United States Patent 7,745,391 (HUMAN THROMBOSPONDIN POLYPEPTIDE) - sequence listing, part 64

SEQ ID NO: 220037 - DNA, 664 bp, Homo sapiens
gaacagcaaagagatagttgtctgcaagctcattaaaagctttaaaaagaacatgagggacaaataatttcttagtcctctgcaatttaaagatcaaggtgatagtacagaaaacacagatctgtgaggaaaacgctaaagttgacagtttaagtacctcaataaaaaatgaaaaataattttaaaatcaaatgcaccattcatttaaagacaaaaactacactgccaattcaaagccaccaaaaaatgaaagttacttttaagaaattgacttttaaatgccaaacatatatttttcaatagttatagtaataatcatttaaatatatgatactgaaaatgtataacaccttaagtggtttatttttcacactaagctccaaaataagatttttgcttttggaggatgtggttcttctccaagatatgagtcaatgaattgaactctttccctcttgtggttttggtactgccaaaatccaactctcaatgtgttttcttgcatcaaggcatgagaaaagagaagtcttagaaaagatacatctaattcctaactgccttccactggcaatactggatatatgataccacctaattgcaagggatccagagaaatacagaccctgactaggcagctacttcccagcaacaacttagcactgtg

SEQ ID NO: 220038 - DNA, 478 bp, Homo sapiens
actgaattctctatctacaggttcaaaccccatattagcattttactctccctagcatccctactttgcatattatctgtcctcgcacatcactcttttagagcacaggcactgagcactccttatctatgtcagcacatgcctctgaagccagcagcagaggacaagctatgatgcaagggaagacattacatggcttgatgggtagctctatcctctgatgaatgagaattttccagttgtctgaaatcataatttccagtgagatgtgggatcagtcatgtctgtcctgggtctgaactagagccggtctgtgtgtctcaatgctctggtcagtagtgcagtcagaaaagcaggagctttagagccatgctggtatgaattctaattccagttctgccacttaatagtcaggaaaataattactttccaggaggcttggtttactttcctaaggcaagaacgctaagtggaaaaa

SEQ ID NO: 220039 - DNA, 399 bp, Homo sapiens
ccaagaagtcccctgccctgctaaaacagaatgagaatgacttttgggtgcagagggtatttgtattttttttcaaaagctccttgagtgggattggcagattcaaaatatacaaacacaggttggccgggtgcagtggcttacgcctgtaatcccaacactttgggaggctgaagtggacagatcacttgaggtcagaagttcaagaccagcctggccaacatggtgaaacctgtttctactgaaaatacaaaaattatccaggtgtggtggtgcatgcctctaatcccagctacttgggaggctgaggcaggagaattgcttgaacccaggaggtggaggttgcagtgagccgagattgagccactgctctccagcctgggcaacagagtgacagaa

SEQ ID NO: 220040 - DNA, 287 bp, Homo sapiens
tctttttaattttagtcattacagtgtgtgtctagtggtgctggatattaataatattgagcacattctaatatatgttagccatttggacatcctcttttgtgaattgtatcttcaaatccttcattcattattctactgggcagtctgttgttttcttattgggtgtagaattcattatgaattctggatatgagccctttgttggatatatgtattgcaagtagcttctctcactctgtggtttgcattttgttgtgtcttttgatgaacggaagttctttttt

SEQ ID NO: 220041 - DNA, 89 bp, Homo sapiens
ccttgtaaagacatgtgccaatttttctgtgctttctaaaatcattgaaccatttattcacaatttgcctttaaacactttttttccga

SEQ ID NO: 220042 - DNA, 404 bp, Homo sapiens
taaggtaagtgatggaagtcagactcaaaaggctacatactatatgacccgatttatataatattctggaaaagtcaagactacagagatagaaaaacagatcagtggttgacaagggttgcagatgagaggagaggattgtcaaagaaaagtggaaataaagccaggcacagtggctcatgcctgtaattctaacacattgggaggccaaggcaggtggatcacttaaggtcaggaattcgagaccagtctggccagaatggtgaaacccggtctccactgaaaatacaaaaattaggccaggcacggtggctcatgcctgtaatcccagcactttcggaggccgaggcaggcggatcacgaggtcaggagatcaagaccatccttgctaacacggtgaaacc

SEQ ID NO: 220043 - DNA, 470 bp, Homo sapiens
gtactcttaatacattggaggactttgggttggaagaggaatatgagagccagtgctttgagaatgtcttctttgtactgatcaggattccttaagaaagcttgctaaaattcctcatagcaagtgcagtgtggctttgtactagtgtcctaccaagagctacccttgatcccttcctcctagcaacagaagtcattagtctttagagagtgaaaaggactctcaaagacttgcagattcctagaaatagaatgccttctgtgtgtctgggggttttcccccctgaatattaagtaaagataaatctttccaaattttagcccaacttttttatctatactatttaatatgtaaatcagctatatacttgttcagtgtatgtctatctctcttcctgtctctccgtacatattttaaataaattttttcctgatgaaaagttatgagtggtcattgtgaaaatttggagg

SEQ ID NO: 220044 - DNA, 761 bp, Homo sapiens
caagccaaggaaccccaaagattgcaaccaccagaacctaggaagaagcacagaaagattcttccttagagctttcagaaagcatggaactgccaatgccgtaatttcagactgttagcctctagaatggtgaaataataaatttctgttgttttaaaccatcccaagtttgtagtagtttgaaatgaaacctgtaggaaactagtacacttgatgttgggggtggtatgtttgcttttagataatttaaaaggaaatgtgttgtaactattgttggtagaaagattgatatggaatcttggcacatactttcttccttgtgttcacaggattaaagtccactccttttcttttggggaaggcagaaattggagcagaaaaatgaatactaaaatcaagactaaattaaaaaaaattaaaaatcagactgaaaccagaggcatcaatgtttaaaagacacacaaaaaaggaagtggtgtgggacttatctcattcgaggagaagtagaaattcttcagaagggaattggagcttctggaccagggagggacctaaagaaggcctgaggcttgatgattagaaagcataatggtggttgagaggaaacaagacagtgttggagtgggatgcctttcaaaaatacacttcttcaccccttcttttatagtataaatgcactctttatttagcgtatgtttacttcatacattttggatgaaatttggaagtagttttcataagtaaaagaactgctcaagcta

SEQ ID NO: 220045 - DNA, 434 bp, Homo sapiens
tctcttccccttccctaaggaacttcaggtaagtgtagatcagatttcagatctagtgtttctagaacttatttcctcagtctgtattctcaacttctagcaaatggatatttacagagcattataggctctggaactagaagatactgcattcttaacaatataacaataacatagcttaagcacttatcaagttatatggtagattaccattagtaatacattgaaatatattaaatttagtttttggcaggctggataaacaccctactaattttctaaatttgtaagtagaactcttcatattttgattattcatgccaatacttcctcttcactgtatactaaactgaatgattaagattcatttgctcaggagcatgaacatttatgaacttaaattttgtgataaaaaagctatttaacgtcgacgc

SEQ ID NO: 220046 - DNA, 301 bp, Homo sapiens
ggtgggatgttaggtaggacctatttacttcttggaaatcttccccttccctctctaaatatcctcctaagaaaaaagtctaaagacatgactccctggcttggcctctaacgtcgtgtccggacaagtgaggaggcctccagaagccctgggggacctgctctctgggaagctgaggtcattctcctctgaagtagcaggccatgaaatacatctcagtccccgacaggcaggctgctcccacgtatcagccgaatgaacatagatggtcacccaccctccctccaagaaaacctgcttg

SEQ ID NO: 220047 - DNA, 296 bp, Homo sapiens
gtatgctcagtctattagtggactaacagtggaaataaagacctattggaaataaattgaaatcttgaaactaatgatagtggccctgtgacatttctgaatgtaaaagttgggtgtgacttccagttgtctccatttggggagatatcgaatgcatttatagttatatatgtactaatgaatgcatgtcaggtagagaaagcttttaaattatgtatagaagtatatgtagatggagcaactaaggtgaaaggttttgtggagtaattaaaacttcccaacatatccaacaaaat

SEQ ID NO: 220048 - DNA, 295 bp, Homo sapiens
gttaaggaaattggtgtctcaactttggtgctatctgtagcattctgtccaactcaggcatattggcctgggtgagtgataatcttttctgaaagtacagtgtttgaactgtactctacacactttacttgtatttatctcattttattcatcataaaaccttccaggattggggaatgcaggggtccttattattaactctatattatatataggataattgaaacttagaaaggtgtatcggccgggcgcggtggctcacgcctgtaatcccagcactttgggaggccgaggc

SEQ ID NO: 220049 - DNA, 817 bp, Homo sapiens
cattgcttataaaaagtcatcagctcagctacctgcatttgggagtctgggtgttgagggcggggatttatacagcacctggccttataagttgagtattcatgataggtgaagaggtgaagttttttgttcatgagaatcactaatgaaaatcagttgtttagaatgtgaagggcacagcctacactgctaaaacactccccctagtgggagtttggtagaatacaaccaagccccctgtgtccaaagagggagttggcctttcattgtactccgggtgatctctctccattatccgcgcaaaggaagggcccgagagcaggaacaatttgatcttatatttctttgggttttgtttcaaaatttattttactttctttaaagctctatcatgttaaatatgttctgtgcagttaaaataatgcatgttctttgctgaaaaaaaaaaaatagaagtgtagtctaggatatactggggacaaaggggaagtaaccagagattaaaccttcttttaaaaattaccagtcgggcgtggtggcgcatgcctgtaatcctagcccttttagaggccgaggaaggtggatcacctgaggtcaggagttctgagaccagcctggccaacatggtgaaaccctgtctccactaaaaatacaaaaattagctgggcatggtggctcacacctgtaatcccagctacttgggaggctgagacaggagaatcgcctgaacccaggaggcagaggttacggtgagctgagactgcaccactgcactccagcccgggtgacagagcaagactccatctcaaaaaaaaaa

SEQ ID NO: 220050 - DNA, 950 bp, Homo sapiens
tagaacaaagacattcatgtaaaggaagtcattcacaagtgtttgccaccaaattataaatttacatttttttagccagtaaatagaagaaacaacctatggtgtataatcaaatatattacaactcaagtgggtaaaattattaaaattaccaggaagaagaaaaatctaattaaaaaataagtggtacatcagatgttaagtgaccttagccagctcattttaacatctgagcctcagtttcccctacagaacagggacagaagtacctactatacttaaaatgcagggctgaagtaatctcttaaaatttgtcatgaaagctataaagtaccacgtaccagtattctgtatattacatgttttaacttgaaaaaattaaacttacacaaacagtatttctttggtcactgacactactatgtaataagtagaaccggcagtttagaacgaatagttcatgagtaatatactgtgtggtaggaagtggtaggaactattctttacccttgcaaagcaatcatcttttttttttttgagacggactctcgctctgtcgcccaggctggagtgcagtggcacaatctcggctcactgcaagctccgcctcccaggttcacgctattctcctgcctcagcctcccgagtagctgggactacaggtgcctgccaccacgtccagctaatttttttgtatttttagtagagacagggtttcaatgtgttagccaggatggtctcgatctcctgacctcgtgatccgtctgcctcagcctcccaaagtgctgggattacaggcgtgagccaccgcgcccagccataaagcaatcatctttaatacatgctgttcttcatgtgaaatgtctgttacaagagcaaattcaggagctgtacaacatactggcattacgttaaccgtcgacgcggccgcgaatttagtagtagtaggc

SEQ ID NO: 220051 - DNA, 421 bp, Homo sapiens
aaggcacagtgccagaggtctgtggagagggggtcaagcacctgggttcctgaagaacatggaggtgtgggagtgattccagacagctgggatgtgcagagcctgagagagtgccagggagcgggttgggagttgaaagttgggtgtggtggctcacgcctttaatcatgacactgggcggcagaggcgggaggatttcttgaggacaggaattcaagaccagcctgggtaacatagcaaggccccatctctactaaaaataaaaaaactaacagggcacagtggtccaagcctgtagtcccagccacttaggaggctggagcagaaggattgctttggcccagtagatcgaggctacattgagccatcattgtactccactgcactccagtctgggcaacaaagtgagaccctgtcttaa

SEQ ID NO: 220052 - DNA, 443 bp, Homo sapiens
tatgcttctcacagacaacgtggttcctactgtcagatcacatttggggcgggaagggtggttttttaaaaaaactcgtttttatgagcaggctatcttgatcaatagcaaactttttttaatggattagtgaaataaatgtccccatgcatcatttatagtctgtttctttctccgtgtggaatcaagataagactgccagcactagacggtttctgttagctgctgagaccagggcctcaccttgctcaagctagtgggtgaatttgcaaccagctaatactcttccttggtttgtttccactttttatctgttggttgttggctttcttttccattctgtattttctatctgactctgtatactgtataaagcagttttttcttgtctgtttatctttcttcaactggaatatttacaataaaacagaaacaaatcctga

SEQ ID NO: 220053 - DNA, 247 bp, Homo sapiens
ccagctccgtctctcaccagttatgtgacttcgtgaagcacccaagtttccttacctgtgaaatggcaactcgaacatctctagtgctgagctacagtaaaggaccacttgggacaacacctgcacgtcctaagtgctcaaaaatggaaactgctatatggtaaaatagccctatacagtccaaattcctgtgcctgacaaaaaggttttttgaataaatgaaagattcatttctttcagcccacgg

SEQ ID NO: 220054 - DNA, 364 bp, Homo sapiens
ttcagctcggtaccggaagtgaaacgcagctgcaggagacggatgcaggaacttggggcagtgagggatgcccaggcctctctctgggctgcctactgctgcgtgattccagggatctgccacctccacggccatccatcccaaggaattgtttagatgttaaaatccacagcacgttcctttgctagagtctccaaggttaaggctattagggtggtaaatctccatttgctaagagaagcgggaagatccgtacacagggtgaccatctgagaaggagctatgtttttaactaaagaaaaaagaatgtcaggcgtagtggctcatgcctgtaatcccagcactttgaggggaaaagaccctg

SEQ ID NO: 220055 - DNA, 1998 bp, Homo sapiens
ctggcccacctccagaagtatggctatctggctttccacaactgaccaaaggtacaagagcaagtccggcctggacgagctgagccgcacaagatacagactcagaagcaaaaatacaagtgaaataaataaaatgaagtttggtcatttaaatttgtgcttctttgcaaggcaccgtttttgcagcagtggataactggcaaaacaactcacttgtcattattctaattttgataaaagtgaagaatctgaagctttctgacttgcaaaaggatttgtcaggtaagtaataaagctcggggaaatttaacaactagtttttccaagactcaacaaatgactatttgttgctatgtttttagttagaagcaacttttaaaaaacatacagagaaataattggaaaaatcagtgttgttcacatcaatgcacacttgtaacacaatgtattttataaagtatcacattctttgaaaatatttgcaaagttgcagagttcgcttattcagtttatataaaaatataaccaaagttttggctgggcatggtggctcacgcctgtaattccaacactttaggaggccgagggggcggatcacctgaggtcaggagttcgagaccagcctggccaacatggcgaaactccatctctactaaaaatacaaaaattagccaggcatggtggcagaggcctgtaattccagctgctcggaaagctgaggcaggagacttgcttgaacccgggaggcagaggttgcagtgagctgagatcgtgccactgcactccagcctgggtgagagagcaagactctgtttcaaaaaaagaaaagaaaagaaaattaaaataatgtttaatacataatcccaagtaactgcaagagtaggagaaaagacaatagtgataccaacatggacaagtggtaacagacttaacacacctaaaaagacaaatcctaaaccagcagcagagaactggagaacaaaccaatctgtagttcagggtgctgaaaagacccaggaattatcagcatcaagataaagagtcattagtgctgttcacccactatttatgggttctcctctgagtataagattgtacatttccacacctctgaagtaaggagcggccatgtgacttactttgaccaagaagatgtagtcagtcctacttgtggatgttttggatggggtatattttacaaaattcccttttcttctgccttggcaaatatgaaagcacagagacagaggctcccttaggttgggtactttgatggatggcataccacacaactttgttctttgaaggcagagatgatttggatttgcttattaccaatatcaataatctatcctggcacatgcagtcaggtatctcaaaaccgaagatatgggaagaatggtaaaagaaagaagacagaatgacagctatataaaaaagttacatgctttgttccaagcccactcttctagcactgaacagttttcttcactcagctccaaggatgagggcagtcagacatttactctccacagaagagaaggaaagaatcttccgtggaaaatctggccagtttaagaagaaatatatgacaatcttactatcagaagctctttagaaaattgtgcagccacatcatccaacagaaaagctcaagtttaacgagcatcacggcttcacactcacatttagaatttccaatcagcttcttaatcacttcttcttaaatctgagcagatcatctgagaaaaacctctaccacaaaatgtaatgtcagaaaaaaaaaagtaaaaggaacttggagaaaatcaaattattcaaggaaaagtaaacatgtaaaaaatactatcaacattctcagagcgataaggaacctgtttcatccatgaagcaggaacaaatgctataaccaagcaatattcagagaacaaaagcccactaaaacaaaaaactttaatagattttttttagatgttaaatttaaagatttcctaaaaa

SEQ ID NO: 220056 - DNA, 740 bp, Homo sapiens
gaaagaaggaaataaacacaggcaccaaaccactatcctaagttgactgtcctttaaatatgtcaagatccagacttttcagtgtcacctcagcgatctcaacgatagggatcttgtgtttgccgctattccagttggtgctctcggacctaccatgcgaagaagatgaaatgtgtgtaaattataatgaccaacaccctaatggctggtatatctggatcctcctgctgctggttttggtggcagctcttctctgtggagctgtggtcctctgcctccagtgctggctgaggagaccccgaattgattctcacaggcgcaccatggcagtttttgctgttggagacttggactctatttatgggacagaagcagctgtgagtccaactgttggaattcaccttcaaactcaaacccctgacctatatcctgttcctgctccatgttttggccctttaggctccccacctccatatgaagaaattgtaaaaacaacctgattttaggtgtggattatcaatttaaagtattaacgacatctgtaattccaaaacatcaaatttaggaatagttatttcagttgttggaaatgtccagagatctattcatatagtctgaggaaggacaattcgacaaaagaatggatgttggaaaaaattttggtcatggagatgtttaaatagtaaagtagcaggcttttgatgtgtcactgctgtatcatacttttatgctacacaacc

SEQ ID NO: 220057 - DNA, 429 bp, Homo sapiens
taaacttcaacagttaaattaacaaaactgctcgccagacacactacgagccacagcttaaaactcaaaggacctggcggtgcttcatatccctctagaggagcctgttctgtaatcgataaaccccgatcaacctcaccacctcttgctcagcctgagggactctgaagctgggagtccatgctgttggatgctagcatctgggagtccatggtgttggacgctagcatttgggagtccatggtgttggatgctaatatatgggtctccatggtgttagaagctaatatatgggattctggggccatcaagggatccactcctactgttacagaagtctcccccactaatgtagtaggcagctcctgtgctaccgtacttataggattccagcgctgtcgtcgagggcacactccagggaatgcgaca

SEQ ID NO: 220058 - DNA, 439 bp, Homo sapiens
acacaagataaaataaagaggacaaaaaggaataggagttacatagaactctggggaacacttcagcttaaaactcaaaggacctggcggtgcttcatatccctctagaggagcctgttctgtaatcgataaaccccgatcaacctcaccacctcttgctcagcctgagggactctgaagctgggagtccatgctgttggatgctagcatctgggagtccatggtgttggacgctagcatttgggagtccatggtgttggatgctaatatatgggtctccatggtgttagaagctaatatatgggattctggggccatcaagggatccactcctactgttacagaagtctcccccactaatgtagtaggcagctcctgtgctaccgtacttataggattccagcgctgtcgtcgagggcacactccagggaatgcgaca

SEQ ID NO: 220059 - DNA, 517 bp, Homo sapiens
ctcagtctctgcctgtgtgtgtctgtcttcacgtgaccaccttagaagaatactagttctattaaaaaatatatatatactacttcttctaagtcaccagcccatcatactgtactataacctcatcttaactaattatatctgcaactatcctatttccaaataaggccacaattctgaggtactgggagttgggactttaaacatatcttctgggggcaagggagatctgcatacaattcgatccataatactgccttgtgtgtttcttttctcagctgattttaatcttaattccttgagttgtttccccttttcaactattacaaacaatgaattttgctgtgtatgtgtcttggtatatatgtgcacacatatctgctgtttgtatacctcagagtgaaattgttgggtcaaatgctaaaatctttttaaaagtagttgtataattttacattgcattggaatgacataataagctatatatcctataataaattgtaaccatgaggctaac

SEQ ID NO: 220060 - DNA, 439 bp, Homo sapiens
ggacccgccgggccagatcccatctctggcgacgcggagaaaaatctggaagccgtcgtcggaggatgaccaaatcctcgctcctctgggagtgcgattacgggcctctcacttcgtaaatcacgcaggcctgaaacgctcacatttgtttaccacgagcatgtttgattttgtaatttaacaaataaaattgcagaggatttttaagagccctggcctggatttaggggaaatctcgcattaattccagctctgccatttccggtctggagaccttggccactttctcttgggaccttgtcttgaagctgtacatccaaggtgcttaccctagctttgcccagccagtatgtttattgggaatactgggggccgtgggggctgcacagataggagcaatgtcgctgtcgacgcggccgcgaatttagtagtagtaggc

SEQ ID NO: 220061 - DNA, 1401 bp, Homo sapiens
  misc_feature (770)..(770): n is a, c, g, or t
tttatattttacccaaacaattagtaaactggtagttgaaaaggaaaggattaagtaatgtagtttctttctccacattctgctgctgcttgaatcccattccaaaacagtttagcatcatatattattaccactctctgaatatcactgttgttgatatgcttaacataccttgatcttcaaaaaggaaaaaaagcgagaaagagaatgagttttggggagttgtctcttttgtctttacatgacacaaagcatgaaacatgttttctttttcagcagtcctttgccatgtgttatgactgaatgttgctccccaaataccatcacaccgggggttagagcttcaacctccagtatgatggtattgaggttagagcttcaacctccagtgtgatggtatcggggttagagcttcaatctccagtgtgatggtactgcggttagagcttcaatctccagtgtgatggtatcggggttagagcttcaatctccagtgtgatggtatcggggttagagcttcaatctccagtgtgatggtactgcggttagagcttcagtctccagtgtgatggtatcggggttagagcttcaatctccagtgtgatggtatcggggttagagcttcaatctccagtgtgatggtactgcagttagagcttcaatctccagtgtgatggtattagggttagatcttcaatctccagtgtgatggtatcagggttagagcttcagcctccagtgtgatggtatcagggttagagcttcagccnccagtgtgatggtatcggggttagatcttcaatccccagtggtggtggttagagcttcaatctccagtgtgatggtattggggttagagcttcaatctccagtctgatggtgtttcgggatggggcttttaagatgtaattagggtttaagatcataagggacctggtctgatggggattagtaggcttatatgaagagacacaagagggcttgctctatctctgactctcccacacacaaagtagaggccatgttagcctatggagagaagatggccatctgcaagccaggaagaaagccctcactagaaaccaaaccctgcaaaaccttaatcctggactcccagccttcagaactgtgagaaaatttatttctgttgtttaagccacccagtctatggtattttgttctggcagcccaagcagactaagacaccatgttcagacagaatttgaaaattacttttaagtttgcaccagaatgtaactacatttgatatttaaggggcaaaagcaggtgtagagtttgtaggaaacctttatgttatttaatccctgtaatcatggtaccctcttgagagtttgcatgtttgaaatatttaaatttaactcactcatgatttttttcaga

SEQ ID NO: 220062 - DNA, 512 bp, Homo sapiens
agataaatggggattcctgtatattgagcacagtaagaaagaagtccagatagatacatgaagctagtttaggaagggattcagagccagggaagaaattttaaccttgacaggataaggatgcagggtgcaggatgctaatcttaacacatcctacatgccaggatgcaggaggacacaactgggaaagagtctggaatcctggtgggcagaaatcaggacgtagagtggagtcatttcaaatagaagttaggccaggcgcagtggctcatgcctgtaatcccagcattttgggaggccgaggcgggcagatcacctgaggtcaggagttcaacaccagcctggccaacatggcaaaactccatctctactaaaaatataaaaactagccaggtgtgatggcgggtgcctacaatcccagctactcaggaggctgaggcaggagaattgcttgaagccaggaggcagaggttgcagtgacagcctgggcaacagagcaagactccgtctca

SEQ ID NO: 220063 - DNA, 567 bp, Homo sapiens
ctcagggcagcaccgttgccacaccagcctcactgtctcagccctgctatctctcactactgagaagaagtcatttccctttcttcgaaatgccatagggtgtcatcagccccaccacacccccctcaccccacggcactccctggcctctgggtaaatggtggctgttggcagtcagcctggcttgctcctcggcctgcggggtggacggaaatgatggatgaattaccaagtttcagccaaggtcattgccccagtgggaatgattcatcagcagatttctcctgtaaagaatctgataatagaccagctgcaggaatgaggggcagaggagggcaattcttagcaaatggggtgttaaatgattctggggttaactgggtgaccgagggaagtatgatgttacaatggaaataacattgtgctgaggcttggtttgtccatctgtaaaatgggagatgaccctagaggccctagcctttgtgactttggcagagagaattgcgcgctgctctggcatgagatgaaggtagggtcatgccctctcagtgccagccccacctgtac

SEQ ID NO: 220064 - DNA, 566 bp, Homo sapiens
gccacacagtatcagctctacctgtggaggtagactaaaagatcggccatgtgagcagtcaaccatggcaggccattaaaactgcacactgaggctcgggtgaaatacagttctcttgtatacggtttctacatggttttagttcctgtggtctactgcagtccaaaaataataaacggtaaatttcagaaataaacattcacctaacttttatacagtatattcttaacaattattctaatttattgttattaatctcttactgtgcctaatttataaattaagccttatcatagctgtgtctgtataggaaaaaacagctatatagagttcagtactatccatggtttcagacatccactggaggtcctggaacatatgttttgtgcataagtggggactgctctgtacgtcatgtgtattgtcacacattaatgctgggaaagtaatactgttcatattactgggagaggacaactggaagctcatatttggaacttgcctggattgtgcctatattagtttcctagggctgctgtaacaaagagctagaagctagggtggct

SEQ ID NO: 220065 - DNA, 474 bp, Homo sapiens
gttagacggagtcttactctgtcacccaggttggagtgcaatggtgccatctcggctcactgcaaccactgcctcctaggtttaagcaattctcctgccttagcctcctgagtagctgggattacaggcacctaccaccatgcccagctaatttttttgtatttttagtggacacagggtttcgccatgttggccgggctggtctcaaactcctgacctcaggtgatccactcacctcggcctctgaaagtgctgggactgcaggcttgagccaccacacctggcctgcctttcattttttgagcccctgctttataccaggcactgtactctctgctttatgtatatttgcatttttcaaatgtggatctgcagacctgttttcaagttatatttaagaatgtcttaattttgctgctcttctagaagatgccctataaccaagtttctatgtttgcatttaaaagaagaaag

SEQ ID NO: 220066 - DNA, 417 bp, Homo sapiens
taaaaatattttttaaggcacatctaaatgccatctttctgcccatccttcatcaatcgtattgtttagttacagagattctggacatttagaaagagttgaaaataaacaactgtatgcaattaagtgtaaaatctgtggtatataatataactaaagggaaaaatcattgagtggtagagttagaagtgttaacaaagaaagtggttttgaacttagtcttaaaaggaaatgtacagtttctattgaagaaggtagtgaatttatactccctaaaggacagcatgagcaaaggcatgtacctggaaacaagggagcatagaatgtaggaaacaataaaaagactaaattattacatggttgttcttttaagccatcaagtctctacatcagttctttttatttaaatgatcagat

SEQ ID NO: 220067 - DNA, 448 bp, Homo sapiens
aaatttttaattgacaaataattgtatatgtttatggggtacattgtgatgttttgatacatatatatttttttaaatgatcaaatgaggctaattaacatattcatcaactcagaaacttactatttcttaaaggtgtttaaaaatgttgtgtgttacaggccgggcatggtggctcacgcctatagtcccagtactctgggaggccgaggcgggtggatcccttggggtcaagagtttgagaccagcctggccagcgtggtgaaaccccatatctactaaaaatgcaaaaattagccaggcaaggtggcgtgcacctgtcatcccaactacttgggagcctgaggcatgagaattgcttgaacccaggaagcagaggttgcagtgatcagagattgcaccactgcactccagcctggatggcagagcgagattctgtctccaaaaa

SEQ ID NO: 220068 - DNA, 401 bp, Homo sapiens
acagtttcatggatggcagatgctggagaaaggcagatatgtgagcttatatcaaaccctaggagattcaactttaaaacctggctctttactcactgggcttgaagattgcagcccagttatattttgctgtttcctcagcagacatttcttctccctgggctttgtggctgtttacatttctgtgcttaattgatccatcctctcaatatcagagataagttggaattagcacaggtaggagcatttctacatgtttcacaagtacttcaatgcaatgtgtatatccatgtattgcagaaggaagaaaatactttgagaactgagcagttaacatgaataaaggacattaaatattataaaccacataacatcataaaaatctaattaaacagtttttg

SEQ ID NO: 220069 - DNA, 414 bp, Homo sapiens
tacatggagtcaagcctgccccccaactcgtgctcagcctgaagctcactgttaccctggccaaccccagctatagtcccacagggcctctcctgtgagtcagtggaccactgcattcattctctggctctagcctagcttgatgtgcttaaaattctcactttgccagcactttgagaggccgaggcgagcagatcacgaggtcaagagatcgagaccatcctgggcaacacagtgaaaccccatctctattaaaaatacaaaaattagccaggcgtggtggcacacgcctatagtcccagctactcgggaggccgaggcaggataatcacttgaacccgggaggcggagattgcagtgagccgagatcgcgccactgcactccagcctggcaacagagcaagactccctctt

SEQ ID NO: 220070 - DNA, 309 bp, Homo sapiens
gtggcgggtacctgtaatcccagctactctggaggctgaggcacgagaatcactcgaacccggtaggcggaggttgcagtgagccaaaatcatgccactgcactccagcctggaaaacagggagactctgtctcgaaaaataaaaaaataaagggggaagaggaatagttaatgatgtatttatcctgtgctcagtaaatctgccttttacataagataaagtaaatagagtagaggaagtcatataggcatttgtcttgggtagacagagcaatgatttctattcttatctttgtcccctgcctgtga

SEQ ID NO: 220071 - DNA, 641 bp, Homo sapiens
ttcaggagctatgaaccatccttccccaaagtgttatcaaactgtgcctttggtggaggcatagctctcgtcggattcttttttgccagaaagatctgtgaacgaaactgctactatgttaactcagagaacagcctccctaataaagaagaggatgtgttcctacaagagccaggttttagttggattgttagtgtgagtgatgaagacctcagaatggctctagaaagaagcccagatctcagctttgcactgtgattgtcccccagcaactttgcattccccctgtatgggaatagggacctgtggattctgttgccatagatccagagattggacctaggaaagtgagaccaggtggtctgacacctacctccagagcggacaacccagagacagagcaggcccctgcaggtgtaggggctggcggcgagaagacagctatgtttacccttgtagactaggaatatcagtatgaatagactagtcctaggctttgaaatgaattttagtgttcattattatttggtcattctaaaaacccctattttgaacctccacttcagagaaatagttctgatgttctcagaaaatgtcaggagtgtatggtgcacagcagtggacaacaaaggaagagaaaa

SEQ ID NO: 220072 - DNA, 575 bp, Homo sapiens
gaggtcagaccctcctcccctgctttggtaccagatctagtggtgaatggatccttgaggcccacaggctttgccctcctccagttacactcacctgtttcttccccttaaggggactgaccccaggaatgtctcccccggctgcaggccacactcaacctccagcaattcatcaaaattaccatttatgcattccgtcctaccaatttctggctctagtgatttctgctccaggtaagctgatcttggctgtgattctctgtattcacttgtttctctggattttagggttgtagtttgccctgaaacctcaatctctgatgggtccaagaaatatcactgattttcagtttgcttaggttttttcttactgcaagaaagcgaataatgacttccacgctctttacatgttggaggtgaagaaattgaattttaaattttattgatttttaattaattaaaatttacatttaaatactcacatggggctagtggctaccttactgaagaatgcagttttaaagttaatcatatctttgtcctcttcctaaactataagatttttagggaactta

SEQ ID NO: 220073 - DNA, 477 bp, Homo sapiens
gacctcaggtgatccacccacttcggcctcccaaagtgctgggattacaggtgtgagccactgtgccaggccgagctcatggtttttcattgtaaaccagggcaggtaaaaactttccttgcaggtaaaacacacctgccaggattaactgtggtaaagagaagaatctgagatactacttagagagtggggcactctggagccagcccatagcagatgatcagtgaatgatatgagcaataataagaggtaatgtttaatgtttctttgtactgacttgggcactgtgccggtggctttgtgtgcttcacacatggaatgcattccatgcatctctgtgctttatgcatttaattctcaaaacagcctcttgtagcattttattacattatgtgtaatacactaaaatatatgatgcatattattattttacacaggaggaccttgaggcttagtaatgtcacactgcttgcccaa

SEQ ID NO: 220074 - DNA, 353 bp, Homo sapiens
atcacaagaacagaacaggaaagagtcacccccatgattcaatcacctcccaccaggtttctcccacaacatgtgggaattgtgggagttgcaattcaagatgagatttaggtggagacacagccaaaccatatcagtatctacacttgtttgttcagagaacaatttcaagtctgtcagcttatcctgcaactgtgcctaaaatatgttccttttttacttaaggctacctggcactgctgtagatgtgtaatatattttgcttaaatgcttagcatgaaagggaagacttccacttttggttgctgtaacccgtgaactttcgccattatgttcagtagactttgtaatca

SEQ ID NO: 220075 - DNA, 517 bp, Homo sapiens
tctgtcttctcaagcacagaccttggtgtcatctttgagggccccatccttgagggcctagattccacatgaaatccatctatgaatcctgctttccagctgtgttacaacagggcctcctctcacctttctcggctggcccaggcctctgcctcagtagggctctaacatgattttcagaaatctcacaggtttttccttgcaagacgcgtgtttcactgtgtctccagtctgcatggatgtgggcgtgtgttgtgatggtcagatggtggagtgagagcagccatagtgtgaggtgtgggtgagggtggccagtcagccgatgagtgggagcgttcagaccggggtgcctggtgcccccataacctcctcggggttcccagggatggcgcctctgacccagcgtgcagcccgaggtgggccccgtgccattcccacttaagcgaagtgtctgttcctctctctgttcaatgtgggttttgtttctgaatatattttctcacacttcttcttcaaa

SEQ ID NO: 220076 - DNA, 641 bp, Homo sapiens
ctccagctgttagtagtagttgaagcattaactgctgttgatatagaaagagtcttttattcttttttttttgtatttttgtatgatgcagttctttttacttcactttagagtagctaccagcatgggatgttttctgtgcacagtctttttaacaaattgttttttctgcatagtactgcagtgttgctttgctaattcctatgtagtcagcttagttctgtcagttgtatttggaatttagtttggaattgttttagcattaaatttacggaagcaatctgaaagtttgttttagaaagttctttttaaaaaattctctcaaactatgcatcaaataaagttaatttttctttctaaaaatatgaagtataaatgtgaagataccttatttttagtatcacctttttaatcttagaaattcagagtatagggatttatcctactagttagtacattcatgtagttttaattgcctaattgtttgaaatttccctaatattatgccgctactcatccggattaaagtgttatgctttcacttatgcttccagtagatgagacctggaaaagataattaattatggattgaagtgaagatactagaacgcatatgtgtttattgacaagattttattaat

SEQ ID NO: 220077 - DNA, 472 bp, Homo sapiens
cacagtggctcatgcctgtaatccctttatggccgggcacagtggctcatggctgtaatcactttgggaggctgaggcaggcagatcacctgaggtcaggagttcgagaccagcctggccaacatggcaaaactccatctgtactaaaaatacgaaaattagctaggcgtggtggtgggcacccatagtcccagctactcaggaggctgaagcaggagaattgcttgaaccccggaggcagaggttgcagtgagctaaaattgtgccactggcctccagcctgggtgacagaccaagactccatctcaaaaaaaaatgatatggatcaatgggttctctcaggtgagaatctgggaggcgcaggcattcagagcttgagactcattcatggttaggagctgggggaagggctgggttctggtccttaagcccaagcctggcttaatcctccttttccataagaaatgctgcc

SEQ ID NO: 220078 - DNA, 505 bp, Homo sapiens
cagctatgatatcaaagtttaccttctctataaaaagtaactgatatggtttttaattctgtcccctcccaaatcttgtgggaaataataatccccagtgtcggagtggggacctggtgggaggtgattggatcacagggatggactttccccttgttgttcccctgatagtgagtgagttctcctgagatctggttgttgcaaaatgtgtagcacttcccttttctctctattcctcctgctccagccatgtaggacatgctggcttccactttgccttctgccatgattgttagtttcctgaggcctccccagccacgcttcctgtacagcctgtggaactgttcaccaattaaacctcttttctttgtaaattacctaatatcaggtagttctttatagcaatgtgagaatggactaatacggtaaccaaattattaagtgcagcttacctttttatagttcgtacattttaaaaataaaatactacagagccaccaattaa

SEQ ID NO: 220079 - DNA, 498 bp, Homo sapiens
acctcacacatgatccttccttcgtgttgagaacattccaaatcttttcctctagctattcagaaatatacactaacttaccgtgaactgtagtcactgtgacatgctattgaacactgggccttgttccttctccctcactgtatttttgcagccaatagccaaatcttgactattattttcaaatagatcaagagaactattatctattgaaagcccaagttgacaactcttttgtactgtgattatggggagaaggaaagtgacgcatgggtcagacgttgggctaggggttctcatctgcccaccttccttaaccatgacaataatcctaggaaggaaatagtccagctttacagatgtggccattgagactcagagcatttcaatcactagcccaaggtctgcaggaaacagcgtggctgagggaacaccagtgggcccacttcaaattctattgtctttcccctcggcatgctgcgatgagatacctgtaat

SEQ ID NO: 220080 - DNA, 675 bp, Homo sapiens
  misc_feature (591)..(591): n is a, c, g, or t
gtgaacactggagataaccaacaaaatatttcaccaagatcttatttacctaagtattccatttttctaacttatttgaacagaggaaaagtccaaatcccttcactataatagcaaatggcaaagtactacgtatttctattttgcagtattactatgaagaagattattacaaatgcatgggctgtgacgataacgttgtagatgtggtcgttacctagaaggttgcctggctggcccagctcggctcgaataaggaggcttagagctgtgcctaggactccagctcatgcgccgaataataggtatagtgttccaatgtctttgtggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctnctacacctacctctctctggtgagtcccaggaccccctggccctaatttcctccagctgcgcacctccgggcctccactggccc

SEQ ID NO: 220081 - DNA, 587 bp, Homo sapiens
tgttcgccatggccggagtcccctgcaaggccccggccacctctcagctctctggctctgacctctccccactcctgcaggctcttgtccccagaaaggctctgttcctcaccaccattcgctctggataccttggggtgtagcccagttgaggatctgaaccaaaaagcccccatctcagagacacagcaatggttgcatcagcactggttctccagctactgccggatgctggccaacttcactggtctggatctgctgaagcttacatgccaggaccttatccaaatctgcggggctgctgatgggatccgccttttcaatactcttagagccaggtgctggacactgccaaccagggtccccttcccactgtagtggcccttactaacttagctagcaggtaggaatctagtcctctttttccatacagaaaaccactttttttttttttttttcctgagatggagtttcgctcttttgcccaggctggagtgaagtggtgaagtggcacgatctcagttaccgcaccaggcccagaaaaccacttttatattaaacagtaaacgctttcttaaaagataaat

SEQ ID NO: 220082 - DNA, 264 bp, Homo sapiens
aaaaaaaaaggtttgactcagttttgcttttcacgtttaggtcagtaaccaactgaaattgatttttgtgtatcttgcaggtaggaatctagtcctctttttccatacagaaaaccactttttttttttttttttcctgagatggagtttcgctcttttgcccaggctggagtgaagtggtgaagtggcacgatctcagttaccgcaccaggcccagaaaaccacttttatattaaacagtaaacgctttcttaaaagataaat

SEQ ID NO: 220083 - DNA, 395 bp, Homo sapiens
gccactgtccgtgggagtgatagaaccccaagtgctgctctcacaactcaacatggtggagtttcactgggacccaacaaagaggacatctctcttcctgcagttcacacctcggaagaaaggtggagagaaaggcatccctttccgcctccagatcgacaccttcaggcccagtgacaaggggctgccgctagaccacctgcactcagctggctgcctcatcaaggtgtttaagcacaaaggagcggaaactgaaaatggaccgtgagaagatggagtttcgctcttttgcccaggctggagtgaagtggtgaagtggcacgatctcagttaccgcaccaggcccagaaaaccacttttatattaaacagtaaacgctttcttaaaagataaat

SEQ ID NO: 220084 - DNA, 478 bp, Homo sapiens
ggaactttgaaattgtcaaactgagagtttaaaataactaatatgctaagggctttcatggaaaatggacagtgtgtaagaacagatgggtaatgtaagcagagacatggaaattaagaaagaatcaaaagagaaggctagagaaaaaagctgtaacagggagaattcctttagtgggcttatcagtagtctgggcaccactgaagaaagaattggtgaatttgtagttatatcaagagaaacttcccaaactgaaatgcaaagacaaacagaagaataaatgaaaatgaaaatacatcaaaatttgtggggtttaataaaagcagttgcttagcagtgttaaatgtatgttagaaaagaaaatctaaaatgaattatctgagctctcaccttagaaaactagacaaagagcaatacctaaagcaagatggggggaggaatcagaaatcaatgaaattaaaaataggaaaaaaataat

SEQ ID NO: 220085 - DNA, 665 bp, Homo sapiens
agctgcagctataagtatttaaataaatcatcaaagggtttgttgcatcagccaagctttttagagtcccaaatttaaaagctgagataaaatcttatcttgctgtgtctttacggaaggatccccagatacctggggttaaggtctggctcaagtcaggacctaggaagcagcatatgttgactggagagacctgggtttgaatcccagctgtgcatgttattagttatatgaccttgggcaagattcacaaccttagcccttctttaccttctcaccctaatctggggtaaacatttgtaccttttggggttgttgcaaggattaaaagaggcaaactctgtgacaatgcctagctccatgctggacttaatataaatgctcaataaattttgacaccatcttctatcccccatatcctacaagataaaacaagacagaatgagaaagtgcttaggtttcttcatctgtaaaaaggtaattggaaaaagaaaattaaaggcagaagctcactcagcctctagggtctgggagatgtcttcttgttgtttaagttttagtctgtactttctaaaaaccagtagtgggcctctggcatttcctggcacatcttagcagataggtattgaatatataccatgtgccacagtactgcgccctttgta

SEQ ID NO: 220086 - DNA, 256 bp, Homo sapiens
tcctgagtagctgggattataggtgtgtgccatgatgcctggctaatttctgtatttttttagtagagacagggtttcaccacattggccaggctggtctcgaactcctgacctcaagtgatctgcccactttgccctcccaaagtgttgggattataggtgtgagccactgcgcccagctgactacctactttgtgttagatattttaataggggttttgcagacctttctcatttaattctcatagcacccacg

SEQ ID NO: 220087 - DNA, 584 bp, Homo sapiens
acccgggaggcagaggttgctgtgagccaagattgtgccactgtgctccagcctgggtgacaaagtgagactccatctcaaaaaaaaaaaaaaaaaaattataaggaacataaaattggttcagcagccatccagccagaaggtggtaagtcacccacaccatttaataaatctgaaaggtagcttaggattcatcaggttcctgaagtcttattagaatctctggaatctgatgagggccccccctgctctcttgaactagcaatgaaagaaaattggatcatcggataaaaattggagctatggtcggccgggtgtaatggctcatgcctgtaatcccggcactttgggagaccaaggtgggcagatcacctgaggtcaggagttcaagaccagcctggccaacatggtgaaactctgtctctactaaaaatataaaattagccaggtggggtggtaggacctgtaatcccagctacttggaaggatgaggcagaaaatcacttgaacctgggaggtggaggttgcagtgagcaattgcactctagcctgggtgacaagagtgaaactccatctcaaaaaaa

SEQ ID NO: 220088 - DNA, 395 bp, Homo sapiens
ttaaatataagtggtttaaatgctctaaccaaagcacaaagattttcagactacataaacaaaatctaaataaatgctgcatatgagaaataaaccttggctgagcacagtggctcacgcctgtaatcctagcactttgggaggctgacgcaggcaaattgcttgagctcaggagttcgaaaccagcctgcacaaaatggtgaaaccctgcctctagtaaaaaaaaaatacaatatttagccgggtgtggtggcacacacctgtagtcccagctgcttggggggctgaggcaggaggatcacttgaacccaggaggttgaatctgcagtgagctgagatagtgccaccacactgcagcctgggtgataaggtgagaccctgtctcaaaacaaaac

SEQ ID NO: 220089 - DNA, 438 bp, Homo sapiens
cttctcagaacagtgttcagacaggttataggaagtgtgatattatagtaaataaataagctttaggataagatagatgagtgcaaattgttctgtcatttagtagctgtgttagttgggaaaactactcatcatctttgagcttccagtgccttcactataaaacagaattcagcatacctacctcgcatgggagtgctgaacattaaatgagattatggattcacactcacataggatggctagaataaataagacagactatacaaagtattggtgaggatgtggtgaaattggagccttcattcattgctggtgggaaagtaaaatggtgcagctgaggcctggtgcagtggctcatgcctgtaatcccagcactttgggaggccgaggtgggcgaatcatgaggtcaggagtttgagaccagtctggccaaca

SEQ ID NO: 220090 - DNA, 556 bp, Homo sapiens
ctcgtaagggaaaaaaaaaaattagaggaagtgaaggcccagtttaaaggaatgggaaggagatggcacacaacgaatgctgccatctctgaaggatgaaggggctgataaagtaaggcctgagtgggaaccttaggactattttgggcaaaaatagttacagccttggtctaagcctgaggaggaaaggaccctgagaggctgggctctggatgtaggttgggcagggtaaagacaaaggaaggaggattcttgggtgctaagcttcctcttttatgaatgagaactaagtggagaggaggagaaatgggatcccagtgcaggcctcagaaggacccgagcaaagctacagcctcttggggaccttatgcatggtaaaaaggtcaagtagaaatggtctgaccattttcattccgagccaaaggaaaggccagttgagagctaaaatcacaaccccctcagcttttgctgtggaacaggagtgcccaaagaatatggagaataaggggaactccaggcaggattggcctaacctcagcctgccttgcttgtgttc

SEQ ID NO: 220091 - DNA, 569 bp, Homo sapiens
agaaagggaagaaagaaatgaatacacacgctctggggtgtcgactgttggaggaaaggctaggataagaatctaagcctcccactccagggctttgggcatgcaatcctcagatgaaccatcaccaaaggaagactcggcaatgtggacaggccttctattgcttaaaaaattgtagctgggcacagtggctcatgcctgtaatcccagcactttgggattacaagtgatttcaggagttcaatgctgcagtgagccctgagccatgatcacgccactatagtccatactatgtaaaggaaatggcacagtaattcttagaaaataattaagaaacggccaggcgcggtggctcacgcctgtaatcccagcactttgggaggtcaaggcacgcagatcacgaggtcaggagatcgagaccatcctggctaacacggtgaaaccccgcctctactaaaaaaatacaaaaaattagccgggcatggtggcgagcgcctgtagtcccagctactcgggaggctgaggcaggagaatggcgtgaatccaggaggcggagcctgcagtgagcc

SEQ ID NO: 220092 - DNA, 425 bp, Homo sapiens
tcagacagtctccctctgtcacccaggctggagtgcagtggtgtgatcttggctcactgcaacctctgcttcttgggttcaagtgattcttgtgcctcagccccctgagtagctgggattacaggcctgtgccaccacacccagctaacgttttgtatttttagtagagatggagctttgctatgttggccaggctggtcttgaactcatgtcctcaagtgatcccccacgctttggcctcccaaagtgttgggattataggcgtgagccattgggcccagcctggaaatatttttttgaaacatgactgataagaatattttttgaaagaatgacagataccaatcatgaaggaaaagattttcacaattgacaataaaaaactttaacttctgaatggtaaaaagagtgagaaaattaaaagc

SEQ ID NO: 220093 - DNA, 562 bp, Homo sapiens
gcattaattactctaatacaggcttcctgtggacttaacattacataattgtgcaatttaacgagaatatgcattcttagacatgagtacagtaactaattagcattgtatttgacaatttgtagcacggttttacagagatgcttcccaacactgtatctttacaatacctcttccattttttttcaaatgtccttgtgctcttctatgctctgaactctaggtttatccacctatgatatacactgtacatgcaataactgattcattcttttggctagagtaaggtttacattaaccttcttatgtgcgatggtttccactattcctgagctgcctgctgatctttaatttttgtttctcaactatttcctcaaaactttttcagctaccctacattttatatccattgtgataaatattagatattggtaagttcaatgctccttttgtacacctgttgtcatccattatggatcaaaactgttcaccagatacaaaatagataggaggtgaggccacagtagaggacacagcatgcattgcaaacctacctacttga

SEQ ID NO: 220094 - DNA, 442 bp, Homo sapiens
aatcccagctactcgggagtctgaggcgggagaatcacttgaaaccagaaggcagaggttgcagtgaactgagagatcgtgccactgcactccagcctgagcaacaagagcaaaactctgtctcaaaaacaaacaaaaaaccagtcatgagttttataagttggaagtgggattgttgtctaaagcttgtcatgataataatcacctttgaacaaacgcagcgggtaccaatgcagcacccaccctggctgtcattcattctaagacacctgataattttgtatgccactaagaaagaaaaaatatgctactaattaacattcaactcgcctgttgatttaaagatgttttctgacttgagagatgttaaaatatgaacactgtgtgtcttaagatggatgaaaaccagcatttcccatgcatggttcctgacttccaaacc

SEQ ID NO: 220095 - DNA, 495 bp, Homo sapiens
cattaggggttgaatttttttgtgttgtgggggattcccctgtgcgttacatgatacttaacagcatccgtcacgtctacccctagatgccatggcacacgctcagttgtgataaccagaaatatcgctagatattgctgacactttgacaatattgagttttcttatctatgaacgttgactgtctttatttttgaatagttctttgatttctttcatcagagttttgtagttttcctcttatagatcttgtacatattttgttagatttaaagctaaatgtttcaattagaaggatgctaaatgttaatgtgttttaaatttcatcttccacttgttcactgtgatatataagaaagtatttgacttttttgtatattatccttgtattctacaagtttgctgaatcacttattagttccaggaattttttttttttttttttttttgtctactctttggattttctacacagacaatcatgtcatctgcaaa

SEQ ID NO: 220096 - DNA, 226 bp, Homo sapiens
aagaactgaatttcagtttacatttaaatacccacacaaggctagtagccaccatattggacagcagcagccctagagcttttattaaaattaaatattcccaaggaaatgaagaagtagtatcagaaacaaaaatgttcgctttgttgtattaaaagtgttcattcctaagggatgtcccctcagaatatctagaagattctttcagaccagatttgagatataa

SEQ ID NO: 220097 - DNA, 581 bp, Homo sapiens
  misc_feature (7)..(7): n is a, c, g, or t
accagcntgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagt

SEQ ID NO: 220098 - DNA, 539 bp, Homo sapiens
acgaacaaaaataattcaaggttaactcagtgataacacttttctattcatccaattataattttctcaaaattccataataaggacacttgtggtagcagtttcataattaaactacacattttcaagggtttcacttatgtatacaccactgggttaaaacttcataacatttttggacctattaattagttggaaactggattgttgtttattagcattaactcaatatcaatcaaaaactgatgatgtgtcatcagattgccatattgtgtcagttttaggaatttatttagaataagtttagcaagaacttagacttctaaaatctgttgaattgaatgcatctgttgcatctttattggtttattaaatcaattttgcttcaagaggcaatttagtgtcatgatgatattagtatacatgataatttggcaaatgtagttttttgttttacttttaaaattgtgcatagaaatagatctctacaaataaaactgatagggaagaattatgcaaaacagctgcaagattttgtt

SEQ ID NO: 220099 - DNA, 540 bp, Homo sapiens
ggatggcagattggagagaggagagacttagactgggaagtcctttaaaaggtgcttagcagtggtggaggcaagttgaaaagttcagaactcagccaacatgagaaaatgggaaaattttgaaagtcatttcagacttaagggactagttgcaagtggatagggaggaagaaattggagatgaagatgggcctgcaggcttttggttggagtaattttgtagatgatcttgttctctgatctaaactcttcttgcttagctaaatggttcctcgttttttctttaaatcaagagatccagagatatgaaattacacttcaggtttaaaccttaaggggaaatattctttgtcaaagaattaaagattagatgccataaaatatactttctgtacactcatcaacccaggtcaggagaaactaggttctggagtcctacgtggttagttctaggaggtaccaacagtctctcaaccaaaggatgagcaatgagtcatcttagaagggataaataagaacatcatatccagatagggaaac

SEQ ID NO: 220100 - DNA, 424 bp, Homo sapiens
tggccggtcgcggtggcgcgcgtttgtcctcccacctcagcctcccaaagtgctgggattacagtgcgtgagacaccatgcctggccaatgagtgcagtttttgtgctgtatgttggttttggttttatcaaaatgtgtggttcctaataggataacttgttttactcctggtgtattatcatttatgtttatattatttgagttttattgttccaatctctaaatatatagcctagggagaatgttttatttttacatctgagttagagatgtggagaggttagtgtaagttgtcagaaactgtatttcagttggtttagtctgtgtttatgtgtatgatttagcggttagtctgttctattgtccttagttgcctatatttcctgtcttcttccttctgtcctttctttctgccttttcttt

SEQ ID NO: 220101 - DNA, 605 bp, Homo sapiens
tatggcagtagttgttccttgatgtaacacttgataatccagataggagctatttcttatcttatctgctctgctcaatgtctgtttttaacctttctattcatcaaactacatacaaaacataaatgtatttcacacagaaagtttgacaattctatcagctggattcaatttttttaaaattatttgaaagaacacagaatgtctctttttggtatagagatatccctaatgttatatccttacattgcaaacttctcgagggtaaaaatctctccaatcattcaacatgtttttactttctattcttgatagtcacacgtggctgttgagcattagaaatggcttgtgcaaattaaaatgtgtgatacatgtgaaatacacactgattttcaaaaagaataaaaaagtaaaaacacctaattaataacttttattcttctaaaccattaaatagtatttggatatactgggtcaaatgaaatatgttatcaatttcacctgtttctcttcatcctttttaatactgtgactactagaaaatttacaattactcaaaaaataaaaataaataaaagtattcacacatgggtcatatttctatc

SEQ ID NO: 220102 - DNA, 236 bp, Homo sapiens
cagtggggtattcattttcagttctgcattttattccattatatgaatacaccataatttacccattctatttggaatttaaaaaacctagaaacaacccaaatacccaccaagaataatgtggcttttaggttatagagtatgtacatgttcaacttaaaagctactgacaaaccttactattcatttttacaactttatttacttatttatttatttatttatttatttgagac

SEQ ID NO: 220103 - DNA, 464 bp, Homo sapiens
agtatgaggatctttataacaatttcgccagagctctaatgcaacaagagtgggtgatgagcgtaacaagtggtggtcaaatggctaccccttaatacctgaacaactataaagagaacaatcagtggccaggtgtggtaactcacgcttgtaaccccagcactttgggaggcagatcccctaaggtcaggagttcaagaccagctttgccaatatggtgaaaccctgtctctgctactaaaaatacaaaaattagccaggcatagtggtgcacgcctgtaatcctagctactcaagaggctgaggcaggagaatcacttgaacccgggaggcggaggttgcagtgagccaagattgcgccactgcactccagcctgggcaacgaagccagactctgtctcaaaaacaaacaaacaaaaaacaaccacaacaacaaaaagagaacaaccagcaaccaagtgttc

SEQ ID NO: 220104 - DNA, 492 bp, Homo sapiens
ttgacctggaagtcttccagcccttagatccatagggctggttctaggcaagaaggtctgtgtctccctcctgagaagcctccgataccccctgactctgggagagacttctaggcatcattctaataacccagcttcaaacttactgcctatgcagagagctgatgtgaaagtatttgcattttgaagggggactccacaggactcaaagaaatgcatttcattttgttttgttttaagatagtctcactctgttacccaggctggagtgcagtggcacaatctaggctcactgcaacctctgcctcccaggttgaagcaattctcctgcctcagcctcctgagtagctgggactacaggcgtgtgccaccatgcctggctaattttttgtattttttggtagagatggggtttcaccatgttggccaggctggtctccaactcctggcttcaagtgatccacctgcctcggcctctgaaagtgctgggat

SEQ ID NO: 220105 - DNA, 260 bp, Homo sapiens
tgctggaattacaggcgtgaggcaccgcacccgggcggccccgctacgtgtgtgtgtgtgtagtatgtgtagtataagaaagatggggtttcaggagttgagtggggacgaggcaggtggccacacagctcggagggagggcagaaggcacccgtcttcgcagagtcacagtggggcttgcctcctatacgtgccggaagggtgaagccccttatctcattgcccgatgtgatgaggtttgaagtggttgagcttggagg

SEQ ID NO: 220106 - DNA, 507 bp, Homo sapiens
ttgggtaaaagtccttcttgtgtagcattgggtttgagtcactcagagaagcactgttgatacagtgccctcctcctcagatgattcatactcagggactttgggcaaatggcccccatcttctcaaggctcagttttctcatctgtaaaatgcagagttgggcagaagatgcataagatctgagcttttgtctggccctaacatcccaggactctagaattgaaaaccatggagagcccctgagctacttcataagatccatccataagatcccagcctggccctggaggtgaacgtccattcttcatgtctgctcagcgcccactccccagtcctctggcttcagggccccatttcctgtgcagcacctctacctctcttacttggtggtgtttggatggggctaaccctcctctcaactccaaggtgagcacatgtcccaggcatagtcagtcaatcagagtggttcaggggtgagcatgtgactcaagctaagtcaatgaaat

SEQ ID NO: 220107 - DNA, 260 bp, Homo sapiens
tgttttgtagaggagacagattggcactgaactttgtggctaatattttagaccatgagataggaaatgtattcaaaaggctgaaaattacatgggagagagtaaatatgatcagagatttgacccataggctgttacctggagaatgcttgggtatacattgacttataactaagaaagatgaatttcaattttctgcttaggtatgctgaagaaaaattaaaagtgtaactccagagaagtaagttcagaaagttagc

SEQ ID NO: 220108 - DNA, 436 bp, Homo sapiens
cagctatccaaggactctgagaagtaaattttagcaggtgaaatggagaagaaagccagaactttaaattccactgaaccagcagtgaatttcctgttttttttcccctgtggtatctcctcgctgatttctcctgggcttgccagaaacccagaactgaaaagtaggggcaggcaaaaatagttccaagaaaggctctctagttctcctctgcaaagaaagaatgagaggcccctttgaatcagagtggaagaaatctcttttttgcttttgttttgttctattctgccccaatcctcttgtaggcctttagcagctgtggcagttaggcagatgtctaaaacaacgagagaagggaatcattttttgtttgttgtttgtttttgagacagagtcttgctctgtagccagggctggagtgcagtgacacgatctc

SEQ ID NO: 220109 - DNA, 456 bp, Homo sapiens
cacctgggattacctcaatgaaatgcatgtcaagactgtaactcggtaaacgtcctcatcctttgcagagaaaaaggacaactcacagctattctggagaggtgaactccatctagcattttagcatatgaaacattttcacacaagttattcacaattgtcctattttcagtgtgaggaatgtgaaaacaaatttgtgaagcaaagatttctttcactgcaaacccgctgaagcaacaccttccaccggctggaaatccaatggctcgaccctcacacagaagtcagaaccccaacagcagccagccagccatactcctgggaattcctgccctaaagtatcagtgactgcaaacccgtagcacatcactgctgtaaccgcagcctattttatagtgcattttaggacaaagagatttttcttgttttttaagtgtttttttgagtaaggtctca

SEQ ID NO: 220110 - DNA, 419 bp, Homo sapiens
aattattaaaggaacacaataacatcagcataaaataacatgaacttgtatttttctacatcagacagaatattgtaggctatgctacataataagttatactggcttcacaaacaaaggctttatttctcactcacatgaagtcctagccaaattttataactctgcagacgagcagttttccatgtggtgactcagaagtcctggcagtttcaaacttgtggctcaatcatctcaacatacagttccttggttgccaactgccaaccagttggccagaacttgtcacatggcatgacccaactgctagggagctgacagatgtgatgacgcacatgcttattcagtaatattaaatgtctctgtcacagcaactaacaaaatgttaaaattcataatgtaaaactggacgatgatac

SEQ ID NO: 220111 - DNA, 360 bp, Homo sapiens
ctataagtaaatatgttaatgctattaggaaccaagattttcagtgtaaaagaaaagagataaaatacaaaatcaaagaaggtaagaaaaaactttaaaacattgatttcttgctctgtttttttttttttttttttttttttagccttgctctgttgcccaggctggagcccagtggcacgatcatggctcactgcagccttgacctcctgggctcaaacgattctctcacctcaactcccagctacttgggaggctgaggtgggagaatcgcttgaacccgggaggcagaggttgcagtgagctgagattgtgccattgcgctgaaggggcaacagagcaagactgtctccaaaaaaa

SEQ ID NO: 220112 - DNA, 674 bp, Homo sapiens
tcctttgtgagaaataggtattgtgattactttttcccagtctgtggcttgccttttcattttcttaatggtgtctttgagcaaaagttttaaatttctatgaagttcaatttgttaatctcatcttttgtagttcatatgttttatgtcttcagagatctctctgtcataggatcactaagatattctcctgtttctttttttgttttttttttttaagaagcaaatagttttaggttttatgtttaggtctgtatgccttcttaaattgatatttgtgtgtgatgttacagaggagttgaaacattttttttcaatacacgaatgcagttgttctagcaccatttattaaaagtctcccctggccccttgaatcaccctggaacctttgttgaaaatcaattgaccatataatgtgggtctgtttctggattatctgttctgtcctgttgatctgtttgtccatctgatctctctttcttttctctacattatgccagtattacactgtctcattactgttgctttatagtgagtcttatggttacatagtatgagccctccaactccgttcttttttgtatgtttaaggttattttagctattctcagtattttgcaatttgatatcagttttagagtcagcttatatatttccagacaaaatcctgctgt

SEQ ID NO: 220113 - DNA, 446 bp, Homo sapiens
tgtgactgggggctgcatgcaccagtaattagattggaacaaaacacgatagggattttcacagtgcatttctatacaatgcctgtaatctatagataacataaccgattaggtcaggggtcgatctttaactaccaagcccagggtgcggcgccaggctgtctgcctgtggatttcatttctgccttttagtttttacttctttctttggaggcaaaaattgggcataagacgatatgaggggtggtctcctcccttactagaagaaggaagaaactcacatttgtcttccccgttggaagcaagctcaaactccataaaggagttacctgcatttcatcgtcatcaaagcaggaaaaacttgcctttcttgcgttggaagatagtaaaactccaaaaaaaaaaggagttgtactgcaaaataaactttagatcttgaccaaatt

SEQ ID NO: 220114 - DNA, 550 bp, Homo sapiens
attgtcatccagaacatgcctggattctcctgcctcagcctcctgagtagctgagattacaggcgttaacggtgttataccatgttagccaggctggtctcaaactcctgacctcaggtgatctacccaccttgtcctcccaaagtgctgggattacaggcatgagccaccacacctggccaccttcctctttttattagctcctgcctagtacaatgcctgaaacatagtaggtgctcaagtagtttgatggatgagtaactgtatgcgtgtcacccttgcctatcctcttgctttctcattacgttattgtgtacagtgttcttcctttctttccttcctctccagttaggttggagctttttcaaattcttagaatataccaagtttactccctaccttaaggccttccacatttgttgtctcaacctgaatgctcttacattagatacagtatggttggctcctttatatctttcatatttctcttcatataccttgtccccagaaacacctttcctgacaaccttgtctagattaacagctccca

SEQ ID NO: 220115 - DNA, 292 bp, Homo sapiens
ctgaaacttctgcctgccttgggattgctggtcaccctaacccaactgggtatgccttggagaggggaggaggcagggattggccgatggctgtcagacactcctcctggtgctgtgggtctgggcatcttagggtgatccccgacaggtgttctgacctcaggcttgtctgtgccactgactacctcagggtcacacttgaagccagttaggggacccctgggtctcagtttctctcatctgcaaattaaagagttctcaacctcactcataataaaagaggttcaaatca

SEQ ID NO: 220116 - DNA, 448 bp, Homo sapiens
attaaaaaaccaaaaaaacccaagacttcataaaacaaagatagggtatactgtaaatgttataaataccagtaatttaaaagtcaggtatagttaacaaaacctgggagttacaggtgagaagaagtgaaggatagtggagcattcatacgttctcactttgtggagaggaaattgagatacttcctaaaattaatgaaaaaataaagagaatttaagcctattatttgaaatcatgaaagataactaataaaaagttatacagtaaccaataaaacctgagagaatggtcagggagtaagcaacaagtgagatgaatcacttatctttcacagtgggtcattgttttaggttgcttagagctacattagtagtattgagaattagatgtagctggtttaacagcagtcactttagtaggtcctaatccttacctaaatcttttatc

SEQ ID NO: 220117 - DNA, 536 bp, Homo sapiens
gtggagtacagtggtatctaagcaggaatgattgatacagatcttttgtggaccatatggactatcttttacctccccctcgtcagccctgtttatactccaacactacatgtcctgcatgggaaaatgggtgtttgatgtttttcagtttatgggatctttagatgttttcacatagcagtctctcacatcttacatatttggccttgtagttcctgaagactttaaacaatcctttagactcactgccagtttccaaacctatcccccttggtaatgataatttttccaagcagctcatttgccctttccagagattttaatgcactgattctctaggcttctgcactggccctggtaacaataaccttgttctttgcaagggataccatcttccttgtatatatctgtgtggcaccactcggaggtgccattaaagtactctcagaggtcatattcacctccactgaggcagcagggtgtggttgctcttggaaatttgcagtgtctgctacagaatccaaatgcacaatctg

SEQ ID NO: 220118 - DNA, 620 bp, Homo sapiens
cagaccagcaatctggaccaaaggctaaaatatgtcataaaaataaataaggttgtgagtcagtttgtccagatcttcacagaaagaggaaacagaacatgaggatttccagaggtgcaaagcataaggtaatttttaaggattcagacaatattcagtatgactggcataaggtttgtgtaggagtctaaccaggggtgaagctagagatctaagtaggagaccacatcattaagcatctttacaatcattataagggcattcttaatattcacacaaaggcaattggaacccacttaaaatcatgtcactccccttccaattcttctgatcctccaatattgtgattggttcttcattttctgctcacttgacctctttccaccatcttgccaccccttcctttgaatggcagataggttaaatagatagcttacattttaaatcttttggtgcattattttctgcatagtgctttgctggggtgatatatttccccctgttatttcaagattcagattttagtcatttctgattttaaaaagaatgatatctcactccataacctatatttaaaactaaaaataaacgtatttttaccattgtataaaaaccttcta

SEQ ID NO: 220119 - DNA, 482 bp, Homo sapiens
aaaaccaaataccacatgttcttgcttataagtggaagctaagctataagtgcacaaaggcatacagagtggtataatggacattggagactcagaagaaggaagggtgggagtggggtgagggatgaaaaactacctatcgagtgcaatgtacattacttgagttatgggtgcactaaaatcctagacttcaccactacacgattgatctgtgtaaccaaaaaccatctgttttcttaaaactattgaaatttaaaagaagaaaagaaaatgccacccatgaaagacaaagattgaggaaatgttccagctgagagaagacgcatgcaagtaaatgcaatttgtgaccttggataagatcctggatgtggaaaataaaaaagttataaaggacattattgaaacaattgataaaaccgccctgtggactttgtattagaaaatgacgttatatcattattaaatttcttggttttaataaa

SEQ ID NO: 220120 - DNA, 478 bp, Homo sapiens
ctctcgttctgaagcaaatgtcctgttatgtgggctttgactatgtccattcagaccatcactctcaatctgtctatcaccttggaaaatatgtatcgccagcactagagcaaccttagagaagcaagttattcaacctctctatggattcgtgttttgcagcacttgtaaaaagcgtttgtatgaatgatgtaataaaaataatttcgttaagatatggaaagtcctcggtgggctttagtacaggatcttttcacagatgtcactatgcatgttccagtctcaattattttagttacctaatgtggtcccagctgaccggagaatcacttcatttggcaacctcaggaaaataatgcctatgtgcctctggaattgattgaataactgttgttctatctgcttggttcttcaatttattcaccaaaaataaactctacattgagcatatctatattaaatgttataaaatcctgta

SEQ ID NO: 220121 - DNA, 382 bp, Homo sapiens
tccctccttcgtaaaagataaaatcccaaagctcacttgataattgagacttaaatagaatcccagacctttttatgaaaggaaaagctaatccctctaaaagggagttctcagagtatcaggaagcagttgtgacaagtttttaaacatctcaagaaacttcagaaggaggtgcacaattgggccaacatgctgagtccaacctgcacttgcgcccagcctgaatcatgcctcttataaagttgaagctaagagcatactttcgggaactgaatttgaatcctgactctttgtaaccctaggcatattatttaatctccctatgcctcagtttcctcatctgaaaaatagggatagtaatagtgcctgcctcacagattta

SEQ ID NO: 220122 - DNA, 917 bp, Homo sapiens
cctccagctgctttctccttcctcccctgacaatcagccagacagaggcaacctgacctcttcctcctccggactcctccgggcgggagattcggctccaccccttcccttcccgctgagtcacacacctcccagtcaggtgatcctcccctgggcccttccgagagcaccttgacctatattccgttctctccatgacagcagactctaagagtcccgggagagagcccgccaggccagctggcgtggtgccctggcagccccagactgcagaccaggcgccccgggcagcgggagggggtgctcccaccccagaggcctggaaatggaaagttaggaggctggtggctgtgtgcagggcgggggaggaggaggtggggagttgagtcagctgggaaagctgacagccactggcggccgcgtgcttcctcccctccctctctgggctcctcagctccctgccaggccctgaccaagcaggctgcaggggatgaagcggtgaagggcagatgccattgtggctgggtgatactgcagcccacggggagaggtgaggaattgtgcaaataatgggataaacctacatgactcacccggagaatgtgagccgaagaaaacttctcctgccacaaggaccgaattcccattcccaaattatccacaaaatggcccctacttattttgtctatgggttctttgtgcagttgctgcctgtacagtctttgtgtcctctgaatgtgaggagaatagggctgctatgggaaaggaaattaaaagagaagtgatccttgggtatcacacctgtaaaaagcgatattaactgaaaatcactgttccttttgaattagaaagcactctgaatttagactcattcgtctttttttttttttttttccaaaagacagggtcttgctctg

SEQ ID NO: 220123 - DNA, 514 bp, Homo sapiens
gaatggaatggaatggtacggaatagaatggaatgtaacgaattgtaatggaatggaattgaatggaatggaatggaatcaacgcgagtgcaggggaatgtaatggaacggaatgcaatggaatggaatcatccggaatggaatggaatggaatggaatggaatagaatggaatcaacccgagtgcaatggaatggagtggaatggaatggaatggaatggaacaacccgaatggaatggaatgtaatggagagtaagggagtagaatagaatcaatccgaatgtaatggaatggaatgcaacggaatggaatggaatggaatgcaatggaattggaatggaatggaatggaatggaatggaatggaatggaatggaatgatacggaatagaatggaatggaacgaaatggaatggaatggaatggaatggaatggaatggaatggaatggaatcgttccgagtggaataggagggaatgtattcgagtggaatggaaaggaatggaatcaacc

SEQ ID NO: 220124 - DNA, 500 bp, Homo sapiens
ataatttagaaaaaatcatggccccacattttgtcaaggattcttacaagtgatattcaaatatctaatctaaaatgattatctagaaattggcacattctaagtgtgcagatgctgatgaggagcaggtattgatagacagcgcgttatgcgtcaaaggatgtctatcctttgctaaagtgttactctgactatgctgtaaaaagcaggaggtaagagcttaagaaagaggagtaaaagagataattctcatgagataaactctaaggattgatgctgtgctccaggtctctccagtgttttagatgtttcaggatgctatttattacagaatatggtgtacttggaattttttttaacatacagtagtaatcattttcctgattaacctaatttctagacagagtttgcattcatgaatggccacagtacagatgcggacatccaaaggatggcattattactcacaagcatagtgctatgtgcagttatggcttgag

SEQ ID NO: 220125 - DNA, 463 bp, Homo sapiens
gttgacgctaatatacatttgaatataaatgtatatttatattccaaggagtttccaaggaaactcaagtgtagcttaattatactcagatttgatatagagggtcttccaccacatatatgaatattaaagccagtcagaagaaatcctggacatgaaaacattttttcaggaaataattaactatgtgctgggtattattatatgagcgtggctacaaagatgaataaaatatagtccctgcctaaataagctttgttgtagcatcttacagcacttaatatcttgtgctgtatctatttaaatgtctttttcccttcaataatagaaatcctgactcacttatttttggtgcctccaagtgcccatcacacaattcagtttacagtgtttgaacatgtgaataatgagagagagaaaaataagaaaacggtcagggaattggggcctttgaaaaaactta

SEQ ID NO: 220126 - DNA, 410 bp, Homo sapiens
  misc_feature (384)..(384): n is a, c, g, or t
  misc_feature (386)..(386): n is a, c, g, or t
caggaggatcacttcagtccaggagttcaaggctgcagtgagctatgattgtgccactgtactctagcctgggcgacagagtgagattctgactcaacaaaaatttttaaaaatacagcaaaatatggggcctgcctaggtatcaatgaaaatatttttaaatagattattcacaataaacatcacttttgcataagtgaatggagtagattaatctactgtataatcttctttctaagccttccattccttctcacctttctaatcttttcattgggaccttaaactcctgctgccaggaaatctgcctgctctgagaaggcagccttgtaaccatcactggccccctaagctggataccatgattgccatccttacctgtananaaccatgtcaaatccataccgtaa

SEQ ID NO: 220127 - DNA, 143 bp, Homo sapiens
gcactggctccccctccctctctccccatccgcggcggtggcggcgtcagcagtggtaagaacagatgagggttccagaaaaacagagcttctccacccccggcagacagggagcaaacagcttcttccgccatcatcccccg

SEQ ID NO: 220128 - DNA, 542 bp, Homo sapiens
tctggttgtttgtatgtgtctaatctcttctactgctacttctacatttatcacacatttattatgtgtcagacactgtgctaacagctttttatgcgttattatcagttgatcctcactacgcatggtaagttttactgtgttcccatttgaggggtagtgtcatacagtggttggattggcagaatttgaggccagccagcttggatttgcatcctatcttcaccacttcctaactatgacccgggacaagttatataacctctctaaagcatcagtgcttttatctataagacagggatatacatatggaaatgatgataatatctatctctgcaattgttctgagttttaagttagttaacatgataaactgcatagaacacccctgccacgtagcagacactcaataaatgttagctattatcatttacataagaggaaaccaaagcttagtaagggtgttttttctagggtatccaactgtaacttacaggatgggattccaaatcagctaccatggctgacagccacacttgtgt

SEQ ID NO: 220129 - DNA, 425 bp, Homo sapiens
tttgtgagattgatctctctcaaaatatttgttttcaatccccatattatcaaatatgcacccaaagtggaaacgaggactggaaagaataaatacatcaaaaatataaccagaccgtgcatggcaggtcatgcctgtaatcgcagcagtttgggaggacaaggctggagaattgctgcccaggagatgtgagacaacacctctaataataattattattataattaaagttaaaaaagaaacatctctcctcaaaagataagtagatagataggtatatagataggagccaggcacagtggctcacgcctgtaatagcagcagtttgggtagtcgaggcaggaggattgcttgagtgcaggagttcgagatcaggctgggcaacatggcagaacccagaaccctgtctgtacatacatacacat

SEQ ID NO: 220130 - DNA, 435 bp, Homo sapiens
ctgcacgctttgtgcatttatcccagaacttaaaatataataataataataataataataataatgataatagaatagtgctctcacttcagtaacaacaaaaaatgctggacaaactttaaattaacaacttttattaaacttatcagagaactcaggttgtagggcaaacaactatagtttactttcgaacaacatgagtgtgaggggcaccaactccccaccatgcagtaaaaaatctatgtataagttttgactctccaaaaacttaacaactaatagcctactgttgaccagaagctttacaaataacataatcgattaacaactattttgtgtattatatgtattatatactgtacccttagagaaaagaaaatgttattaagaaaatcataaggaagagaaaatacatttagaatactgtactgtatt

SEQ ID NO: 220131 - DNA, 700 bp, Homo sapiens
gcagtattaataattaactttttcttttttttgagacagtctcgttctgtcgcccagacttgagtccagcggcgtgatctcaactcactgcaacctccacctcctgggctcaagcaattctcgtgcctcaccctctcaagttgctgggattacaggtgtgtgccaccacactcagctaattaattttttgtatttttagtagagacaggttttccctatgttggccaggctggtcttgaactcctgacctcaagtgatccgcccacctccacctcccaaagtgctgggattacaggcatgagccactgcacccagtctagtaacattttttatgtgcctccactgggtgttctttctgcctgtatcttccaaaaccagattggttaaatcataaatgtaaagaatctgaaaaagtacaccaaaaaatttcaaattatgtttaatcaatgagattatcattataaattatatttaagttttttaaaataacacccttgagatctaattcacataccatacaaatcgtccatttaaagtgtacaagtcaaaggttctcagtatattcagagttgcacaattatcaccaaaatcgatctcagattactttttcatcacccccaaaaagaaacttcataccattaatagcattctcccttccctccaacctcccctcagtcccatgctaatctattttcatata

SEQ ID NO: 220132 - DNA, 469 bp, Homo sapiens
agataaggaagagatggcgtagagctgatagcctggctgtatcacaaaggggatgtcaagttaaaggaagaagctgaggcaaaattaataatcataaagttattcatgatagcaggaggcagacaaaatgcctaggctgataggggcggtccccagtgaaacaccaccttcaagccaaaaacagcctgaagtctgaaagactgaactgttggttctggatgaaacctgtgacccagagtgagaacttctgttcctatttgcccactctttcccgattggttctttctgaataacgctttttgaccagttgaatgttgccttttctgatactacctatggcctgcccctcccccatcctgtgcctataaaaaccccagactcagccacactggaggagaccaccttcccgtctcctctctgctgagagctgttttgtcgcttaataaacttctctgccctcaccacccct

SEQ ID NO: 220133 - DNA, 198 bp, Homo sapiens
tatagatagtttgagatgggtctgtaaatcaacttattccctcctcacaaagttgcctcaaaactattactaaaaaaatccttcctatttccattagtttgcttataaatccagactttttctagactgccaaattggctctgccgggccagtaacaaacatttttataattttatattacttttaaataaatgacaa

SEQ ID NO: 220134 - DNA, 155 bp, Homo sapiens
tatattatgtcacggctaaaagagaattcccctcacaaatgcagttactatttagtgggagattctgtaaaactcagcgtcaacaaagctcttccagttatgtctcctgcttctgggacggccaggacctctcctgtaccaccccttcctctccc

SEQ ID NO: 220135 - DNA, 407 bp, Homo sapiens
ctacataggaattttttaaaaaataaatgaatctaacaagacatttattttcaatattctcatgctaacttacacagtaatcatattccaatgaataacaactggttcaaatcttgcataatcatctactaattgtgtgatcttgggcaaattaattaaccctgctaaacatatggtggagtgacagagacacagacacacagagagactcagagttccaaacctgtcaggctgtaagaattcccttggggctgggcacggtggctcacgcttgtaatcccagcactttgggaggccgaggccagtgaatcatgaggtcaggagttcgagaccaacctgaccaacatggtgagacccccgtctatgttaaaagtacaaaaattagccgggcatggtggcatatgcct

SEQ ID NO: 220136 - DNA, 498 bp, Homo sapiens
tactgcactgatcacacagaactgctgtcatctgtgttggccttgctgtggtttgtgcactcagaggcccacatgaagcaggcatcagtgaatctttagcgggtgaagggtggaatacacaaatctccctgaacattgatttcctcatctgcaaaattgggataatgacaactcctacccagtcttcctcactggatatccggagcatgacttaagatgattcatgggaagcattttataggtgttaatctactcctcccacagttattccttcctcaaccccaagtgggaagccagccctggctgctgtccagggtgctgaaagggacttgtcttcacccaaaggatgaggagacaagactgagaggcccgcccgcacaagctcagctgcagccttttcttgctttccagactggcagggtcaaggatgagcagaccatccctaccttcatgagaacagaccctgggagatgtctaataaaaatacaatgtaaacga

SEQ ID NO: 220137 - DNA, 370 bp, Homo sapiens
agctttattatgggggtgaagtgtggatgggagccatgagtaattgtcagataccacactaaaatgggcagggcaacatggacggagctggaggccactatcctacgggaattaacgcaggaacagaaacccagataatgcaggttctcacttataagtgggcgctaaacactgagaacacatggacacagaagggaacgacagacactggggccgcttttagggtgacgggtgagagaagggttgaggattgaaaaactgcctattgggtattattatgctgattacctggtacaccagattcctgtgacacacaatttacccatgtaacaaatttgcatgtgtaccttttgaacctaaaatagaagtt

SEQ ID NO: 220138 - DNA, 478 bp, Homo sapiens
tattgcgttgtaggaatattttgtgcatactagatattagtatgtcatcagttacatgttttgataatgttttccttctagtctgtggcatacatattcatttatttaatagggtcttttaatgagcagaagattttaaatttcgatgtagtataatttatcatttcttctagtccttagttactgctttctgtgtcttaagacatctttgtcttccctctaaatatgtttccctcttattctcctgtttgcttttagatgctttatggtttccatttttatttttaggactacgattctttctaaattaattgtgtatatggtgtaagataggtgtcaaagttctttttttttttttccaagtggatatcaatgtgttccagcaccatttgtgggatagactttctgtttctcaagagattgcattggcacttatgtaaaaaaaaataaatcaaatgactatttaaatttaatctat

SEQ ID NO: 220139 - DNA, 434 bp, Homo sapiens
ctgcagatggacttttcctgagatttgtttagggaaacttgggtctgtcagggctcagtgggcagctgtccagaaaccttggggtgtcatgtgatgcccactgaggtttggggagaggggaatgagggtggtgacttgctttcctccctgggacttgctagcccaagcttgaaggtgccaccgtctcagggcctgggcttgcttggggatgggtggtggctccacagggtggaaatgttcattcctttctcccgagtccagcgcctcctggcctctggtgcttgcatgcggatgctcccatgctgtatcccgctccccgatactgcactccagcctgggcgacagagggtgactcctcaaaaaaaagaaaaatagctaaaatatgattgtaccactgcactccagcctgggtgacagagtgagaccctgtctct

SEQ ID NO: 220140 - DNA, 100 bp, Homo sapiens
gtatcactccagagttaagcaagtctcagatcccatgggaccattttaagggctgtgggttctatccggtaagcaacagaaaattgttgaaggattttaa

SEQ ID NO: 220141 - DNA, 251 bp, Homo sapiens
aagctgctgtttatggtttgtctgcttaaatatgtttaatattagtgaagttagcatgaagtatgatttttctgctctctaaatgtgtaactgtcatatttatgatgtataatttacagctctagattgttagttttatgttgacccagttgaaaataacacacaccaaatagattatttttaacagtgatttatagaaatcatgttgcttatatttctctgttttctaagaatataaccccttctttccc

SEQ ID NO: 220142 - DNA, 399 bp, Homo sapiens
tggaagttccccaaaattttggaaaagtctcccttaacaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 220143 - DNA, 799 bp, Homo sapiens
ctattttttcatcttttaaaaagggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatactgttctcgtggtagcgaataagcctcacgagatctgatgattttataaaggggagttccccggcacaagtcctcctgcctgctgtcgtgtaagatgtgtttgctcctcatttgccatccaccatgattgtgaagcctccctagccatgtgaaactgtgagtcaattaaacctctttcctttgtaaaaaaaaaaaaaaaaaaaaaaaaaaaaaaaaaaaaaaaaaaaacagaaaaaaacaaagcaaaaaaaaaaaaacacacgcacacgcaaacagaccgaaagaacacaacaacagactaccgcgcgcagagcgaagaagagagagaacactgacgagaagagacggagagaggagagaggagggggaagaaggggaggggaggagagagaggagagacaaaggcggagggaaggggaagggaagtaatgtaggatacgtagtgatggttgtgctgatgtgtagatgagaacttatagataaaaatgaaaacgatactaaatcatggatacacactactacatacagcacatatggaagaaacaaattagagtggtgatgagagggaagaaaaagaagag

SEQ ID NO: 220144 - DNA, 3577 bp, Homo sapiens
aaaacaggtctccaattttaatcttctgtgccatgagactccatcaggcagtctacaaaggaccactgggagcccacgcgtccggtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgttctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 220145 - DNA, 1522 bp, Homo sapiens
cggacgcgtgggtcgacccacgcgtcgaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 220146 - DNA, 1586 bp, Homo sapiens
gtaattaaatgtttatgcaatgtttaaaataaactctagagggctaaagccattaatatgcccataggacacatctcgataaatgctggcatatatggcattttcatgcaatagaaactgttagaatcaagggagaaatataagactaaaatatcagtaccctttcacatagcattcttgttttaacctatgacagatggatgtccagagccttttctttttcagagtccttggtttagcaacccttgttcgtttggtgttacttgttataatagcatttctttgcaccaaatgaaaataggttagtttgagtgttgacagaagtgtttatgttgaattttgtcacatatgacttttggatgagctgagtgtagagtttcttttgtctgtctgtttccattttttccattcgacatagttcttttcagtgctcggaattttttgaaagattgaatttcccaaatgtaagaaagaaaattttatccatatttccacaccagtgttactgtccagcatacattttgaaatgatttctagtctatagtgtaggcaaacatgaaaatagtactatgtagctgtttattaaggtatagatgtaatttaggtaattgaaatagatgattagttttgtgtgatggagtgcctgagcaggttctgacatttttataaaggtcaatgttttcacttgactgctttctagaggtgtgtgtttacctttctctcttgcaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 220147 - DNA, 4328 bp, Homo sapiens
gggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcagggatcaagacaatgccatcattcggcctctacccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagcagtgaaatgaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgttctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattagggttgggccggtacctcacggggtctcatcattaccctgaagtccgcacgtacgtgattacgggttcccatgctgagggtgttccactaacgggcgcgaatgtgcgggggccgttacgcacctcatcggggcgccactcttccagaggggtggggcggcgtcag

SEQ ID NO: 220148 - DNA, 2603 bp, Homo sapiens
gggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcagggatcaagacaatgccatcattcggcctctacccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagcagtgaaatgaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgttctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtatgtatacagatggaattttggaaaccacagcaagattagcccatggaaaggagttgttgcatagttgatacaaaacctcaaacaaatgtcatctatgtttagttttaaagtgttatttacactagatttgtcttcctaataat

SEQ ID NO: 220149 - DNA, 1084 bp, Homo sapiens
gggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcagggatcaagacaatgccatcattcggcctctacccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagcagtgaaatgaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggcccaactttgggtaccgagctcg

SEQ ID NO: 220150 - DNA, 345 bp, Homo sapiens
ggcccatgggttgtagtagctgtggtttgccaactaccccagcatttataggaaatcttaatgagaaagactagtgatctagtaaagacattctgtttaattttggaacattgtatataccattaagcattattcacaaatttctgctggtttgatttctatgtgttaaataaggaatgcctatgtgactctactggtttttttgctctgttgtgttgtctgcaggtgtgtggatacataagtaaatgctacagtgtggctgctcagtttgaggaatgccgagagaagatcacggaaatgcctagcatcatcaaggatctctgtcgggtactatattttggcaag

SEQ ID NO: 220151 - DNA, 4454 bp, Homo sapiens
gggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcagggatcaagacaatgccatcattcggcctctacccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagcagtgaaatgaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgttctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaaggtgattgtgacaaaacttatggatcagaatttgtctacagtgatcatgccaaagaacttattgtaggggagatttttgttagggtgtataatgaagttcctactttccaactggaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggaggctctgagaaatgtcataaaatacaatccaggttctgagagtgaatgcattgggcactttaagttgatattttctcttctccgagttcatggagctggtcaagtgcagcagttggctttagaggttgtgaatatagtgacatctaaccaagactgtgtcaacaatattgctgaatcaatggttttgtccagtttattggctcttctacattcattgccatcaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 220152 - DNA, 2073 bp, Homo sapiens
ggggaccagcgctggtccgctcgcccagcgagggccgagagcacatggcgcaccggcagtagttccgtaagtggaagtcgtcagcttgttctggaaactctttatgctttgacatcgagtacaaaaataatcaaagaagcaatggcaaagggtgctttgatctatttactggatatgttctgcaattcaacacatccacaggttcgagcccaaacagcagaactttttgccaaaatgacagcagataaactgataggtccaaaggttcgaattacgttaatgaaatttctaccaagcgttttcatggatgctatgagagacaatcctgaagctgctgtacatatttttgaaggaactcatgaaaatcctgagttaatttggaatgataattccagagataaagtgtccacaacagttagggaaatgatgctagagcactttaaaaatcagcaggacaaccctgaggcaaactggaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 220153 - DNA, 1627 bp, Homo sapiens
gcatattcttaaagtcctttagattcatgccttttatgaaagaaaatgggaagttcgttgttctcttaggattagtgaatctgttttcaagtatcagcacttagaacttttgaatccctagttttgaacaccaaatacattaccttggatatttaggactgtatgagtattttatagttgatttatttttgttttacacctgcagggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgaatgaaatcctgtgccgttcttcagtctggagtgccttcaaagatcagaaacatgatttgttcatttctgagtcacaaacagcaggatacctcacaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 220154 - DNA, 2304 bp, Homo sapiens
gggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcagggatcaagacaatgccatcattcggcctctacccaaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagcagtgaaatgaggcgcctgatgatagagaagattgctgcccatctcgcggatttcacacctcgtcttcagagtaacacaagagcactttatcagtattgccccattcctataatcaactatccacaactcgaaaatgaactattttgtaatatttattacctcaaacaactgtgtgatacactccggtttccagattggccaattaaagacccggttaagcttctaaaagatacccttgatgcctggaagaaagaagtagaaaagaagccacctatgatgtcaatagatgatgcttatgaagtgcttaatctgcctcaaggacagggaccgcatgatgagagcaagattaggaaagcttacttcagacttgcacaaaagtaccaccctgataagaatccagaagggagggacatgtttgaaaaagtaaataaagcatatgaatttttatgtaccaaatcagcaaaaatagtggatgggccagatccagagaatataattttaattctaaaaacacagagcatcctcttcaaccgtcataaagaagatttacagccttataaatatgcaggataccccatgcttattcggactataacaatggaaacttcagatgacctccttttctcaaaagaatcaccattgttgcctgcggctacagagctagctttccatactgtcaactgttcagccctcaatgctgaagagctcagaagagagaatggactagaggtgttacaagaggcatttagtcgctgtgtggctgtcttgactcgttctagtaaaccaagtgacatgtcagtacaggtgtgtggatacataagtaaatgctacagtgtggctgctcagtttgaggaatgccgagagaagatcacggaaatgcctagcatcatcaaggatctctgtcgggtactatattttggcaagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgagattttgaagatgcttaacagcaacacagaaagtccatatttgatatggaacaattctacaagagcagaattacttgaatttcttgaatcccaacaagaaaacatgattaaaaaagtatgttattgttttataaatttcttgggtaatttattctgatggaatctctggaagtacagcagtattgattagaacagaaatccactacttctcactttagtgtcagtcagtatggctttctgccacctaatatttggcccatttaagaagagcattgtgttgtatgtagtaatacattaggaatttttattgttgttaccacttatatacagctgtcttctattttaaccagtttttgaacccagaaaccttattttagttgttcacttcagcctcttttcgctagtaagtgaaaggtgctttccagtatcaagactgaacattttttcta

SEQ ID NO: 220155 - DNA, 357 bp, Homo sapiens
gaggtagcaaacagccttgccaaactgagtgtccatgctctgagtcgccttggagggtatttggctgaagaacaagcaactccagaaaatccaaccataaggaaaagcttagctggcatgctgacaccctatgttgctagaaaacttgctgtggctagtgtgactgaggtatgtgcttcacaggtagcctgggttttaatcaatagtgcaagatcctttaagcagtaaagtagtacaataatattgatctagggaacctaaaaattaagaacgttcacatgtttgttctctcaagcaagaaattcactttataatggattgatgctaatgatgtcagttctacaagtccagtttttg

SEQ ID NO: 220156 - DNA, 526 bp, Homo sapiens
tgatttccaagaaaaggaaagagaccacggatgaatgatagcaagactattaaacaggaatacaaagaagagctcacatttattgagcacctactatatgtgctggaccctcttgtaagagcttcatacaaattaggcagacaggcaatattattatccccatttgatctacaaggaaactgagtacaaagtgatagcttttctgcagagcttgtgcacaggggccaaagtttgggaacaatgcctttctttaatttgaaagtatctgttgttggtgtcacttgttggaattcctagaatcccagaaaagtaagtttaagttttcttctgccagcatcggtcagcctacctttgacccaaggtcacgactccctccctcctcccttcccttccctgctctgacattcttaccttgtttttgagttccttattccctagcttcctccaagcagcaggctctgggaacagtcccgttcatttatataacaaatatttattgaaatgcagacttgttgttttcataata

SEQ ID NO: 220157 - DNA, 718 bp, Homo sapiens
ggatctaaatgcactgtggagtcaaagattaaggtgtttctttgggttggaatcccagaaagttagcattcaaaacggcggtgaggtggcgcttattagcgttccacgtgatgacacccaatggttactgatccccaaacttgagcagcagcatgctgtgctgtttgacagccctagcgatctttagcgagagactttgttgactcacttaacttttaatttctaaaaattggtcatttttgttacttatgggacgctttcctggctagtcaatattttgcagaattatgcgaaagaaagaggattattgaaaaattaactgtaaacggactggtgttctgatgatccacccttcccctaagttacttggcttgccaagagaaaaaaaaatctcaaaactagatactagaaaagatttgatcaaattacatagttaaattttgagtgtggatatttcagtaattttgtttccaaaaaaaacagaaaaaaaaggtatttgattttaaagtatcagtggatgaatgtatctgtctcctacaatttataatcattttagtcttaaaaataaattcacctccaaaaccagaacaagaaatactcctcatatgggttgatgatgtcagcatttattcagctaaggcagatggagagtattagaggcgtactgtctgaatgggtgtcaattctaaagttatatttgccaatataatttgagttc

SEQ ID NO: 220158 - DNA, 674 bp, Homo sapiens
tgccttgatgtccctgttgtacctggcaaccaccattctgctttctgttgccattgaatttgactaccctaaatgcttcattaaagtgaccaaatcatatttatcttgggggtgattgggtttatttttcctaatacaaagccctcaagattcatccatgtggtagcgtgtgtcagaatttcccttcctttaaaggctaaataatattccatcgtatgtctatcattttctttatccattcattcattgatgccacttgggttgcttccacttcttgactatattgtgaatactgctgctatgaacatgggtttacaagtgtctcgggaccctgctttcaattcttttggatatatatacacaagtggaattgctagatcatatggcaattatatttctaattttttgaggaagcccatcccattttccatggtcaatacatgatttcacattcccactaacaacgtacaagagttcaatttctccacacccttgccaatagtaattttttgttttgttttaatactagccatcctaataggtatgaggagctgtgggtctttaaaaataccaatgctcaggtcccaatctctggagagagcgcctgggaatcagttttgttggttttttaaaagttccctgttacttctgaatgcgtccgaagattgagtact

SEQ ID NO: 220159 - DNA, 627 bp, Homo sapiens
cttttaccctcacaaactcttaaacatctgtatgcaaacagctaaacgtctattttagactgagaaataaagcacagaaatgcaagcaggatattatcgcaaaggcaaagtagaaaaggaagagtgggcaccagtgtcctggatgtgtcactgggtgatggttgtgcaaggccagctgggggttcagggccgggtcacagggtcagaatagaaagaagcccaaggagttctgcaggttccctgaggagtgaaccagggatcaatgtaaggctttaaggaaaagaaaaatgctaccgggagggaagggagatcgtggaaacacagcatggaaatagagcctgctctatgggataggatggatctagaataagagctaaagaaataatagaaaagagatacaatatcactaaaaaagaaaaaagacatagaaacaggaggcaggagaggccagttggagagaagatcagacaatccaagcgctgctcagctaggagggaactatgtggaggcagaacggtgaggaggacactgagaattagagagaaggagaaagaggagatgtaacaagatggagaaaaggcggaacaagacaggggtggctcttagcattttcccatcttggatggc

SEQ ID NO: 220160 - DNA, 292 bp, Homo sapiens
actcagacttagacagctggcataagcaaggacttccctattctgagtgccaaatgtcaatttgaaatacttgaacttttattctctgggacatgtactggcattagtaagaatttctatttattgagcatttatttggggcaggcagatgataagttatacacattaattatcttatttgattttcacaatgacctatcagttacataattgattgtctgcattttatggataaataacctgaggctcagttatttgacttgctcaaggtgatgtaacaagtaaatggcag

SEQ ID NO: 220161 - DNA, 546 bp, Homo sapiens
catggcaaaatcagttttatcctgttcatttctaatatttcatttttgcctccatgattagtctccttagaatatgtaaacagttcctttcttctgttttttgtccatttttaccatatggttttcatgcagcctgttttacagaatttcgtattttatatttcatcctgtcttattgtcagtctctttattttcttaactcctcttgtggtcttcagagccctttttgactcttctctatttcattaccaggtgacaggtttgaaggcaatgttacaatctcatgtaagctgtttagagaaatagttggttaacatcttcccaggctttgggcttataattatactttcttttctcctgttccctatgtcatattacacagacaacagcctttcttttgtaaaataccaagccccaaaagaaatcactgactcaatgagcagtttttaaaaatgtgcatactttagacttttggtactgcctgccctttggtatatataacatcatcggaacattaataaaataaatagattggtgatagtttta

SEQ ID NO: 220162 - DNA, 143 bp, Homo sapiens
aagtaactattcccacagttctagttttgacatcatctactttctcagggtatatgttttaagaatgcaggcacacctgttaattttactcctttggtaatgttgaaatccagggttgggagctttgccataagcaaatcact

SEQ ID NO: 220163 - DNA, 796 bp, Homo sapiens
agatagtgaacatattcattaccccaaaaagtttcctcatgcttctttgtaatccctctctcccttgttttcctctactcattcccctcttcccaaccagatctgctttttatcactggagattattttacattttctagaagtctatataaatggaatcaaacaacatgcactttttttggtatggcttttttcagtaagtatatttattttaagattcatccaaattgtttcatatataaatcttttttaaaaattatattgctaagtaactttccatttatggccacaccacaatatatttattcattcatctgttgatgtttatgttcttttcagtttctgactattacaaataaaatggctatgagcatacatgaataagtctttgtgtaaacataagcttttgcccccttaggtaaattcataggagtagaatgactggattatatggtaggtgtggtgacctttttaagaaattgctaaactgttttccaaactccataccgttttaaatttccacacacaaaaaagtatgaatgttcccatttcttcacatcctcaccaactcttagtatagtcattccttaattttagacattctactagggctatagtggtatcacattgtggttttgatttgcatttccctataactaatgatattgtatgtcatatcatatgcttctttgccatccatgtatctttggtggaaggtctgtgcaaatattgtaaacacgttttaattgtgttgattgatttcttatggttgagtaaaagtgcacttcttgcaagc

SEQ ID NO: 220164 - DNA, 501 bp, Homo sapiens
ttccggttgtagccatttcactttgatcactcagaacattcaaatgaatgttgcatggtactttaagccattcagacatctataggaaaaacataccagacagaggggatgagggacagctagtgtagaagtcctgaagtaggagtgcctagcattgtttgaagtcattaaggaagcctttgaggctgcagaggaatgagtgaaggagagtgtcttaggagattggaggagcagggagcaatgatatcctggaagccaaatgcagaagtgtgtcatatcattgataggacagatatgtgaggactgagaatttaattgacccctggatttgacactgtggaagtctttggtgacttccagaacggttgtggtagagtgccaggagtaaaatgcttacagatttcagtgtatggaagggaatgaaaagagaggatttataggtggccattacaggcttgctttttttttttttttccttttttttatttaaagaattttgct

SEQ ID NO: 220165 - DNA, 308 bp, Homo sapiens
tccatgggtcttaaacccctcaaagtcatccataaggattggaatcaactcataaaccctgggatttttttgtttttttcactctatttttatcttttctgttttacacgcgatgtttattttaaacaacgagaggctagacttgaaggtgaaagtagaaaggattgtaagccaaactcctgttaatgttgatattttggccgggcatggtggctcacatctgtaatcccaaagtggtgggattacaggcgtgaaccaccgcgcctggcttaaagtcttttaaaggctcagctgcgtttcacttccga

SEQ ID NO: 220166 - DNA, 479 bp, Homo sapiens
aggtaggcatggcaacaaaataaagacaggaagtcttcggaataagtgatcccatcacaatgaatcaatttgccattggaacatatttttacaaagtcactcttgtgaaaatatttggctatgaattgaaacagagtctgtaaggttaatatttttcctggtctaaggtgaacagcattttagagaatgaacccaggacacaaccacagcacaagaaaaaaatatgagaattaagtttacacatgtgtgttactacagtaacagaaaacatgtaaagaacatttgttttgatttatatgtcagtctgcactgtttaattttttgtgtcataaatgctcttatttaaaaaaataggactagttaacagtgtcaattactagtaattcatggtataaataattaaacaaggaagtgttcaaaaaacagtgttttaaataaagttttattttacatctttttacttacacagaaattgtcaa

SEQ ID NO: 220167 - DNA, 342 bp, Homo sapiens
agggcccatgccaccccagcctgccaaatggggcatctggtgctgcaggagctgatgaggagtctaacacaccgcttaattcctgtgtgccccatctagcacagcagctggccctcctcccgcctaaaggccccctgtcttccaggacggtgccaccttaccccccttttaccaacggactccactacacctttgtctaacaccttccaagtaagagcccctgtctggtgtgcttctgcctgcttcctgcacctccctagcgctgagcccctcacctccctgctgtgctgaggtgattgcagtgccacctgctgatgcctccttccactggcaaagcggccg

SEQ ID NO: 220168 - DNA, 473 bp, Homo sapiens
agtgtcaacctgaaacgtcatttcctgtttttcattgtaactttattatgtttgcccgttctcttaaatctttggatttttaagtgtttgaacagaaaattgtttaaacccagttttcacagttactcaaattggtctttttctccttgaagtatattgtgtgtcctagtaactcaagatggagacagcgtaagtgtccctgtcctcacgctgtcagccacagccaaaggaccgctggccaaggagctgcaacaactgggccggataattggcctgtcatggcgagggggggtggcgcaaaggacctggggctgtgcctctgccatcatcaccatccttgttcacaagcgctacttacatcctcttacaaataggtgtggatttctaactttttcacagcaccatgctgggcctgcagtgaagggtcaggaacgaaaacactaggttatgacacccaaattggggagtggggt

SEQ ID NO: 220169 - DNA, 716 bp, Homo sapiens
cgtccttagcatttagagacgtcatttactcttcacctggggcctcttgcgtctctgtgcagggtggtttggttgtctctaggtgaggttgtgtccagaattggtgggttcttggtctcactgacttcaagaatgaagcctcgcagtgagtgttacagtttttaaaggcagcgtgtctggagtttgttccttctgatgtttggatgtgttcagagtttcttccttctggtgggttcacggtctttgctggcttcaggagtgaagctgcagaccttagcagagagtgttgcagctcacaaaggcagggtggactcaaagaatgagcagcagcaagatttattgcaaagaacaaaccttccacaacgcggggcgattcgcgagcgccgcccctcgcgcctcactccgctcgcttctatctcccatctccccaccaccacctttgatctccgccccatctcaccgccccctccttcccaccgcccgcccgcaccacgccttccccctcccctccccgctctcaccctccccctctcacccccccattcctctcccctcccctccccctctcccgccccctccctcctcccccctccccctcgccccaccctctcctctccctcccctctctccctctctccccccgccctctcccctctccctccgccctcccctccctctcctcctctctcgccccctccctctctctcctccttccc

SEQ ID NO: 220170 - DNA, 569 bp, Homo sapiens
tatttgtgaggtggctggtagagaagtgggagcaaggaggttgaggtagaagtgtaactttttaaaaaatatatatatttttaaagatgggcgtctcattatattgcctaggctggcctcgaactcctggggtcaagtgagcctctgctttagccttccaaggagctgggactataggtgtgcaccaatgcacctagcttgaagtgtaatttttaaacaaccacaacattccaagacaaatctttctgatttctgttcttttagtaattccctaaagcacagcttgtctatttcaagagttaaatgttcgtactgtgccactagtgactgaaacacagaagccaaataataatactgatattttgaaaatgatgtatgtaatggagctattttattttttaagagttaagaatcataaactgtggaatgaaatatataaagcatttcagatgtacaaatatataaaacatctagtaaaacaatgcatttacaaacattaaacattaagataaattgctatattaaatacaattagttttcaaaaataaaactaagctacgaaaaacaaa

SEQ ID NO: 220171 - DNA, 701 bp, Homo sapiens
aaaaaaaaaaaatcctatgatgatcaaactggaaatacacagcatagttagcacacgaatgcaagcccacctagtgccaatgcttgttattattttccactctaacacagcacctaaagccttaactgaggagggggaaaaaaaaatcacaaaaatcttccttcttgacatttaaatctattcaatcttccttatatgaggccaaatagtttgaaggctttagccatattagtttcaaaataatatgtgattttgatcaagtgcgggtggtgatagtttacatggtagctatcatcgttactttacatatgtaacactttcataggtgtaatagacttcaggcaatgttgtaagtattcgaaacatattaacttatttaatattcaaaaccaacctatgaattaggtaccatgacagaaaaaaaaatggttaaataaagtgcatgaggccaccaattcaaattcaggtcatctggctccagccttcatgctcttaatacaccacttgtaaacacagacattgagacttgaaatgttaagaaagcataaaaacaacactgtttcaataaacaagagcatacagtcacgtatctgccaccacagtcaatcagccttcattttttcattctaaaattggtatgtttaatgtacttaaaatgaaggaggcagcagatttacaattgctccttagtgtgaggttgt

SEQ ID NO: 220172 - DNA, 584 bp, Homo sapiens
agactccgtctcaaaaaaaaaaaaaaaaagaaagaaagaaagaaagaaatactgggtttgagccttatttagcacttagcatcaaacagacattttcttttccaggggctcatcctacttgtttaattccagccagataacttataatttgtcaatatgtcatattgaacattactcagctgtggtaagaactttctgtcatgcttgctttggaaagcccagatcatgtttattgttttaacaatattacgtggttaatttgggaagcaagaatagcagcatgattttgagtgctgataaaccagtatttgaattcctggtctctcccttctttgctgtgtgaccctggaaaacttagtaacttctttaagtctgtttccttgtatgtaaagtggaaacaattatagtaaccagttagggctgtgaggagtaatgagctaatatagacactccacacacatgaagctgctattgttatgatcaggattgttatttggaggtagtgagaaaagaatgatagaaggctggccaagttggattgtgcattgaaatgagaacattgaaagcaaggtggtgaaaggaaa

SEQ ID NO: 220173 - DNA, 646 bp, Homo sapiens
tatcgagttgtcttcttgcactcagtgagttcctggctgggggccacaagatcagatgagccagttcattgatctgtgtggggccgccggatccatcaagtgcagggtctgcaaaataccataagcaaacttcctcccaaagtgctgggattacaggtgtgagccaccgtgcgcggccctccctgttctttttgggacatcaactttgatgtcttctccagcaagtaacaaacttagcaataaccttggcatctgacctagctagggagaaactgagccaagagaggcgttacggaccagtgccccaggagtctcagagctccagcgggtgggtcatcctcagggcaagagaaggccttaatgccagcccgtgcattcggaacgctgtttgtccccactgatacgggttggatgctgcctgggaggaggacttgtggggatggttaatagatgagcgagctttctggagagagaagggtgagttatggggttggcagggaggagagccatcttggaagtgagtaagaggaagtgaggaaagagaaggagtggggcatttggcatcttactaagtcattggttgagttgttactggctgagtggaattaacatagcagaaggtaagattctttaggaaattaaaagt

SEQ ID NO: 220174 - DNA, 889 bp, Homo sapiens
cagtagcatagatattaccgtttttgtttttttgtcattttaaaataccacattactctgtgtgtttttatttatttagtctgacagtcttttaagagtttggtttgtttgtattcattatgataggggtttgttactaccatttacttaacgactactttctgtttttctctttctgcgcccctcctccttgccttgcctttttgattgattgaggactgtttgcttattagttttggtgttttgttttgttttgctcataattccattccttctttacacccatttttggaggctatacactatttctgtatccttagtggttctgaaactttactgtgcttacttaaaaagaagtcgtaagttaataatcttaactcattctagtataagacaatgattgtgaaacagtttaattttaatcagctcctttcctgattaaatgtttccagactagtgacttttaaaatgccagttgcttctgtttaactcaaaagtttgtccggctcacaaatgccattttggaaatgccatgtagcctgttcttacaatctaagagtattctgcaatggaaaaccagcttcagggaggtgctccattaggaaaatctagaaaccaaaaactgtggataatcactttgctgaggttttcattccctgaagaagcaaaagttgctagtctccctttgaacaaattttatgcctagcttttcttgggtttagagggcaaaattaactttttttgttgaagtagtgtgttatgaaggctaaagcgaacatcattatttcaaaggaaaagtaaaatagaatatggtcttactcacctggtagcaattgcataaaataacgtgtatccaacattaatttttaatcggtaatatttttttcct

SEQ ID NO: 220175 - DNA, 484 bp, Homo sapiens
cagtagcatagatattaccgtttttgtttttttgtcattttaaaataccacattactctgtgtgtttttatttatttagtctgacagtcttttaagagtttggtttgtttgtattcattatgataggggtttgttactaccatttacttaacgactactttctgtttttctctttctgcgcccctcctccttgccttgcctttttgattgattgaggactgtttgcttattagttttggtgtgttttgttttgagacgatggggttttctagatatataatcatgtcatctgcaaacagggacaatttgacttcctcttttcctaattgaataccctttatttccttcccctgcctgattgccctggccagaacttccaacactatgttgaataggaatggtgacagagggcatccctgtcttgtgccagttttcaaagggaatgcttccagtttttgcccattcggtaatatctatgctgctg

SEQ ID NO: 220176 - DNA, 485 bp, Homo sapiens
cgagctgaaatcgtagttcacgcattgtcagtgttgcttttgctgtgagaatagtccggtttcctgaacctccttgtgccagtgtattttagattctgtaaatgtgtgcagtccagcctgcactagaggaataagataatatcctacaaggtacaagctacaaggctccctagcattgcattgtggtccgggaggtaagccgtgtactgggatgcctgtgctgcagtcactcagctaaagaaaatattgctgagcatagacatagatctttgcccagccattgttacctatgttaaaaaggaattcttgttcatgttgagagcaaatcagcatctagaggctgatgtcagattttcaaacatagtagtattctgttgtttaacaatgtaaataattaaatctactttttccacaaatagaagtggacccaaattgacaaacttaatacgttctttgagctaaaatgaagttttgaaaaagtaccc

SEQ ID NO: 220177 - DNA, 441 bp, Homo sapiens
aataatttaaatatgcaaatagaaagtccatgccagttcttgtagaacatactcccatttcagttccatcagcaatagaaaagaaaaaaatgccctcagttgtgcacacaagagaaagattcatgcagttttttctccagatacaccaagaggtttgattcttccatgccttttgtgtttgcttgttggtccaactcaaatttcctccccttcttctccctgccaacatgtaatatacactttaatgctagagtgatcatatattttattggccaaagaaaacctttgagagtaaaagggcagtattaaactatacacctggctgggaactgcagctcacgtctgtaatcccaacagtttgggaggccaaggtaggaggattgcttgaggccaggagttcaataccagactgagcaacatagcaagacccatctctaccaa

SEQ ID NO: 220178 - DNA, 564 bp, Homo sapiens
acactgaacatttgttcaatctgttcacattctgggctcacttaagtatttgtgaatccctaagcactgtatttaaaaattcagcatgaagttctgttcatgtagtggcttcacagccaaggaagccagcaactatcagaacctgaggatgcatcaaataatttctatgatgatggaaggtaactttaaaactcaactaagacaagtggaaatgaattatcaggttggcttgctcttgtatgggagacagtcctgtgtacaaatctgcactctacttggaattaatgagaatttcttcagcaccaactgtgtgtatatcactatacttggtacatataaacaaacagtagataatgtcctcacccttttggggcttatgatccatagaagactaaaagacaaagcaaaagcagttcaacatgataaatgtttgataaatgttgtgggtttagcacagggattcttaaccaggaaaccagttctgggaaggaataccagattcacctatagaccattttcacagtttactattctgcttttctttccacccttcttcgtcgacgc

SEQ ID NO: 220179 - DNA, 435 bp, Homo sapiens
cctcccttcacccttcctcatactggctctccgaggaagtgaaattagagctgagatccaaaggcagaaatgtgaccgaaacaggagatgagtggaggaaacaggatcccagccagagcataacacgcacagagatctgaggtagaaaacagttgtgtgtaggctgggcacagtggctcatgcctgtaatcccagcactttgggaggctaaggagtgtggatcacttgaggtcagaagttcaagaccagcctggccaaattggtgaaactccgtttctactaaaaatacaaaaattagctgggcatggtggctcatgcctgtaatcccagctacttgggaggctgaggcaggagaatcgcttgatcctgggaggcggaggttgcagtaagccgagatggcgccattgcactgcagcctgggcaatagaatgagac

SEQ ID NO: 220180 - DNA, 555 bp, Homo sapiens
caggagcaggagtggcagctgcagcagggtggctgaaggtgtcatgtgcatcatttttcatattatttagcaacagtgatgagatcactccccatgggcaaacggaggtgggtggcttatatttgctgaaggaaggacagtcttcaggggatggctgctgggctgggactccagattgctgactgccaaagctgctcctgcattttcctgccaggagagccctctctgccctcctccctccaatcacctctcaccatcttttgggttattgggaagattagaaaaagtgagacccagccaggcccagtggctcacctgtaaatccccggctactcaggaggcggaggtgggaggatcacttgagcccaggagtttgagaccagcctgggcaacatagtatgagacttatcactacaaaaaaaacagccaggtgtggtcgtgtttgcctgtggtcccagctacttgggaggtttgagccagggaggctgaggctgtagtgaactgtgattgtgcctctgcactccggcctgggcgacagagtgagaacttgtctca

SEQ ID NO: 220181 - DNA, 342 bp, Homo sapiens
gccaaagaccgaacctaaatgaccatgacagaggactggtttctttcttttctctttctttctctttcttctttctttctttctttctttctttctttctttctttctttctttctttctttctttctttctttcctttctctctctctctctcttccttccttccttcctctctttctctctttctatctgtctgtctatctgtctttccttccttccttccttcttttctctctttctttcttttttttttttttctggatggaatttcactctgtcacccacgctggagtgcagcagcacgatctgggctcattgcaaccaggggctctcaggttcaat

SEQ ID NO: 220182 - DNA, 311 bp, Homo sapiens
  misc_feature (32)..(32): n is a, c, g, or t
  misc_feature (58)..(58): n is a, c, g, or t
ggggagtggtctggggagaattctgagggcgnagctggaaggttgggataggggtcantggggcaaccaggactctgcccaacatcaggaccatcagcaacagcagagcacacctggaacagaataaagagtccaaacataaaggatagtctcttcaataaatggtgctgggaaaattggatatctacttgctaaagaataaaatggatacttatttcacaccctatacaaaaatcaaatcaagacagattaaagacaaaaattgtaaaacctgaaattataaaaactagaaaaggctgggcgcaatggct

SEQ ID NO: 220183 - DNA, 607 bp, Homo sapiens
gtgagtgccagagactctagagcacagtgcttgtctgtcctgggtaggcaggtgccagtcagcagatgactgccatcatagttccagctatgctattagcaagttttctgattttttaaagaaaaattctaagtgtggatattttcaaaaggagttatctctcgatttttaagtgttggcaactaatcaaatctgtgcacaaaaaaccacaaaggcttgggtcctttggtttacgatgtgacctcttctgaggaggtattaacattttataagagatctgcttccttagagaaatttggagacctagggtggtctaagaaaaatcacttctccttctagccaagactggcagtcccaactctgctctggtgaaaggtttggccaagccaccatctccccaccacagttgctagttccttcaaggaggaactgaaggaacactgactctcaacagctgttgcccgttcccaatatcatggctacatcacaatactagagggaaataattactgtcatggtgataagaattttaagtgtacatttctaagatgtttttagttagctagtgaaaatacaattcaaaaatataagccatttatatgggaaa

SEQ ID NO: 220184 - DNA, 390 bp, Homo sapiens
taattttagtcagtataatcaagatgtggtgttatttcattgtgtgtgtgtgttttaaacagctttattgagatacaattaacataccctatgattcagtcatgtaaagtgtacaattcattgttttttaatatagtcacagttaatgtgcaaccatcagaacagccagttgcagaatattttcaatacctcagaaagaaactttttacctttagctaccaccaccctgcttcctaaccccatccttaccctccagcctaagcaaccattaatctattttctgtctctgtaagattttgctgttctagacattttatatgaatggaatcctaaaatatatggcctttgtgactggcttctttcacttagcataaatgttttcagggttca

SEQ ID NO: 220185 - DNA, 469 bp, Homo sapiens
tggtcaaatcctgccatttctatatgacaatgcaatttgctgggaagacggggatgtgtgtgcaggggtagatgtaccctggctatacctggagcacagggacttattggctacacctggccatcaacaagatcatccacctggaagtccattagaatgacctggggctccaaacacaccctgcccaggccctacccgtacattctctgtttggcctggtggggcttgggcatgttacgtttaaaaaatcttgagtgattctgaggtggagtcatggctgtggcttcgctgtggcattctggtctgcgtggagccctgaatggcagggttttacggcaaatgcaatgactgcccaggggcttctaagtgaccctgacctttttcccaagtgtcccacctctgaacaagcctctggctatttttgcttcctcctttgccactaagggagctactgtgaaaaaaaaaaaca

SEQ ID NO: 220186 - DNA, 453 bp, Homo sapiens
agaaaaacaaacagcattatgttatcacttatttgtgagatctaaaaatcaaaacaattgaactgaagaagatagagagtagaagcatggctaccagaggttggaaagtgtagttggggggggggaaatagggatgtttaataggtacaataaaaagtagaaataatgaatttactatttgatagcacaaaagggtgactatattcactaataatttaattgtatatttcaaagtaaagaatataattggattattgtttgtaacagaaaggttaaatgattaagtatatggatgctcaattttctatgatgtagttattatgcattgcatgactgtatcaaaatatctcatgtacctcataaatatatatgtatctgctatgtccccacaaaaaatacaaaatttttttataaaggaaactctaagaaaaaccttggactcaaagctcattc

SEQ ID NO: 220187 - DNA, 354 bp, Homo sapiens
ttttttttttgatggattgctgcggaagacatcacatcctttgatttcaatgtaagactagatgcagctatcaataacacaacaaataactatgtactcaacacccagttgaagaaataaaatcatgacaacagagctggcactttctctttcaagttatgtctttgtgtccatcctgcttccaaattacattgaaggggcaaccagttctcctcagcactgccagcttatactcctctggagtgtatcctgaaccactgggacttctttgacactcagaatctggaagaaaagtgcttcatatcccactgcaccaagaaggcgtcgaactccacatgaatcaggcaaccagac

SEQ ID NO: 220188 - DNA, 546 bp, Homo sapiens
ggtcacccaatcaaccaaacaaaaatcatatacttgaatcaaagctgaaacttttcagtggtgatctacaaggaaacaagtaacaaaatgtgaaaaatatgagcatttatttaactttggaaacaagaaaatgccatcagagttagaaccagaatcatagcatatcagagcccaaagggccttccaaggtcttagttctatccattcattgcctaggtgtggacatatattcattaaggataaatggcatgtcagagtcacctgcctaatgtgtgaaagggtcatcatgttctgattcttggcttagcatgctttctattaatacaactttgataaatggacaaagggccaacagaatgagaagtataaagtgacagatgtcttctgaaaagtaatggtagccagttgaataatgaaaacagtaaattttaagaagactagggagtacaatgtaataattttaaaaagaaggcgaatttaaattcacttccaagtgacactctccaagatgaattatctgtcctacgttaaatgttccagaagacc

SEQ ID NO: 220189 - DNA, 272 bp, Homo sapiens
tccctgattcctgtgagagattagttggctctgcacgtagagcctactacaaggtgtttgccacgccttcttggaatttcatgtttacacgtctgtctttgactctaagttcagtgaagtcaggaactttcttttcgttgtcataaccgtggttctaggacatattcgatatgcaataaatacttaaaaacagcattgaaagatgttaccctagtctggattttgaataaaaatgtaatgttatttcatttgagtccttgtaacaacctttt

SEQ ID NO: 220190 - DNA, 461 bp, Homo sapiens
cacggtgtctcatgcctgttatcccagcactttgggagaccgcgaggtgggaggatcacttgaggtcaggagttcaagaccagcctggccaatatggtgaaatcccatctctaccaaaaatattaaaaattagccggtcgtagtgatgcgcaactgtaatccctgctactcgggaggttgaggcacgagaatcacttgaacctgggaggcggaggttgcagtgagccaagaaaaaaaaaattagctgttatcacacaattaagtactaacatggaaattaaaaatcatgagtagctgtctttccttatgaaatttcctagactacactccataagcagcaaatagaagtgttactgtgactatagaacaagttggcaattttttaatttgactgtcatttttctaaagtatctgtaaagaaaatccatttctgactggactgataatttataaaatatcct

SEQ ID NO: 220191 - DNA, 425 bp, Homo sapiens
agaaattaaaaaacaaaaaacatagctgggcatggtggtgtgtgcctgtagtcctaactactagggtggctgaggtggaaagatcacttgaacccaggagttcaaggctgcagtgagctacatgattgtgccactgcactccagccttagcaacagagagaaaacctgtcccctataaaagcaaacaagatcttatctgcctttttcactgtgctgacatttgctctaatggtacaaaagcaaaagcaatggtgggtgaaactgttggggccttagtacacctcaaagcaggaacactaaactgtactggcaaaatattttacaagcctttgtaaattattttacaaattttgtaaattactctacaaaaataccagttgtacttaagaatgtctctgatgaagcagtaaaaatatgtcaatttt

SEQ ID NO: 220192 - DNA, 887 bp, Homo sapiens
tgagaagttggtgatgggggaagagtggacttttttttcaaagaatgctgtggtgactcgagtacaacacatgaagaattccagaaaagagccatttttgaagtcagcggtgaatcagaggttttctgaccctctcgagtgccttctatgaagaagagttcaactctggctccagtttgtcccctactcttttcccgaatccctcgacattccttgctcttttccccaggcaccgcatggcctgtgacatttgctgggactcacacacggcgtccaacctcctttctccgagcgatgactcctaggaacttcccaaggaccagagcgatgcaggctccgacacgcgagggcggggggcgggggtgaggggtgcgatggacgggggagcggaagggaaagagagagagaggggacctgggtgtagagagggcccagggccgcatgagccaagccagggaggagcagggggttcatctcagcaacctgatcggtgtcggcctttccctcccttcaaccctccattggtgttgctggaactgggaagactgctagacagacatcctctagggcactctccctgactcactttgctgtgcttttaagcgctcttttctggatcaacaagagtttgctagtaaaaatctgagcccgccatctcgatgcttctcctgtctctaaaactggtgcccgggctgaggccccaggtgacagacgttttccagtctacgctgcgcggggctaagcctctgcgaggcagagcgcactaaagcgtgcgccgcctccgggagagctgagctcaggacagcatcgtctccgtgcggtcgccgctgggcacccagcagcgcggtctggctccgcttcttgtgtcgctggccttaagagtggga

SEQ ID NO: 220193 - DNA, 306 bp, Homo sapiens
gaaaaagactgtttagttgacatctgagaaaataagaaggcaggaaagaagacagcatttggggaacagtctggtttggtaggagaatgataaaaataaggctggaaagagcttggggccagattttggaatatgaagtattaatggtagtttaagtttagattttattcgagtgcaaattcagaaagagcattgactccctgtcacttttcccccatagcagtgaccataataatggcagaaatatgaaacggtttttatttcatgttaactctgatataccagaacattcaggaaaaaatactt

SEQ ID NO: 220194 - DNA, 436 bp, Homo sapiens
gtcaaacattatttcttagtgtgtctgtgagggtgtttctgaaagagatttgcatttgaatcaatagactgaataaagaagattgccctcagtgatgtggacagacatcatcaaagtcattgagggtatgggtagaacagaaagaaaaaggaagagtaaattctctctctcttcttgactcacaacatctatcttctcctgtcggcaggcatcacagctcctctggccttcagactgcaagatttacaccagtacctcttgccccccgctcccccattttgcagatctttggcctctgatggttagttacattattggctccccaggttctcaatccttcagacttggagtaaatttctcatttggctttcctggttttccaacttacagataacatattacagcacttctcatcctccgtaattgccgtcgacgc

SEQ ID NO: 220195 - DNA, 501 bp, Homo sapiens
agccaggttcttctctgtgtatggttatgcatgtcctagatggccttgaaattgatctgttctccattagcaatctgtgaattgtactcctgtctgaaattgagtagaggtcagagctatgaaggttgaattcaacaagaatttttatgaagtataactagagttagtgctctgctctaactgcttttggagacagactttccccagtgtatcccatcaaatcacagactaaaaacagtctatttccccttattcttggccagataggacctaggcacctgaatttttttttaaactagatttccaggaaattttattgaaggctaacagcatagcatttcatgttggataaagaagatgcacaagacgggacatggtaagacacacctgtaatcctaccactttggaaggatgaggcaggtggatcacttgagctcaggagttcaagaccagcctgggcaacatggtaagaccctgtctctccaaaacaaacaaacaaac

SEQ ID NO: 220196 - DNA, 727 bp, Homo sapiens
ctctagcggatccccctgatattctggaggagagagtgggcttagaaaaagtttatttttataagccctggagatcttgattgacttatttaggccaacagtaagtttgcagttaagaaatctagtgcctggttaaggtattatgtcaagaaatattgtgtcctttttaagaggttattgtcagtgtagtctgcacggattggaacacacctggaaaagttgttcattttggctcctttctttaaatggaacaaactaagtggagcggctaaagggagccagcatggtcacaggctatatagtgcgaagatgaccagcccgaggagaaggaacttgtggaaatgtgacagccagctgtcaatatgggaaaggatattgtcgggagtagtggtcaaagagcagaatttattagaaagcacacttcacttaggtcaacagaggggagaactttctctttgcattttccctcagtgaatgggcctctttacagagtggcagagactggggaacagtgtttctttgttgggagaaaaattagatggcaggagctctaaggtctttctgcctgtgagactgaattgacccaaagaaaaatagatcttggatgggcacagtggctcacgcctgtaatctcagcactttgggaggctgaggtgggaggatcacttgagcccaggaattcaagacaagcctgcctgggcaacatagtgagacccccgtctctaca

SEQ ID NO: 220197 - DNA, 356 bp, Homo sapiens
tgaacctgtgaagagtttccatgcagggaaggggggatgagtagagctagggacctaaaatttgagaggggaagatattccccagtggaagacagtaaatcaaagactagagaccaagcatcagtctactgggtgtttgctacacctctgaagagctaaggttttccctcctgttacagtaatggacactcaacaacacatacccttcccagcaacctgtcctgctggaaaactactcgataaggtaacttctgcctgaaggggaccagggtcatcatacccgcaagtgcagcatcttcctgcagctctcatactaccaagctggggtttttccaacataaacattacaggtgcta

SEQ ID NO: 220198 - DNA, 202 bp, Homo sapiens
cgagatttgaacctgagtatgcagattcgatgtgatacctgttttggaggccgttttgcataaagggtaaggattttgcgatcttgtgtcctttcccactggggcaagtgtcctcatgcctcactctttcccagagtgggtctggactgtgatcttgagtctgaagaaatacctctggtgcttggagacatagatttgggga

SEQ ID NO: 220199 - DNA, 516 bp, Homo sapiens
aggctgttagagcttgaacaaactgacttttaaccatagcactcaaatccttttaaatatcttattacctgactttagccatgccaaacagccgatattttttgctcagagaaaggaaagttcaagatggtttgtggagaggaagagaattaaccagtggtaaaggttatacagattttaaaccagaaaggattcattccctaagccaggattgaaccctgggccaccattgtaaaatggtgaagccttagctattgagctacagcattggctggtttccgttgttcttcccagaaggattttagagcagccaattctgagcttgcaaagtcttttaactgttcaagataatttttagggataagtatgacatgaacccccaaattcctatctgttggatggtggaaaccaagagaaagaactgccatgtggttacaagttcaagctcccaaggacatttttcaacatgtggtctctgggcacaatgaaagagcagacagttaccctgagtaacag

SEQ ID NO: 220200 - DNA, 1110 bp, Homo sapiens
gaggggttatgttgaggtgaggacacgaggacacgtttttgcgcgcatggcgtggggcggattttaacccccgccttccccttttcacccccccatttttcccttctcccccccttttccccaaaaaatccccccccacaaaaaaaaaaaaaaaaaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacaaaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctgg

SEQ ID NO: 220201 - DNA, 583 bp, Homo sapiens
aaatgctgatgccatgctcttagatagctcagccttgagaacaatgagccaaataaatttctttttcttttcttttttttgaggcggagtttcactctgtcacccaggctagagtgcagtggcatgatctcgactcactgcaacctccacatcccaggttcaagcaattctcctgtctcagcctcccgagtagctgggattacaggcgtccaccaccatgtctggctaatttttgtatttttagtagaggcagggtttcaccacagtggccaggctggtcttgaactcctgacctcaaatgatctgcccaccttgacctcccaaagtgctggaattaccacccggccataaatttctgttcattataaattacctgttctgtggtattctgttatagcaacataaaatggactatgatagaaaattggtcctgagaagtgaagctgttgctattaaaaatatctgaaaatgtggaaatggctttgaaactgggtaatgagtagagcagaagaatttaaagaagcaggctaggaaaatcttagattgccgtaaacataatattaagggcagttctgatgagggc

SEQ ID NO: 220202 - DNA, 397 bp, Homo sapiens
ctctcattcttctgaattgggttgaggatcattccatgtgaagcagtgggataggcttagaatacatagatggacctttgaaaagacccatctcagcccccgggaaaactcaggaatgatttctggattcttaatatactgcatcttcatgtatagacggccacgtattggggaagcaaaaaataaacatttagaaacaggcaggtttgggtttaaattccccatctctactaaaaatacaaaaaattagctgggcatggtggcgggcgcctgtgctcccagctacttgggaggctgaggcagaagaatggcgtgaatccaggaggcggaggctgcagtgagccgagatcgcgccactgcagtccagccagggtgacagaacgagactccatctaaa

SEQ ID NO: 220203 - DNA, 317 bp, Homo sapiens
cagttgatgccacttgctattggagttgtgggtaagtggttttacattgcattacacgactaaaaggtaatcagattttgctactgttttggtgtacagatgctctttgatttacagtggggttaccttttataaccccatcataagttgaaaatattgttagtaaaaaaatgcatttaatatacctcacctaccgaacatcatagcttagcctagcctaccttaaacatgccaagaacctgcatgtttggcatgtttggcaaatgcatctaatgagcctattttataataaaatattgaatatctcatgtaattta

SEQ ID NO: 220204 - DNA, 471 bp, Homo sapiens
ggtgggggtggggaccctgcagttgcgtgtgctttgaattcagccgacggttgtacattccagtagccggcatctggcggtgaattcatcagccagtgtatcacccttgatctcaaacccagatgttgtgttcacagcagaagggaaagaaggaaaaacgaaatctgagacgcccagggagaggccgtggtttctgggctcagggcagttagaacgagagtctttataaagactccccctctcgcagctgcctctggctccttggggaaggggcagaggagcagagcagcccctctcgggggcatggacaggagatgggctgacacccaccccagtgcctaacaccaggcccagcacccagtaggtgttcagtaaacgtgtctgtgccacaattttcatttcttcccagattccttatgtctcttcgctttccccagccctgttcttcacatggcctgggactcggagagg

SEQ ID NO: 220205 - DNA, 447 bp, Homo sapiens
ttgctgcttgctgtatctgagccaatcagctgctaaggcctcctgccctgctgaactattgaaagaaagagctaaggcaagaatttttacttcatgagccaaggaagaggcagggaccagttaggggaggtccaaggtgaggccccagtgcatgtgttagattctgagaaaagcctggcctgaggggtatatgagctaaacctgcctgtgagaatggtccttgccaggtgaacacgtcttctcaggctttgagtagcttccaggtaaaggaaaaattttttaatgaaaaaacaaaaataaaataagcaataaaagaaatgattgtcaaagataactccaagaggattaaaagaaacaaacagacacaaatgaaaaaaaaggtaaaaaacatgaaagaacaagtcaagactaagaaaatatatttaaaaaacaaataaataatccaga

SEQ ID NO: 220206 - DNA, 364 bp, Homo sapiens
gtttctaaggggaagccggcatctgctgccatggccctgagccgccggcatgacgacgctggtgacctcaagggctgcgaagctcaggactgtgtgcggctgcaaagctgagctgtcgtcttgcctgtggcttccgaaatgcagccctgggccctgtgatcgctgcattttctctgcgcagctttgagggacggagtgtgctgaccaacagaagaaaggcaaacagcagaaactgacactgtggtggccactggacgtggcctcggtcggctgcggagagagaatttatttccacagcgaccctcaggaggcgcaggtcttggccagacccattcttagaaaggaacatgagatcagaaaggct

SEQ ID NO: 220207 - DNA, 505 bp, Homo sapiens
tccgcgccgcctgagaagggggcggaaggaaggacggagaagggtgaggggcggattaacccctccctggcgactcctttgtctggcccggacattgctgagccgagtggggcgcccaggagccagcgaggggctcccgaggcggccccggctcggcccaggtgtgcgggccgcggtggggcgcaggttcgcagcggagccacgagatccccgcgcctccggctgacgtccgggcgcccagggtctgcggccccacgtgcgatccatccgggagctgcgcctcagacgcctcgtggagcgggggagaacctgaaggaagtcgtggcgcgtttagatattttaaaaactcgaattaattgggaaaataggaagggcgcttccaaacgcggagaagacatcccggggtggggaaggatgtcttttaaaaattatatccccttgttgtggcggttgtttttgacctttcctactattaaaagaaatgttgccacgtttaatttttgtt

SEQ ID NO: 220208 - DNA, 747 bp, Homo sapiens
tgcggtagcaggtgcctgtaatcccagctactcgggaggctgaggctgaagaatcacttgaacccaggaggcggaggttgcagtgaaccgagatcgtgccactgcactctagcctgggcaacaagagtgaaactccatctcaaaaaaacaaaacaaaacaaaaaaaatgacagaaacatatttgaaatgtattaaattcatttaatgttcccttcttatgaactctgattaaattaagtaagaattccgcgtacacttcaacttgtgtgagagaaggagatcctgaagggcaactgaagagcaattatcacatttaaaatacgcaaaatctgaattaatttagtacctaaaacagaaggctgaagagcacatgaacagtttccacgaactgaaatctgaaggtccacagttaacatatctgctttctcttccctactacagaaaagagttgataggctggcctaagagttcctgttaagttactcaagagagagtgttctctcattttctggagaattattctgcaaaaatgcagttctctgagacggtttgcacacaggagaaggctggcaatctagaatggagtggcaaccatgagtttcctccctcctgaaaatatctggtctgccaagcccttcatatgtgacccttatggtttcttcaagggcttctaggcatacagctgatcccttagggaaatgggagaaaccaggaagttagccatagcccactccttactccctagtt

SEQ ID NO: 220209 - DNA, 243 bp, Homo sapiens
cccattgaaaatgttttaccttttacgtgaaacgtaactgtaaaagtgtgtaggtaaaatgtatatatattttaaggaatagtaatcaaatgagcactcatgtaacattgatacagcatgagaaatagaacattaccaacaatttagaaactgtgtactactccccaatcacatatcctttcctctgccagagaggtaagcacgttcttaaaattcatgttaatctttttttttgtaaacttc

SEQ ID NO: 220210 - DNA, 492 bp, Homo sapiens
atctagttgtcccaacaccacttattcagtagttcccgtctctactggtatgatacacctcttttatcatttactaaattcccatatatacttgaacatatatctggattttctatcccattccattgttttgactacttatgtgtcagtattttcttttcttttcttttctttttcttttgagatggagtctcactctctcactcaggctggagtgcagtgatgcaatctcgactcactgcaacctctgcctcccaggttcaaatgattctcctgcctcaacctcccaagtagttgggattacaggcatgtaccaccacgccctgttaattgttgtatttttagtagagacgggatttcaccttgttggccaggctggtctggaactcctgacctcaggtgatccacctgcctttgcctcccaaagtgctgggaatacaggcgtgagccaccgcgcccagccgtcagtattttattttcgtatgtaggtgt

SEQ ID NO: 220211 - DNA, 582 bp, Homo sapiens
tcatgttcaaaaattaactcaaaatggaccaaagacctaaaatggtaaaactcttggagagaacacaggggaaaagcttcatgacattggatttgcagtgctttcctggacgtgacaccaaaaacacagattacaaaagataaaataattaaattggaccatatcaaaaatataaatttctgtgcctaaagggatataacagtaaaaaggcaaccgaaaggatggaagaagatactgcaagtcatgtatctatttctttttttcagctttctcaggttgaacaagtcatatatctaataaatgttaatatccagaatatattaagaattacaagtcaacaacaaaacaacccaattttaaaaaggggcaaagcgctgaatagacatttttccagaggtgatacacaaatagccaataagcatatgaaaagatgctcaacattactaatcatgagggaattgcaaatctaaaccacagtgagataccactttacattatttaggatggctactattaagcagccaaaaagtgaaagtaatccaagtccatcagcaaattaatggataaacagtatgcaggatg

SEQ ID NO: 220212 - DNA, 295 bp, Homo sapiens
atattggaaatgatgtgttatgttatgattttatgagtggttgtttttatttgagatggagtcttgctctgtatcccaggaacataccccacgcacatgcacaccacacacacacaccccacatcactcacacacccagcacacccagggcatagagtgtggctctgatagaagtaacatgggcctctaaacaagtgtggcttcttttcatttccaagctataggcagaaagcctggactacagctctagaaaccagatctcgcctcctcttcagcctcatagcatgtgtctcat

SEQ ID NO: 220213 - DNA, 409 bp, Homo sapiens
ccacatctagaacgaacagccagacggcctcaaaacctctgtttcaacagccacatggcctcgaaacctctgtgtttcaacagccagagggcctcgaaacctctgtgtttcaagagtccttgtacctgctgtgaagtttgtcagagtaaacttcagtgtgtgcaaatctcagaggagggccaggctctggtgggttctagggccccccaacctgtgcccagattggcacagacttcctaagcatgaacatcgtgatgcatggagaataaactgacatgatggacttcataaaaattaagtttttgctcttctaaacatagtactaatcaagtaaaaaggcagacaagagtaaaatactttcagtacatatcttcaactcaacgatcagacagacaactcagttttgttt

SEQ ID NO: 220214 - DNA, 652 bp, Homo sapiens
caaacagagatttacagacacatagtagggtgtgtatatatatagatgagcatcaggtataacacataaatgcttatatatctaattggtgttgaggtctgaattaatgtatttttgaaagcatcggttcttgtgacagtagaatcaaatacttgcataatgttttatagactagttataatccttacaaaaatcctattgacaaaatagcattagcttaatattccagatgagaaaatgggctccaagtaattagatgctttgttcctgatcaaacactaagtggaaaaaaacccacctcattacaaaattttcttgttgaaagacttcagactgcctctaaaatagaggagagaagaaatagtctgacactctaaattggatataaacgtcagaattgggactataagtctagaaaaagtaagtatgtttaatggcacatatagaacttacagtcttaacaaatgaagctttttggtcaattttggagtatgatcttctataacacggaaaatcattttggggttttttttcctgaataattcataaatggagatggactaaagaaaatataaaggaaatagcataggaaaattttgtaaaaacttatttggatattttatgatttttctacatctgttttctaaatttt

SEQ ID NO: 220215 - DNA, 428 bp, Homo sapiens
ggctttaatgtttcttaaaatggatttcactatagtttgttgcttactccgttgcatcatatttgaataaaaactctttattgtatttccagatcttaaaacatcactggcattagtttcatggtagctctcttcatatagtgccttggaagctaaattttgcaattacctagtaattatttaagcattggagcattggagccaaagaacagttcaaaggaattcactgaacaagtgccaaatctttggattgatttgttatttcagcttccttaaacttccaaaagagtctcacatgcaaatgtcttaagaattattaatacaagaacaaaagtataagagccaattgataaaatgtttgggaaatgattgtatctaaaatttagactaaggatgatgttaaaattgattgcaaaatggctagccaa

SEQ ID NO: 220216 - DNA, 404 bp, Homo sapiens
gatgggtgcagcacaccaacatggcacatctatgcctatgtaacaaacctgcacgttgtgcacatataccctagaacttaaaatataataataataataaagagtaccgctttatttttaaatgttatcattcactagttatgccatctgagtttgcaggctatttttgtagaaaagtttatggctaaactgaatttcttcaatacatgtagggtttactcagatttctatttgaggtactatattttggtaatgagcatttcccaggaattttctatttcatatggacattaaaatgcattgataatatagttttattgcctgtttaataactgtaaagaccataatggtattgccatgtttaaactgggaataaaatatctgtgccttttcaaaatcttccc

SEQ ID NO: 220217 - DNA, 477 bp, Homo sapiens
ccacattcaagagaagaaagcaatacaaatccttaaacactggtattagcaaacaagaatgataaagcccctattataattattctgaatgacataaaggaaaatgctattaatggatgagcagatgggaatttcagcaaatgagtaaatcagtttgaaaatgggaattctaaaactaagaaatacaatgtttgaaagtaaaaatccactggataggtttaacaggaaatttgaggtggcagaatagttaatgaagttgaatatagatagaaattatttaatctgaaacaaaaaggattgaaagaaattaaaaggactgaatagtgctggtgataatgtcaaaaggtgacttgtgataatgctttgtgttctctgatcttcctagatctgtggtttggtgtttgttttcttgcttttagagacaaggtcttgctttgttgcccaggagggagtgcagtggcaggataatggcttgct

SEQ ID NO: 220218 - DNA, 180 bp, Homo sapiens
gctgggaatgtgggctgggtttcatcctccagctctcccctccttttattcctgctgggttcctagatatgaggagctctaagtcaagggtctgccttgtgttgatagagaacaggttcttggagccagtactcatgcaaagggatgaagtgcaggcttgacagcttcaacattaaatca

SEQ ID NO: 220219 - DNA, 895 bp, Homo sapiens
ggaagaatgccccttgcatcctcttccaatgtggtgggaaggaagacaggaaaaggcaactttggagggcagaatgagcaggaggacacactcaaccagctgctggtggagatggatggttttaatacaacaacaaatgtcgtcattttggccagcaccaatcaaccggatatcctggaccctgcgctgcttaggccggggcgtttcgacaggcaaatctttattggactaccagacataaaaggaaggggttctattttcaaagttcacctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgagcgagtgattggtggcttagagaagaaaacgcaggttctgcagcctgaggagaagaccgtggcataccatgaagcaggccatgcggttgccagctggtatctggagcccacagacctgctcttaaaggtatccatcatcccacgtggcaaaggactaggttatgctcagtatttaccaaaagaacaatacctctataccaaagagcagctcttggataggatgtgtatgactttaggtggtcgagtctctgaagaaatcttctttggaagaattacaactggtgctcaagatgacttgagaaacagtaactcagagtgcatatgcccaaatcgtacagttaggcatgaatgacaaggttgggcaaatctcctttgacctcccaagtcagggggacatggatataggagaaaccttacagtgaagccactgcagattgatagatgaa

SEQ ID NO: 220220 - DNA, 740 bp, Homo sapiens
tagtccagagtaataggcaattagaaacatggtgagtcaaataattctgttcttttgttttttccctcttgctcattcattaatttggtctgtatttattgagtactaactacatagatattgcactaagtattaggatacagtagtaagcaaaaatctgattgcttttcttatggagcttaaagtctaatgggggagatggacattagtcaagtaatcgcacacataacattttaactgtaaggaagtcctatgattagaaggtacatagttctgaaagagtttatttaaataggtggatttgacctaattatggatagatatcagaagagaccactgagctgagatccaaagtgctgggattaacaggtgtgagccacctcacccagcctatgaggttttaatagcataagttgtagcatccttaatgtgttgaataaggcaaatttgaaaagactgatgctatggaaaatataactttaagcatgagtacaatacaaagctcattactaaattttcataccaatttttatatttatcactggccccaggcttcccaagtatttagggtcaacatctttacctttggtacccaaagtgtaggtcttaaaatggcagcatttgcctggcacagtggctcacgcctgtaatcccagcactttgggaggctgagacaggtggataacttgaggtcaggagttctagactaccctggccaacatggtgaaaccccatctcta

SEQ ID NO: 220221 - DNA, 481 bp, Homo sapiens
tagtccagagtaataggcaattagaaacatggtgagtcaaataattctgttcttttgttttttccctcttgctcattcattaatttggtctgtatttattgagtactaactacatagatattgcactaagtattaggatacagtagtaagcaaaaatctgattgcttttcttatggagcttaaagtctaatgggggagatggacattagtcaagtaatcgcacacataacattttaactgtaaggaagtcctatgattagaaggtacatagttctgaaagagtttatttaaataggtggatttgacctaattatggatagatatcagaagagaccactgagctgagatctaaaggaagactaggaggccaggcgtggtggctcacgcctgtgatcccagcactttgggaggccgaggtgggtagatcatttgagcccaggagttcgagaccagcctggcaacacaggagaccctgtctatg

SEQ ID NO: 220222 - DNA, 540 bp, Homo sapiens
cagtggaaactctgtgatggtgacaaacatgggaatcactctgatgtgacgcagttaaatttacaccttaaaaaatggatgccaagacaacataaacaagacccagggacaccaacagggtatggtgctgtgccccagagtcagggtcctgggttcttacccagggaagtgagaaataaagataacttttccctgctccctctctcctcccctgacactgatcttcccaccctgtacctccctcttctgctcccaaacccccacccagtgctcagtcgcagacatcactgcctgcagggcatgcacagtgcagcccattgcacacaaactacaaactcacagaaggtgatgacaatttgtgtttgggacgtctgattgtgaaagagggaggacagcgtacttgcagccacagagactgaaactggaacgtgatggaacggggctggaacgtgatggagctctgacataacagacgtgtgactttgtgtgaaatgtgcagatccatgtggaataaaacacagcctagcctgtgaaaaaaaa

SEQ ID NO: 220223 - DNA, 521 bp, Homo sapiens
atgtatgcaagtgtactttagccataggttttgatgggaaagtagagagaggaaggaagggattgggagcgtgatgcatgtctcgggagggtggagttgtgaggacaccatgctagagggtatgagaagggaggaccagtttgttcagttgtgtgggctgtgcgctgcacaactcggggataccattcaaaaccatatgtattagacatctgaggcttggagaagcttgggaaatagtagttgagtggccacttgctacatatttttaaattccgctggcctacccagctcctagcctatggtttttaaaacccctctgctagctggaggctggatgagtcaatggagcgtgtatcggtgataccgtatagaagcactactgtcttgatcaagaatttgcattttcttcctgaaattatgcagcatcttaaacatgaatattcaataatatttaatattcaataataataattataaaataaatattgggaatttaatccatagagtattatttaaacact

SEQ ID NO: 220224 - DNA, 451 bp, Homo sapiens
gcggccgcgcggagcggggagccgccagcctgcgccccgtccgcgggtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatggcaaccatttggaggcccaggccagaggctggaccaggaggattggatgcatccgcgctgtccatccctgctgctgcacaaacgactcagccacagatcctcttggatgggctaccttgaaagggggaagctccaaagaatgcgtacaaacccatacatttacctaggtgcgggatgattgcaagaccactttatt

SEQ ID NO: 220225 - DNA, 301 bp, Homo sapiens
  misc_feature (47)..(47): n is a, c, g, or t
  misc_feature (87)..(87): n is a, c, g, or t
tttttgggggggccccccaaaaaaaaaaaccccccccccaaaaaaancccggggggggtaaaaaaaaaattccccacattaaggagnttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaa

SEQ ID NO: 220226 - DNA, 4967 bp, Homo sapiens
cgagaatgttcctagagggtctgcgcagctagagagagctcaccaagagaagttggcgcaaagtagctagccagagcctggggactgtgttaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccgctgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgctgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaa

SEQ ID NO: 220227 - DNA, 4704 bp, Homo sapiens
cattatatcatgctgattttaaaataatagtactaatatgtatttgcctgcagtttggtccacaaggctcctttgaattcacttaaaatcttacttattttctttcagagacagcctctgcctgtggagatatttgtctcatgcataccccttgtatctggttttctttgtacccaggacttccgccttatctagtagccctacgtatccggacctgcccttcattaggatctccccacaccggaaccccgctgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgctgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaa

SEQ ID NO: 220228 - DNA, 3990 bp, Homo sapiens
  misc_feature (3952)..(3952): n is a, c, g, or t
  misc_feature (3978)..(3978): n is a, c, g, or t
  misc_feature (3983)..(3983): n is a, c, g, or t
cgagaatgttcctagagggtctgcgcagctagagagagctcaccaagagaagttggcgcaaagtagctagccagagcctggggactgtgttaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccgctgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgctgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtggggaacccaaaggggggggggggggtttttnaaaccccccccctttttggggggggnccccnttttttt

SEQ ID NO: 220229 - DNA, 561 bp, Homo sapiens
gcggccgcgcggagcggggagccgccagcctgcgccccgtccgcgggtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccgctgtgctcgaccgaggcacctccaccaccaccgtgttcaacctccccggctccccgataaca

SEQ ID NO: 220230 - DNA, 5131 bp, Homo sapiens
gcggccgcgcggagcggggagccgccagcctgcgccccgtccgcgggtctatgggaagttcggggacttgacagccgctgccgccgcagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccgctgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgctgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaa

SEQ ID NO: 220231 - DNA, 4730 bp, Homo sapiens
acaagaggtccaagatcaaacccgatgaagacctccccagcccaggggctcgggggcagcaggaacagcccgaaggaacaacccttgtcaaggaggaaggggacaaagatgaaagcaaacaggagcctgaagccatctatgagacaaactgccactgggaaggctgcgcgagggagttcggcacccaagagcagcttgtgcacgacttccgccttatctagtagccctacgtatccggacctgcccttcattaggatctccccacaccggaaccccgctgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgctgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaa

SEQ ID NO: 220232 - DNA, 2470 bp, Homo sapiens
  misc_feature (2408)..(2409): n is a, c, g, or t
  misc_feature (2438)..(2438): n is a, c, g, or t
  misc_feature (2469)..(2469): n is a, c, g, or t
cgagaatgttcctagagggtctgcgcagctagagagagctcaccaagagaagttggcgcaaagtagctagccagagcctggggactgtgttaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccgctgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatgggcaccacanntccaacaaacaccttgcaacttgggggtnggggcccattgaacccttctcccccggggcna

SEQ ID NO: 220233 - DNA, 499 bp, Homo sapiens
agacagtgggaatgccacatcttactttatagtgataagaccctgtttacatagtgagatgctgcacaaacatgcattccaaagtaatcctccatttttgaaacttgggaaatctgaaaaggggacaggtcatgtggcacctgcaggtcccacagtccccgtctttaacctatgatatctgaggacctattaaaagctttaaggtcgtctgggcatggtggctcatgcctgtaatcccagcacttttgggaggccgaggcaggtggatcacctgaggttgggagttcgagacccgcctgaccaatgtggagaaaccctgtctctactaaaaacacaaaattagccaggcgtggtggcacatgcctgtaatcctagctactcaggaggctgaggcaggagaatcgcttgaaccctggaggcggaggttgcagtgaaccaagatcatgccattgcactccagcctgggtaacaagagtgaaactccatctcaaaaaaaaaa

SEQ ID NO: 220234 - DNA, 196 bp, Homo sapiens
ttccaggtaataggtagataaggacaaaaggttgcattcttttgagtttctgataagcctttccaaaggaggagatatgcatttatctcagtgagcagaaggatgactttgagttctgtctgtcctttgtccacaaggaaattccttgtgagggaggtatgtaacatttttatctttacagctatcatttctagga

SEQ ID NO: 220235 - DNA, 428 bp, Homo sapiens
aagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgta

SEQ ID NO: 220236 - DNA, 533 bp, Homo sapiens
agctatcttacaattgaggaaactgacagagcttagggtacacagctggtaactgctagggcctcagtttaaatttgtgtccagattccatgttctttccactgaactgtactccctctattactgaaaatacgtcttgtttgggatattagttcccaaacaccaatttgagaaacctctccctggtccacaggaaaatgagagaaattagagcaatgtgattgttttttcataaatctaactgtactcattttaaaggatcatggagattattgctgttttagatgtttaaaatactgtctttccacacttgtaaaaaatgtagagtcagtttttttaaaatgacttttaaaagcctaatcaggcaaaacaggttgagaacttgttattgagctgtcttaattgatttaaacgttttatatggaaataatttcaaatttacagaaaatttgcaagcataagaatagtgcaaagaacatctgtatgtcctttaaaattcaactattattcagattttaccctcttaacatttt

SEQ ID NO: 220237 - DNA, 681 bp, Homo sapiens
gggtcaaggaaatcacctcatcactcttctttgatgggcagattcctatctcttagtttaccattttccttactaattccctcagctccatccaatgtgcattcttgtgtcaaattgcatgttcatgagtatattacatgttcctgttgtgagtatgcaggggttaccatgggatgacccctgtgctatgaacttggaacctcaagaaattagattgccttttaagaatgaatcagagaagaaatacaggaaaccactttaaataacaaatgtgttcctaggatagcaagatttgactggaccctgactgacgagattactatacctaaagaaagaacgcattcgtgagaaggagagttctgctcagttatgaacaaagcaactgcattcaataaatatttgttgagtacctactgtgttccagcagagagctcacattctagctggggagacagaaaacaaataagtgcatttataattggatgtctgcttgtgatatgtgtgtatcccaggcagagggtccacagaacaaacaacagcatctagtgtggctcggagatgtgctcactcaagttctatgccagatttgagaagcctgcttgactctaacatcccaaatctgcatttccagcacttgggtgacattttgacctacctaatttctctcggaccaatttctcc

SEQ ID NO: 220238 - DNA, 470 bp, Homo sapiens
tgagatgaggtctcattatgttgcccaggctggtctcgaactcctgggctcaagggatctgcccaccttggcctcccaaactgttagggtcataagcatgaggcaccatgcccagcacttaacacgatttgaaataagaatcactcaaagcatttgctgcctactgtggactccccagcctgggctgtaagctctggaggcagggatgatacctgtcttgctcaccacgacacccctacacctaacacaatgcctggactatagcttcaagtgagtagaaacttacccagcaaataaatgaaattaagacaaccctagctttctctactttgcgtgtattcccctcaattcatcacttccttatttttccttaagaggaaggcaggaagtctgagccccaacaatgtctctcaaacccacaccaccctggggggccaccccaacaggacgaggtggacgtgtcaacagtg

SEQ ID NO: 220239 - DNA, 445 bp, Homo sapiens
atcaattgtcaattagaatgtgctaatcatcggcattggaacaacagggaaactaaacgtgggggcagggtataagggctcttaaataaatgcatatctaagcaccaataaataatttttacagataccttgcataaaatcagcatttcagtttttttaaatttactattaaaaatgcctgtatagaaaatcagattattttgtgatctcttaaatggcagcaagttaattaaaagttcagtgtattcaattgtcatctttttggaagagattggatttttaattaataaattaacacattaaatataacttttcttaatataaattgttaaaataaattaaaatttaaaatatggtattgtttctcctatgctgatgtaaattttcttaatataaattgttaaaataaattaataaaaatttaaagtatggtattgtttctcct

SEQ ID NO: 220240 - DNA, 406 bp, Homo sapiens
tttcagaaagtaaaggttgatagaatccactggtcttgaggagcagactttgcagaagagagtcttatgaatgagggagaaggggatactgaactttacaggatttctaggctcacagggacactcccctagagatgaacaaggctgactggaggtgatgttaaaacccagctaagaaggcagccacagacctctggcctctcacctgtggctggcccagaagttctcagcccgtgttccacaagagccttgaagacctgaatgaaggacatgaagtcagggccccactatattctcctttctgcagggccctcaacatagctgtgactttatcctcttctctcaccaccaagaaggcccattaagatgtgaatgagtggaagttttattaaaggatgagctttga

SEQ ID NO: 220241 - DNA, 388 bp, Homo sapiens
aaatacgtgctagtttcacttgagaatgtccttcatgaagcagtatagaatattaattttattaacctcacactttgggtaccaatctttttaatattctgtgtgacaaagcaggaagtacgtgtaaagcactttgactgcataccgaaatacagcaattgcctcaaggaaaagcactcgtgcagtgctttgagtaggagttgaaactagctgctttttttaagggattccatttttacctgaaagaatgacatattgacaaactacgtgttcagacttgagtgtttggctgatgtcttctcaaaaataaaccaagcgagagtctatcacttcacagaaaacaacagacagtatttgttgccaatggtaaaatttgagctttcaagca

SEQ ID NO: 220242 - DNA, 446 bp, Homo sapiens
ttttgatattatgatacatttattgggatgtaaccccatcctatgttgtggagtacatatatgtatatattggttctatttctctggaggaccctaacaagtacagactgagagagcggctttgtcaaggtccagaagccaagaaaagcaaattgatggagtgagtatagaaattgaaagcataggtgttgcatgcagctcggcctgtgttagaacccggctctgtcatttaatctctctgagtcttaatttactcctttgtaaaatggaaaaaataatagtgcctgaaccaaagggtaatgttaggatagtgcctgactcttggcaagtgcttgatgaatgatcaatattattattactattgttgttattattactaagtcttcctaagaagagtcatgggctctcagagaacctttgctttcttctcctacttacttgaaatt

SEQ ID NO: 220243 - DNA, 449 bp, Homo sapiens
tgaattggaaccatgaaaccagcagcacagagaacctgggaatcagagctgtcagggcctggtgttgatccgagagccctggtcctgtgccagcggagccattgggcgatactgggagagctgtcatgagcagcatggcatcagcagggacacctgggcttgttctcggcttccttaccctgtgatgacgtcccaggcaaagttgcacagccgaaggttccccatgaactgacttctgcctgtcagatgctatgtggggacaggtctgatttaggagcaaaggtggaggtcagacagagctgggtcctggccctgcccctgacaggggcaaagtctcctcactctgggtctaggacttagggtaagggctgttccaagggcagaagtcaggcttaaagtgcacagccagcgttgtggtacttaggtttgttgctggtgttaggattgct

SEQ ID NO: 220244 - DNA, 309 bp, Homo sapiens
tggatagaggctgctttacacctctgaggcctcaagcaggattcaccatgatgtcatctgcatccctccaaagtcacctgcttttgtcttattgcataacttgtttcaaatgttctgccacaacctcccccagcccagacatattcatgatgttcttttatgattagtcagtcaccacgggtagaatgtgtgttccagtgccacatcagggatgacttatgcaaacccaagatggccctttggcttagtccttcttcgcccagtgtaagagtctgtcttgtgcctggacactgaagactgggggagggc

SEQ ID NO: 220245 - DNA, 489 bp, Homo sapiens
ggcgctcgcctccgctccaggccagaagccgcagcccgcgcgccaggcacagctcccccgaccggtctcaggagttcggccacctccccggggaagagtgggactcagccaggcgccgggccggcctctaggagcctgcgccagagcaaagggcatccggcacccgacccgggccaggcccttggactagggcggcacggaacctagcgcctgggcaggtccaaccctgcgcactgcccctcagcctcgtgaacccttcgcctccacgacccccggaacccatcccagcaagtgcggcagtgacctcgggtctcaccgcccgggggccaaacacctcggccaccccggggccccagaagggccgagggtcagccgagcggacgaaccacattcccaaggacaagcagcgggtggcagcaccgcccccgcccgagcgccctcgggtccctttctgccggggctccagtggcttgagtgtcccgacccctc

SEQ ID NO: 220246 - DNA, 528 bp, Homo sapiens
actgctatcaggttaaaattattggatcccagttgtgcatgttcattaatgacttctcttatttatgtctcactgtaattttgtccttttttattcaacttttgatatacttcttagagttaattcttattcctagaataaccccttcttgttgtgttgatatctgtcactgaatttccccatattatttaataataatctgttttatcttattctgcaactagacagttaatttccttagtgtgcctctcgtcttctttatcaatgtatgcccagtgcctgtagtgtagataatttgtgttgagctttaaagttcataaaattattttcttttcttcatttgttccctaccaaaattcttttagagtaaatataattcctattttatagatggagaaatgagttttaagtggcttgcccatggcagttagtaactaagagataagttctgttttgttttgtttttttcctttaaggtttattgagttataatctacaaagaataaaattaaccttttttagcagaca

SEQ ID NO: 220247 - DNA, 490 bp, Homo sapiens
tcgtcactcgctgactcacccagagcaacatatcctgcaagctccattcatcacaactgccttatacagttgtaccattttttatttttgataccatattttttactgtactttttctatgtttcaatacgtttagataaaaatacctacctttatgttacaattacctacagtattcatcatagtaattggccacaccatatagcctagatgtgtagtaggctataccatctaggtttgtctatgtatactctgatgttcacacaaccatgattatctcctaatgacgcatttctgaatgtatccccatcataaaatgacacgtgactttattctgaagggagaacagacaattttttgcagagagaattcagatacgtggtatgagagaaagatgagtcaagaactgcaagcttttaagctaggtaactggaaagacagaattgcatttcggaaaagactaagatgcagctttgaggtaatctgaggg

SEQ ID NO: 220248 - DNA, 583 bp, Homo sapiens
accaatttgatttcattcttcccccttttcttggacggaatgaggtattagtatgtttcatacaacacattaaagacaatagtgtcaccaaggttggtgacaggttgaaaaatcatgacttatacacagataaaaagtaaatgtttaaaattaaacttcagtaacagaaactacggataatgttgcactgcattcatttccttcacttcttgtcatacaagaggttatacaaacttatttgtttaggataaaattcagtgagataatataaatcatcacaggaaatgaaacatgttataaatacgtggtctctggttctctgttctatctctagcacctggaaccatgtctagcataattggcactccataaatatttattaaatgaatgagataaatgaatgaatgagtgaaatcaacatttcttaaatttcagaaaaaatttcacctaccttggagactacatcaaaatatttcttttcacccataccaaacatcacaatcatttcactgaataactatctctgaaacaagttcacagagacattgtgtgaaatcaagtgtaattttttaggccatgaatc

SEQ ID NO: 220249 - DNA, 682 bp, Homo sapiens
gatgctgggtttgagtttggtagtcatagttttaagggcgaaggaacctaaggtagctggggcaatttccaggaaagaaaacttggacccaacctctggagactaaggggttcagggggaactttgatggggagtgcacatctgacttggaggtattgaggatgtcgattttctcccagttttgctacttcctcccagccagacgctgacaaaaaaatccccagacgtttcagttaggagggcctcccagatgtgaggttttgggggtggagtatttgagtttggtagactacctctttgccttcagagtttcttcttttctttcttccccatcacacagctagcctattacctcatattttgggggtgcagggagcaggtagacaaacttgctaaggattgggttgttaccagggcctaagaatggctggatggggccgggcgtggtggctcatgcctgtaatcccagcactttgggaggccgaggtgggtgtatcacctgaggtcaggaattcaagaccagcctggccaacatggtgaaaccccgtctctactaaaaatacaaaaattagccgggcgtcgtggcacatgcctgtaatcccagctgcttgggcggctgaggcaggagaatcgcttgaacccagaaggcggaggttgcagtgagccaagattgcgccattgc

SEQ ID NO: 220250 - DNA, 405 bp, Homo sapiens
tctgcattttgaacacactttaagtaattattatgcagattgaagtgtgagagctgctgatttagaaactgcagttatcaagtaggattatttttttcttttaacaggtagttcatattgcatttttacagttaatatttctgtatattttaggaaaacgtgctctttgtatttaagcagggatgattcagacacatgtagattgctattttgtctcaaaatggtgtatgtacagtgtataaaaatatgatatttattacgttgggctagtcattttatttgtgtgtcaaattttatgatccttgtgactactttttagccagaacagattatcaccaaaataaatttctccaattagttaccttggatttatagaaatataaataaatgttggaatattcttct

SEQ ID NO: 220251 - DNA, 597 bp, Homo sapiens
  misc_feature (589)..(589): n is a, c, g, or t
tccactgctgagtgaatttcttcatatttgatgtggtaccaatggttccatgcgttcactgttaactcaataaatcttcacaatgcactttcagaaagtgaggaccaaagaagagaaagaagacaacttacccaaggcttcgcagtgccagaaacagtctaactccaaagactatgctctttcattacaccatgctgttttgtacttacaggacactttttttttgagacaggttctcacttggtcgtccaggctggagagcagtggtacaatcacaactcactgcggcctcgaactcctgggctcaggtgattctcccaccttagcctcccaggtagctgggaccacaggcatgtgtcactacacccagctatattttgtattttttgtcgagacggattttcatcatgtggcccaggctggtctcgaactcctggactcaagcaatcctcctgcctcggcctctcaaagtgcttggaattacaggcatgagacactgctcctggccgataactattcttattgctataaatctggtaaagaatatgactaatttgtcatctaaaaagccaaaaaaatattagacagnctttaatt

SEQ ID NO: 220252 - DNA, 217 bp, Homo sapiens
tccagggaggttttctttatagaatttacaaggtctgtgttactatattttcctggttttcttcctaccattcttggcctctcttaattttcttctgggccactttcacattttgttctccagcctttcttattttccacactgtttcttgggtggtctccactttcatggctgaacttaccaggtatgtgctaatgatgctcatacctacttctaa

SEQ ID NO: 220253 - DNA, 504 bp, Homo sapiens
actatggaattggacacagcaagtctaaaagatcttactaggctgggcacggtggctcacgcctataatcccagcactttgggaagctgaggcgggtggatcacctgaggtcatgagtttgagaccagcctggccaatatggtgaaaccccatctctacctaaaatacaaaaattacctgcgcatggtgacacacgcctgtaattccagctattgaggaagctaaggcaggagaataggttgaacctgggaggcggaggttgcagtgagctgagattgcgccactgcactccagcctgggccacagagtgagactccaactccataaacaaaacaataaaataaaataaaataaaataaaataaaagattgtattaaaccatgttctagccaatacctggccatgggagaaagacaactggaagttattggaaactttgcttcctaatacaaaaatgtattcaaattctcttgctttagttttctctttaatttacataatagg

SEQ ID NO: 220254 - DNA, 277 bp, Homo sapiens
gaaagatggctgcaccattttccatgaactattaggataggctggtgagaaacagggaaatacttccaatgactacggattagcagatttccttcctgctgagctgccagatctgtaagttgcaatgtaagaccagcctaaccaaaaacaaaataaaataaccctacaaattattttggagtggcaacattatattagggatttctttctttttttttttttttttttctgagatggagttttgctcttgttccccatggagttttgctcttgttcc

SEQ ID NO: 220255 - DNA, 415 bp, Homo sapiens
cggtgggatattgatgcagtgatgctgatgatggtggtgatggtgatgatggtggtgatggatgcaacaactgcattcagcagtttacttcctgtggccaaatggctgagctttgcggaacacctgccttgttccagcaggtgttgtgcttatcttatctcctcctcagcccaagcccacaatgcaggcacaatcatccacattttacaaatgaggacactgaggtgtagagtcgtgagtgaccctttctgaggaccctccttgggaagaggcagaggcgggactcggacccaggctgggggctctggtgccctcagtagatgtctaggccaatcctttgcctctcaagctttcctggagtcatgatgtgcctgtgcagggtggacagcggccactaaggagactatctctggtc

SEQ ID NO: 220256 - DNA, 457 bp, Homo sapiens
atgatgctgatgatggtggtgatgttgatgaaggcagtgatgctgttgatggcggtgatactgatgatggcggtgatgctgatgatggcggtgggatattgataacagcagtgatgctgatgatggcagtgatactgatgatagcagtgatgctgatgatggcggtgatgctgatgatggtgatgatggcagtgatattgatgatggtggtgatgctgctgatggctgtgatgctgctgatggctgtgatgctgttgatggtggtgatgttgatggcggtgatgctgtttatggcagtgatgctgttgatggtggtgggatattgataacagcagtgatgctgatgatggtggtgatgctgttgatggcagtgatgctgttgatggcaatgatactgatgatggtggtgatgctgatgatggtgatgatgctgatgatggtggtgatgttgatgaag

SEQ ID NO: 220257 - DNA, 278 bp, Homo sapiens
aaatttaattgattcaaaagaaatacagtaagtgagcgatagccataaaaatacattaggataaaattacataagtaaaataatatacatatgtgttcatgaataaaaagaggaataatacaaaaatgtttaaatggataatggtggatatcaaaccaacatggcatttagatcccgttacacacttttaaaagcataatgtaatcattttattttaaatgtcagtgtttagaattcaatggaaatgatgtctttcagaacaaattaaacttatgatg

SEQ ID NO: 220258 - DNA, 455 bp, Homo sapiens
acgaggggagctcagaaccctacttcctgagtgtgggatgtgcgcagctatgtggttccgaagagttcaagacgaaaagagggagaaagagtaacttcccagcagaggacctgacgacctgagccaggcaatcgaggtcagcaccgatggcgaccaggcgtgtagactcgtgccctgggtaaggcgtgaccgggatggcactttacctctgtagtcctcctccccaagcacatcctccccactccaatcatgagaaggacgtcagagttccaacagaggcttccagtatacctgaccagtagccctcaaaactgtcaaagtcatcaaaaataagggagctctgagaagctgtcacagccaagaggagctgaaggagacaggatgactgaatcctagaacagaagaatatattaggcaaaaactgtggaaacctgaataaactgtgcatagttaat

SEQ ID NO: 220259 - DNA, 250 bp, Homo sapiens
atgagcctccatgcccagcaaaaaaaaatgcattttttttttccatagagatagggtcttgctaccttgcccaagacagacctcaaactcctggccccaagggatcctgccaccccaagtgatcctgctgccttggtctctcaaagcactactgtgcctggcctattttctttataataatgctaggaataaggaactaaaaaataaaagacatagaaaatgttctagtagattctggcctccctggaaa

SEQ ID NO: 220260 - DNA, 451 bp, Homo sapiens
cccactattacttcaaaattaatcaggtttaaattttagatcagaatcattgcccactgttttcatttagaaattgtccaaaagaccatagatacattctggtgattccttacattttacagttcctacgttagcctctcaaggccacaagttgccgccacgtcttcactgaatggctttctcagtgctgaataccaacagccgtattacagtatcaaggattctgtcaggtagggtttacagaccagactgttcatgcagcaaggtgctaactcaggcgtcaacgttctacttgtattttctgaccaacttgcagaagtgagcaatcttcttaaaatgccatttctgttggcagggaagaatgaaacggcacacatcctagcattctaagaacacctggtttaaataaaatccagtgatgatgggctctttcacattgtttaaggggaaa

SEQ ID NO: 220261 - DNA, 738 bp, Homo sapiens
aactcctgaccacttattcactggtcaactcaagcaaataatatttgtgtttgtccaattaacaaagagcaaaaaggggtggtaaaatacatcctgagccttaggcatcaggagaagtttgcacgtggaactgctgttctcaacgttgcttgctacggtagattgcagaaatggtggctgttttcctcgctgctgctaggcttgacatttttcagctcttaccatcaaaaggtagagtcttatttttctacctcttgcatgcagcaggccttctgattgtgttggccagtaggatgagttagaagtggcattgtggaagtcatttctgagctcagacctcaggaggtttctgcacacttctgtctttctcttggaaccttccacgttaccatgtgaacaagcatgggtgaaagtatgaaatatgagaaattaccagggaggtcttcccagtgaaggccattcttgaccaacgagacccaactaacctggtagttgggacagatgtgtgatcccagcagaacccagaattatgagctaaatcgatggctattgttttaacccaaccaagtttggggatgatttgttacgtaacagctgactgatacccttcatgttacacaagttcgtgagtaacaaaaaagtagattgtcactaagtatttttgaagagataaacacatccttttaatttatcttttattgagacatcttatttttttctttacctgagaatcgagct

SEQ ID NO: 220262 - DNA, 816 bp, Homo sapiens
cgtccggggcaagtccgagagcggggagggcgtttcctggggtaactccacctggggtcttgtcgaagttgccgcatctccgccggaccgcacgggaacgacgtgcccacactcggaggaaggggttggcgctgagcgagtttaaagggttccttttgaaagcaggaagtttgaagtgacgttgcatcagcaacagagcatgcagtttcaggtgctctcgggacagctttcagtttctcagaacaagtctaagcctcaccgcagtaataacttttattagaggacaaaaaatccgccaaagtaaaccctttctgtccaacccctaaaaacctttggataaacgtttacaagaaacggatcacagccttatttgtttttctaaactgagcataaactcttttgaagactcagcgttactgtcaaaatgaatgagtgcctgcctagttatgattcaattatcgaggtgtttgggtctctgcagtacactcagtgactcccaggcttttcttttttctctttgaaattgcttattagaaggctttatctaatttctcacagttgtgtgtctttttgaggtagttctaataaactttaaaggcttctggtttgctgcaggcctgccgtcgctgtggaaagcaagtattctttcaaagaagaatagaagtgcattggtttctaaataatcccaggacgctaggatcagcatcacttgggaacttcttggaaatgcacattttggggtcttatcccaaacttactgaatcagaaatatattttaacaagccttccagttgataccaatgcacctggacgcta

SEQ ID NO: 220263 - DNA, 449 bp, Homo sapiens
agagaaccaagtaattatttatgacagtggaaatataaatagaaccacagttcatgacttaggtaataacccatccccagctatggacataagtctagataacatttctatttaggagactggtatcattgtggcacataccagagtcaccctgccagtctcaggagcagatcagtggaacagatgatggttatttttaggcataggtttatactgataaaccactaaatggcacacccttaaaagctatttcagtttagtaaccagggccagaaaataatgttcctatagcaacaaaaatagttgtagaattcatccaccagaaatatggcccagcttcactgataagtgactggatgttgctatatcctcagaaattgctgcacgtaagttaaagagtaggaagttggaggatatgacagaatacagcttgggcttggactttgtcc

SEQ ID NO: 220264 - DNA, 1087 bp, Homo sapiens
  misc_feature (1049)..(1049): n is a, c, g, or t
agcaagcacggaaatttcaggtgtaaaagggctctggcccagaacctaagagatctggctccagatcttggatctgcctctgacttacttgatcaatttggcagtgtcatcaggccaggcaccgtggctcacgcctgtaatcccagcattttgggaggctgaggtggatggatcacctgaggtcaggagttcgagaccagccttgccaacatggtgaaaccccgactctactaaaaatacaaaaattagctggacgtggtggcacgcgcctgtaatcccagctactcgggaggctgaggcaggagaatcgcttgaacccagaaggcagaggttgcagtgagctgagatcgtgccactgcactccagcctaagcgacagagtgagactttctgtcaaaaaagaaaaaaaaatggcagtgttgcttaactgtagtttcagttacctcacatttttaaaaaagggggtggggtgaagaagagctatgagacaatctccacaattcccagatcccaaggatcatgaggaggtgcatggactgactccttcaagtcatcaaagttccacgaagccgtggtagctgctcagagtgtcagccaaggaagtcaccttcttgtgaggagcaattacagcagagtacagaatctggaaaagggtttggatatcaataccaatccaatgcccctagtttatagatcaggccactgaagcccagaggggtgaaatgatttgcttttgccactaagtagccactaactttggccaggcaggaaaccagatctcctaactcccctccagtgctcttgctgttagctcactgcctctcattgaagtcagtacacacaaacatacaaatcacacacatatacattccaagaacctcgcaatggaaaatcattttagagcaggggaagtttgggtttctctaatgtgccctcgtgccgaattcggcacgaggggctgcttcccaactccacctccagaatcaaggatattcctccaagcccagctcgaatgcttgatctgcctggagccttcctggtcatccttgngtgacctggagctggtgctgttagagcacttctgctct

SEQ ID NO: 220265 - DNA, 409 bp, Homo sapiens
tcacattgcagctactccctcccacaccattggcagacagttctaaccaatcaagcatccttcccttctgaacccagatataagccttttcaatagcagtctacactgggctaccaatgactggagtattcatatggcacaaaaccagtagaactttgatctattagtagagaatcactacacattttcgtatttcaaatactgtatgcttctcatagttaatgtgtacattcattgttattttatttttatttttactctccttccgcaaaagccgctattacaatcaatggcctattggagtcgatattcatccaccttgtttactcaggactcctgccatcaccagctcaccccacacgcatgcctattgcttgccttggctcactcatgcttgcttcccagatcc

SEQ ID NO: 220266 - DNA, 485 bp, Homo sapiens
gccaggcgtggtggcaggcacctgtaatcccagctactcgggagtctgaggcggggaattgcctgaacccaggaggcagaggttgcagtgaactgagatcgtgccactgcactccagcctgcatgagagagtaagtctctgtctcaaaaaaaaaaaaaaaaaaaaaaactaccaatatgaaattatcatggtcacactatcacacgtaactttgaaggtttgatgacccataacttcatagatctgtgtggatcccaggtgatttttgaggaatatcattggccttctttcaggactgtggccttctacgtgggaatcttccctgattgggcctgtaattttcataggaaaatgtctatttctattctcagcacagctaacttagtaaagcctatgagtttccccccactcaaccaagcaataacaccttcgcataccctcttacctcactgccacttaaaactcaaaggagaaacttgttattg

SEQ ID NO: 220267 - DNA, 471 bp, Homo sapiens
tcagttgctattaattttcattttatcaaacacagactgctataagattaaggtggattatctcagagtgtttcaaactctaataaatctgggtgagtattttggcctcattggacaaaaagtttcttcatttgtatttcaagtaaaatggagggttttgtattctgtctaccagaagaaaagctctagcctgggaacaattcctcacatgctcaaccaaatttctcatctcaaatctgttcctactcaattcttacatttccaggcagtgaatccaacttatagatcaccccaagtctgtttttgcactttcttaaaaagggtggaaggggtagatggaagagataaaatgcgaggctttgctgttagaccttccatttattcaacacattttagccaagtctcacttggatctgggcacagaactagatgttgggaagggggcagcaatggagaaggcctcagaaatca

SEQ ID NO: 220268 - DNA, 640 bp, Homo sapiens
tagggagtactcagtggcaagtccggtattgaagttgggcctgtctaactacaaagcttgtactgtgtgactcaatcaagctggcctctggtgagcacatgtgggaggccggctccttgcaaactgccctgtccatgtgttactgaggacaactgtaaacccaagtacatgtctcctaagccatctcctgactttacagagaaatgactgcagcccagagaggggaggtgacttggtataggccacatagccagggaacccccagggaatcaaacagaaatgagacctggaattactttgtactgggggctgcagctcaggaccactgaagtgacagtgcattttctaccactgttgtcaatcactctgttgagcgttctttgcagcccacagatgtccaagggttgccaggggcatagagccctgccttgggtgggaccaggcccacgcggggtgtcggcctaatccaaggagggagttccctgccttggtaagttggtgcaagacccggagctcttatgcatacacccaacaggtggtgatcccccgagtccagcccacccgcccagcagtgcgcaggcagccaggggttcaaggacccacccacatccgtgcctgacaagtctcccctccacccgac

SEQ ID NO: 220269 - DNA, 714 bp, Homo sapiens
gactacaggtgcccgccaccacgcccagctaattttttgtatttttagtagagatggggtttcaccatgtagccaggatggtctcgatctcctgaccttgtgatccgcccacctcggcctccccaagtgctgggattacaggcgtgagccacggcgcccagccttcacatttcatttcttgtacatcgttttgttttcccaggtgttaatgattatccctttttttcacttaattattaatgttatgagttagtaaacacctgcctgtactctgccactttttttgtaaataaagttttgttgtaacacagccatgctcattcattgatagattgttttatgcctgctttcacactagagcagagttaaatagttatgatagagacagatggcttgcaaagctgaaaatacttagcctgaaatattttctagctgactttttgtagtttgctgactcctgatctgtgtacctgttggtagttcatcagtagactatctattagaagtataaatcacttctccctaccttcaaggactttgtataatcttatgagtttccctttttttctcctcttgttaattaatatccctgttgttacccttcattcttcttttccgatttggattagtagttctgtagtcctgtttcacagtagtcatcttggggattctctttgcttttcccttcttgttggatccctcatttctcatttc

SEQ ID NO: 220270 - DNA, 752 bp, Homo sapiens
cttaaaaaacagcaatgaccctcccaatccctccgctataaaaggtgttttgaacttctataagttttgccatcaggtgtgtatttcatattgttttctggtatccatacctaaattccttctgaaggactatcttcctttacgtgctaagtctatgagcttctcagtggaactgacacttccagtatgtaaatctctagcctaactcatcagagtatagcatcccactcaccaaaataattgattcaggtgactctatgagagtcaatgaaactttgctgggacatctatagaagagaatctccttcttttctgttggacttaagcctgtgaacctccaccagccacattaccaccacagagcataataccatgcaagaatagacccatgcacagatgaagcagagagacaaagagagaaaatgggtcttggagtcatcatttgaaccccaatctagacatatctatagccagctgttcccttggacttttcaattatggaaactgttaaatgctgtttttacttaagccctttgattatttgatcacttggaaaagatgttatcctacctaatactcataaaagcatcgtttagcatggtgcattgagcccttgaggatgtagcttctgcaaacttttacagtcacatcttcaaaagtcacccacgtgtaactattatccaagaatatgcagataactgcaattctagggtactttgccctagggtgcctcaccttttcaggttcagctc

SEQ ID NO: 220271 - DNA, 596 bp, Homo sapiens
aggcggaagcacagtcgctctgaggtcgcccgtggccgcaggtgcctcagcccagccgcgcgccttggcccttggccgcctactcctaccgccccggccttgggcggccctgggcctgctgcgggcgcggcgctgcccgaccagagcttcctgtggaacgtcttccagagctgccacctggcaccgccccggacgatcctcctcgtcctcgactcgcaggtcgctcctgacggttcttttgactgaaggatgcgaaggaagatgactgtggaccaggatccgtatatcagggaattaggatcgatatggacttgaagccactttgatccctgatttatcgatttgagtgtgtatgtctcttcccagctatctctgagtaagctttctcatcctgaagattacgggggactcaatatgtaccagccccgagagcaagtggaagcatgcatgagttatgtatggaggcaaatacaataacaactgcaagtctgggaaaaggtctctagacactaaaacatggcaatgccaagtcagtgatatgtaggtcaggaaatgctcactgctacctctagtgcagtaagactgacctggataca

SEQ ID NO: 220272 - DNA, 397 bp, Homo sapiens
aggcggaagcacagtcgctctgaggtcgcccgtggccgcaggtgcctcagcccagccgcgcgccttggcccttggccgcctactcctaccgccccggccttgggcggccctgggcctgctgcgggcgcggcgctgcccgaccagagcttcctgtggaacgtcttccagagctgccacctggcaccgccccggcacctcccgcctcccccgcagctgccccggacccgtgtcccgacccccgcggccaaccccgttccctgccggttgccccgcggcctcccccgtcacctgccgggtccccagcggcctcccccgtcccctgccccgacctccgccgtctcccccgcccctgcccggacccccgcgggcgcccccgaaccctaccccgaccgacgcg

SEQ ID NO: 220273 - DNA, 344 bp, Homo sapiens
taaaagaagttctgagctccttggagaatgtttataaaataagacctgtgctcaatgatcaagtaaaatggaaatttgacattttttaaagtgttaaacacctttaatgtaatttgacttactgcagaaacccataacagggaatttttaattcaaaatatatgctaattataattttgttaaactttcatttatgcatattagagctacattatttataaatatatattaaatttatattatattagatgcttattcttcttgtttgaataaatatatcactttaaatcatgccatccagtttttattcagcagtatatttgaggaatataagtttttagctg

SEQ ID NO: 220274 - DNA, 380 bp, Homo sapiens
tggggaaagaggaagtggggagggagtgctcccacacaccactggtgagcatggagactggcacggctccagaagcaacttgcccacgtgtaggaaaaccagacactcctcagaacccaaactaactacaaccctttttaaggcactgattcttttttaggacaatatctttacttaaagaatagtacagaacataggccaggattaatgtagaaaatatcttaatacttatcacagtgaaacacaaggaaaaattaaatgtccaacagcaggggaggttttgctcatctcttgaactgaatattatatagccattcaaatgatgttctcaagaaatctatttcaaaaaattaataaaattggaaaagatgtatatagaa

SEQ ID NO: 220275 - DNA, 233 bp, Homo sapiens
aagcttggaggtgggaatgatcagggcaatttgggggctagcccagcttagttggagaattcatactgaaatagtggagtgtaaacctggaaaggtattaggagccatttcattcagtacttcaacaaccagactatctggttagcctttataaccaaccaggaaactttataatgagtaaaggattaggttaagcagtttgttttgttttgttttgttttgagacagtcttg

SEQ ID NO: 220276 - DNA, 406 bp, Homo sapiens
gaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaa

SEQ ID NO: 220277 - DNA, 391 bp, Homo sapiens
tcctcactgacgtgtagcaaaaggaccactctgccaatcaccaacaggccttcatcttggtagaagtctggagatttattctctggagatgataaaagcaaggtgtttccaccaaaacgagaagtaagctaagacaagatccacgaagtaagagttgcaacaaaaaaagcaaggcaagaaccatcccaaagcctcagctgcgcggtcatcatcagagggggatctgttcagactggagcagagctgaaggcttcagggacacttcaagaggattaagtaattgcaaacctaataacaaccattgcctcttctatttattgagtgttcattgtgtgtcagacacagttctaagcatgtgtgtattaacgattaaatcctgatagtagcccta

SEQ ID NO: 220278 - DNA, 519 bp, Homo sapiens
ttatacataccgacatagttacacttctacaaaggcctttggtaaactgacagtaaatatgacttttagcttatgggattggcttacagcactatccgtcatttgtatgtctctttaccttggccactaagttctattttgcctactaactcttcccaaagcagtatagattcagataatataatgggcactcacacaacttttaactactattacttctagattccttaaattaggcctcggttttttggagagaagaaacctggagagcagggtacgtgatgtgattatttctctggtagattagtcctgagaccacagtgttctgacagtcactgggctcctcagtggaccgctggctataaggacttgggagctggagtaggagcagatggcagcaggtgattctccgttggaaacagggagtataaacattttctgcaagtctgctcaagagccctgcctcatttatcttgaatgcagtgtgtcttctaaggaaataaaataaatacagcctgg

SEQ ID NO: 220279 - DNA, 346 bp, Homo sapiens
atatccagcatggattatttgtaatggcaaagatgatactaagcctgttcacttgcacaataatacagtagggctgacctagtaatgcaccctctcccctaattttccttttatctggaagcagataaaaatgacactactgaaccagaggtgagcacaattgtcatcaattttctaaaaaacagaccttaatggtataggatggaatgaatggaagaatatctagctatagagaacaatatagggagatatctttattgttttgtactgatttttttgtttccctttaacatttttgttatataggtaatatatcttcagtgtagaaacaatgaaaatactgaga

SEQ ID NO: 220280 - DNA, 935 bp, Homo sapiens
ggcacgagggcggagtctgcggccgttcccgcggcctcctcctcctccccgttcccttcacccccaccccgcacccctttccccatcccggctccgtcaccctcccgtcccccacactcaggacaagaatgccctgcccggaacaacccagcagcgcctagatggctttggtcacggtccagcggtcacctacccccagcaccacctccagcccctgcgcctcggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattg

SEQ ID NO: 220281 - DNA, 917 bp, Homo sapiens
  misc_feature (4)..(7): n is a, c, g, or t
ggcnnnnggctccgcgcgacccggcgggcccgcctccgccgccgggtgcacgcgcagcctgcgcctcgtgccggagcagagcagaggccaggatgcggagttgtgcactttgagccggccccatgaccctgagcacgttggcccgcaagaggaaggcgcccctcgcttgcacctgcagcctcggtggccccgacatgattccttacttctccgccaacgcggtcatctcgcagaacgccatcaaccagctcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattg

SEQ ID NO: 220282 - DNA, 336 bp, Homo sapiens
aagaaaaagaaaggaaacttgtctagagtagacaggagcgtatgagtgagtaaccacagcctctcttgattatgtttttacttcgttccatgaagttgggactttggaatagagaagagagaatccaaaagtggttatccatcctactctttgatttcctttcctaagtaatttattttcttttgactttttccttgtagcatcagcgagagctttctaactgtcaaaggtgctgccctttttctaccacggggaaatggctcatccacaccaagaatcagccacagacggaacaagcatgcaggtaatgcttgcatatacaccatttctttcttg

SEQ ID NO: 220283 - DNA, 465 bp, Homo sapiens
ggcagtaaacaaaacaagtaagtaaaatatgtgctgtttgacaatagcaaggacaaggtctttgtggtcaagaatatgcccaggaaagtccctacagtgtacatgaaggggcagctggcccctgatggtgacaaagtggattgctcagtggcaaagctggatttaagcccaaggctgcaatgtatccacattcatccttcttgataaaagaaaactgcaactgaaagatccctccctgtcatgtcttctaagaaagtggcacttgattgagaccaaagtagtcagtggtctgaagatattcattaactgtcatggaggtatggaccaacccttcaaggcttctgtcttctgcacccagtgctgcatagggaatacactgttgagacaagtcttgtgttcactccatgttagacaccattataagcagttgacagatgtcaataaactttctatttccaacagtca

SEQ ID NO: 220284 - DNA, 471 bp, Homo sapiens
tgttgcccaggttggagtgcaatagcaccatctcagctcactgcaacctccgcctcccaggctcaagcaattctcctgcctcagcctcccgagtagctggaattacaggcatgcgccaccacgcccagctaattttttgtatttttagtagagacagggtttcactatgttggccaggctggtttcgaactccggacctcgggcaatccacctgcctcgacctcccaaagtgctgggattacaggagtgagccaccgtgcccagccacatatatttacaaaaagaatctaaaatcaataacctaataatgatcaacgtaacaataaaaaagtcttaaatccgtaacctaaactttaagaaactagaaataagagcaaactaaacccaaggcaagcataaggaaggcaataataaagaagagagtagaaatatatgaaataaagaatagaaaaacaatagagaaaatcaatg

SEQ ID NO: 220285 - DNA, 510 bp, Homo sapiens
ggaaggagacaaattgagatggctagtatggatgactcttctgagggtttttgccagaaatgggataaaaacatagggcagtagctggtggggggtggagaagtatcttgaaggtagaaaggccaagtatgtggatgcaggtcctgtggaaacttatttctgatgtattcatttttctcattaaaatacaaaataaatatcagttgcaggtatggacagggaaaaaggggttgcaggttttagtggggaggagcgatcacctaggagggggacatgagagaagggactggggggtgggttgtgactgccggggacatcacaggtccacttgaggttctcagtcatgaaagtaaaatgtgatcaggcagcatggttgtgttgaaatccaagttttaaaaaactctacagagaatcactgctcccagtcacagaactgatttacttggctgtgatctcccttcatttttaaatatcctttcattgatatataacatatagagaaaaatatgc

SEQ ID NO: 220286 - DNA, 252 bp, Homo sapiens
cactgtaagaatttgcaacagggcaaataattcacgcctcataggatgatgaaaagagctagcaagggtctgaattgagtgggctagaaagttggtaaacaggagccagaagttcagccagctagcgtctgtatctcagccttgtaataaagatcttgtaataataatgataattgggctgggcatgtggctcatgcctataatctcaacactttgagaggccgaggtgggaggattgcttgagcccaggag

SEQ ID NO: 220287 - DNA, 402 bp, Homo sapiens
tgtcatgagtaaaaagagccgttgtcttttctgatgggtatcatatcagggataataatttaaaccaggagagtcaagctgatgccataattaatctgaaaataagtcaatataataggtatgaaatataatttttagaagaaaaaccagattctgatggcaagattttagtttaaagatgtagctatgagtaaaattatacttgaccccttgaatttgttttttaaaaatttaaaccagttttagttggttttgtcagatattacaacaacaaaaaagctaatacaggcagtgaaactatttctgagggtgtgaagtcaactggaggtcaagtcttttttggtataaagggggtcagatcagaagcgggagatcaaatatattggtacatacttgttcaaa

SEQ ID NO: 220288 - DNA, 463 bp, Homo sapiens
gcccgaaaattcccgaggcataagggtgggggaggagagttgtgagtatagagttttgggtgaggtgaggagtctgtgggtaaggtgtttataacgtgtgtagtgtatttggagtgagggtgcatgctcccttttcccaccgttctgaagtcacagcttggcgtacctgggaatgcccttggcgtagtaatccctggcccttattttggatctgtcctttattcctttgttactttagaactggcttcgccggcgattgtcctgggtttcctctagtgtctgaggcttggaggagaagtcatgcacggcttctggggtccagtcctttggcctttgctggagattatttataccaacccagcccttttagctcccacttcagtatttttggatttatttattttcatcaaagagaaagttcctttgtctcggctgagttgatgaacgtctctatagcagcaaa

SEQ ID NO: 220289 - DNA, 282 bp, Homo sapiens
tgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaa

SEQ ID NO: 220290 - DNA, 427 bp, Homo sapiens
tttgctatagcgttctcatttcttttttcctgtggtaaataaattaccagaaagttgcctaaattttcttcattatcatccatctgacacaatgtgtgaaatttttattggtatgaagttacaacatcatctgtaatattagtataaaaattatctcaggtgttccatatgtgtctcattataaattattttatcaagcataaagttttgcagcagagggaacctgtcatacacagtgagaaactccactgggaagctcctatcacagtgtttgccaaaccaacacaatgttttccctcagcacctgggttttgccattgtatagtcatgcataaaaataccaggacagttgtatctggactgattcattaataaaaaatgttttaatgtagatatgactccattaaagtaatatacatgtctttta

SEQ ID NO: 220291 - DNA, 375 bp, Homo sapiens
tgccattaacttagggaatatgcaagaaggagcagatctgagaggcatgatattccaccctgtgacatgtgcttgtaggatatctaagttaacgtgtccagtagacatttgtatgttatgtctgggaggtaaggagtagaatctagtcttgagaaataaaactacttgaagtcatagtggcttcaatgagcatggagtgagaagacctccaaaagctaaggaagctgggcatggtggtgggtgcctgtagtcccagctactgggagactggaggcaggaggattgcttgagcccaggaatttgaggttgcattgtgcacagttgcgcctatgaatagccattgcattccagcctgggcaacatagacagtctcta

SEQ ID NO: 220292 - DNA, 396 bp, Homo sapiens
attactttgcttttgtcagcactttgcaaaaaggaaattaactttttgcaattaattagtgcaagttgcccacagtgatatagcttggtatgtttttctttagtctcagctctgcagcccacaatctaggagctgaactttaaggtgcttcatacctgtccctataggatctaactctggcagctttgggttgcctctgcttagaggcttggtgccagggatgagtggagagacctcttggcttgatgcctatcttggctaggcctagggcagactcatggtttagccttagcccttcctttcaaggtccttggctggggacttggccttgtgctcggtacaaaggtgcactgcaatgtgttttactagatgagtaagaagatactcctcccaccc

SEQ ID NO: 220293 - DNA, 451 bp, Homo sapiens
ctagtctttgaaattggaaggagtgtcaaatacacagaagccagagtcatcttggccagatggtgtttgatacagatggatggttagttgtcatgcagatctcctagttggtaacttgttgctgccatctgactcaaagaatcattcacacacactggctgtcaaaagcatcttcttttctgtctgttttagctgtcatgtctgtgctctgtacagaagtgttgacaagacattgctgttgtacattttcaatgtggttgttagtgagttttctgtttcgtggggtctttgatagtgctagaatgtacttgctttgtaattgtattttaaaaaaatactatgactgtgcaacaataatctgaccttgtaaaaggacttttctggttttaagtttaggcagatatgttctgtgaacaaaagcatttaatcaaatgaaaaaaaaaagactagt

SEQ ID NO: 220294 - DNA, 438 bp, Homo sapiens
agatgaggaaattaagccacagagagttaagtgacttgcccagggtcacccagttagtagagagtggaactgggattccatctcaggcagtcaggttccagagcccatggtttttaaccagtaagctctcatacataactgtttgtaatggttaacttttgaactgaagcttatatttgaattttccaaatgttaatgtgtgagtgagtaatttatttttccttgtgatttcattgtttagggggtctttactttctgaaaataattggcgtaagaacaagatcttgtaggatgaattgacctagaacatttcagagataatagtacatagttggggtggggagaaaaggctttatttgggtttaatcttgaaaaatgaaacaaaactatgaaaacattcatgttatggttgcaactatgtgttaaattattagaatg

SEQ ID NO: 220295 - DNA, 411 bp, Homo sapiens
agggagctttgacagcattccaaagcccaggccccagcccacagagacttggatttaactgctctggggtagggtctagacattagaatttttttaaagcttcctcggggattctaacacccagcctgggttaggaatcacagtgcagtgctcagcttcagtctccatgagaaccacctggagaccttcccaggcaccaccccagaggttctgattcagtagggaccgggactctgcaactgacaagctcccaggtgattccaatacagaaactgagttctggactgggcgcagtggctcatgcctataatcccagcactttgggaggccgaggcgggcagatcacctgaggtcaggagttcgagaccagcctagccaacatggcaaaaccctgtctctactaaaaataca

SEQ ID NO: 220296 - DNA, 623 bp, Homo sapiens
ttagtggtccaggctccttccatgttgtggcttgttcatctgtgagagcctctgagttctctgcttctacttggtgaaaggggaataagagagtagaaaaactcttcccactgcttaagatccctgactgtgaatcattctgtaccacttctgctcatgttcgattagtgagaactaatcacatggccccaccctgatgaaagaggtgctgggaaatgtagtcccatctgggcagctaccttctgctgacaactctacactgtggaagaggaagtaggaatatttgggggcaggtagccatctctgccatagtaccagcttgagtcgttgttccctttgcaggtgcccttggtacctgagcctccttttctgctggcttctgcttcttcagctggccatgtccagctccatgttccagaagattctgcctcttttactgtgcggagtgatgttcccctggggatctactagtgctctgctgagagactcacacccaggttctgatcagatacccacactgtgtacatttctcatattgcagtgtctgtcagtcagcttctgagaaatctgtgagagcagcattccatctcctatgattctgcaggtgatcaggaggccttctg

SEQ ID NO: 220297 - DNA, 403 bp, Homo sapiens
tgtcctaataaatggacttttcctacaactataatcatttttttgaagaaattgtgtgctaaagcagaatcacctgaaagtgtgattagttcaaaatccttatgcaggttctccttagcattgaaaatttgaactgtattaaagtgtcaattctaattgtaatgaaataccattctttgaccttctggatgtggatgtagctgtggagcacatggaatacacacagggaattgtattctgccctctcggtcacagatggatacattaagaagactcaaaagtgttctcttgggaaacctggtttcttgaccacaaagattctttctactgagcaacattccttttcagatctctatcctaggagatagagatcagtccaagcagggtcccctcatcatccatc

SEQ ID NO: 220298 - DNA, 340 bp, Homo sapiens
ttcatcatgtttcattttattctttttaatgtagctaatagaaaattgaaaattatatatgctttcattctctttctattggatggcactggactagaacaagcactgtgctcctggcttgaccccacgccagaaggagctagaaggatgagtggctggtgagacatgagtggtgtgtgccgtagatgcagcactctctgcagcctctgtctgcctctggtttgaatggcctcttccaatctgctgtgttgtgttttgctcagctgattctgagtggtgggaagattttattgcactctgacttagaattgcgccaatttagaatttgattctcatctga

SEQ ID NO: 220299 - DNA, 203 bp, Homo sapiens
accaccaatgagtcttgagctgttattttacttccatcagctgatgctgaaataacttcaggttgaagaatgtatacaccatttaaattgtcagctaccattttgagtaaataaaaacaagctaaaagtttctctgagaataactgacccttttgttgctgagtcagcaaaagttttacagtatttgaggtcagctttatcaa

SEQ ID NO: 220300 - DNA, 391 bp, Homo sapiens
caagagcgaaactgcatctcaacaacaacaacaacaacaaaaaagccagatgtggtggtttgcgcctgtaatcccaggtactcagaggctgagatgaaaggatcgcttgaggccaggagttcaaggttggaatgagctgttccagcctgggcgacagaatgagaccatgtcttaaaaaaaaaaaaaaaaaaaaagtgagttttggggaagaataatcaacagatgattgttgtgtgctctgctaaggggcttttgaccgcctggcattgggaagccactgaaagctgttcaatagttgaatgaggcattaaagatatttgagaagcccaggagttcgaggctgcagggagctatgattgtaccgctatactccagcctgggtgacagatta

SEQ ID NO: 220301 - DNA, 546 bp, Homo sapiens
tccaagcctattggcatgtttttccagccttgttttctccttatatgagtattgttcttgatatttaaatattgacataaaattcttccataactttgattgagttgtaaatcacaccctctccttggcttcctacatccactttttctttccttttcttgcttaacagcaaagctataaacctcttcctggactgataaggaattttatcatcatgccccagagccacagaagaagctgttggtttagaattcttttcaaagactcatttaagtaatcccccagccctttctccgctcactactttcagggctgccttctcacgtccagaagcaatacagtttccaaactgctagaacagaaaaacaaatttgcatttttctggaaggactgtctgtgctcatttcaagctggttccgccttctccgccagaaacacagtaagtgctcagaatgcgaaaccaaaatgagataagaggccccgtgaaattctttttcaggacattcagctgtctttattctagcccaaagcatagggtagaggcac

SEQ ID NO: 220302 - DNA, 753 bp, Homo sapiens
caaaaaagagtaggtacttaatctcccctgaaagtgaacatgtgaacaggactttgtttagttatcctgtactctagggcacactgtattacagggaaataagaacactgatcatggccgggcgtggtggctcctgtaatcccagctactcggaaggctgaggcaggagaatcacttgaacccgggaggtggaggttgctgtgagtggagaccatgccactgcactccagcctgggcaacagactgactccatttcaaaaaaaaagaatactgatcatgacatttagtttcatgcattagtttttgaaatgtatatcacgtatataattctatactttcatgaagtttttatatagtgtatcacaaaaaacaatcacgaaatccaaataaaaaaagaaataaacttacataactatttgatgcttactattaacttccgtggacaaaaatacctttccagtgaaatggtttttttcacaaaaacacttttgtttttcttttgctatataataaagcccccacaatcatgtgaaatcagatacagcaagttttccattctttagagaaggttggctagaatgcttatcttgtgtaaaagaaggaaattagaaagtgacttcctacttatcatttaggactttctcagctcaaaatctatcttttcctatatatctaaataaatgaaataaatagatgataatttttttcatccattccctctccatgaaggaactaaaattctaatattgcttt

SEQ ID NO: 220303 - DNA, 582 bp, Homo sapiens
tttttttttttgagatgaagttctgctcttgttgcccaggctggagtgcaatggtgtgatcttggctcaccacaacctccatttcaaaaaaaaagaatactgatcatgacatttagtttcatgcattagtttttgaaatgtatatcacgtatataattctatactttcatgaagtttttatatagtgtatcacaaaaaacaatcacgaaatccaaataaaaaaagaaataaacttacataactatttgatgcttactattaacttccgtggacaaaaatacctttccagtgaaatggtttttttcacaaaaacacttttgtttttcttttgctatataataaagcccccacaatcatgtgaaatcagatacagcaagttttccattctttagagaaggttggctagaatgcttatcttgtgtaaaagaaggaaattagaaagtgacttcctacttatcatttaggactttctcagctcaaaatctatcttttcctatatatctaaataaatgaaataaatagatgataatttttttcatccattccctctccatgaaggaactaaaattctaatattgcttt

SEQ ID NO: 220304 - DNA, 544 bp, Homo sapiens
ttacaaagtttgaaaaaagaaaatacgagtttcctttctgactgagaacagattcagccactgtggaaatgagccaaagaaatgtcaaaattgatattccatgaagaatttaagaagccagatcattgatctcactcaaatatgtatgaatattatttattataattttgaatctttttttcctaaaagtttacaggggctggtgataaagttgcttttaggacctaaaaggtcacttgccttacttacattgtcttttctactctagattggatggcgcgattaatggtccaggctctgttgttccatcgtttttgttggttttactgcattccattctactagttagtagtttaaaaggccacccaagagctccaacatgtaaagagctaggaagtcatgcttacaagaaaaagccaaagaaactaaaaatcattgacttttcttggatccatcagaaaattgaggtcacaaagcaaacttccacactgaaatgcagagatacaggcaaatacagagtcaaagcagcaattagtttccctcg

SEQ ID NO: 220305 - DNA, 604 bp, Homo sapiens
ctgttgtcctgtttggaggggtgacagcagaaatcaaagaattccactcctccatggaaagacaaaagacaggtgctcaccctgggatggagggggcagtgggagcctgttagtacatctgtgatcccaggggtcagggcctacagaaggaccctgcaggctaatgggggcaaggataccagagagtaggggcctgtttgctcttctgaccctgcagcactaaccatggggggatagggagtttctagtgcactgattccaggcagagagatggagcctgtgagatgtccacagggaatctgacatccctggaaccccgtcatgtcttggggaatatggggtccaaggacagatgggaagacaggagagacattatagaagctaaagggtatgggatggcctgaatttgggctacaacctctgaagaagtcacttcctcatttatagccaaagtaaatgggcacccagatagtctcagtgtggaccaggagccagcctcacacatccctccaagccctccctatccatcatactcccaccctccaatttcactccccacttacagggcaagccgattggttcattaatcactgcctcctcatca

SEQ ID NO: 220306 - DNA, 440 bp, Homo sapiens
taagggtgctaagaattaaacacaatatgcacgttaagggctcaggatagcacacggctagtgctgatgagttgtggttgctactatcgtgataactgtgataaaaggtggggaagggctaacaccatctaggaccctttcctaacagtggcactcgaaaatcttggatgccattggccaaaaagcccagttagggcagaatgagaaggagaccagggccatgacaatagtggtaaattctatccatacctattaaattaatgcatgtagccattcagtaagtactgagtgttccaactctacatggaacttgttccaggtatctaaggcagtgaaaatttttaccacttattgagtgtgtactttgtgccagccacattctaagcgttttcatctattaaatcataaccctaccaggaaggcgctattactaccaccac

SEQ ID NO: 220307 - DNA, 545 bp, Homo sapiens
cacggattactcaacatttatcaaccaccaccatgatcagtcagcagccatccacacccaggcaagaccctttaccagcaaagaaattatgattttctgaaggctcaaatgattgtgagcattttttgagctataaagtatttttaattaaggtatgcccattgattttttaagacataatgctattgaatacttaatagactacagtatagtataaacataattttcatatgcactgggaaaccaaaaaaattgtgtcttgctttattgcaatattcacttcattgcagtgttctgaaaccaaacgtgcaatatttctaagatatacctatatgttttatcccaaagatgtttgaaatttttatctgatcaaatctgtcagtcttttcatttatggtttccaggttttgtgtacaatttacaaatatattatcctcctcataatttgaaaacatttttacttgcttgtagaatatttgaaatactttttaatgtttaaatctataacacacatagaattcatttattgaggtaatccgtgaggg

SEQ ID NO: 220308 - DNA, 599 bp, Homo sapiens
gaagagtcacatcttaacaatgttgatttagcaggttaaattatatccattaattttcatcatagataggtctccttaattgactctttgggactaaaatatttatatcctctgcatcattgttctagttttaagtacaggtaatgttgaccaataacctgttttaataggtaaaaaactgtacataatctttttgaggtgttttttaggattatttcttgctacctgggatacttacagaaatgtagaactgagccaccacgcccggtccaggtcctttttaatgtctgacagtaaagtgtttttttgttttttgtttttttttttcatataatttacataggataaaactttactcttaaaatgattaagtatttaatattttcactaaaaactactgaataacaatattcagcaaccatcactgctagaacatttctatcactccaaaatgaaaaccccatacccattagcaatcactgcaccatttcctcctgcctctatcccctggaaacccatagtctacttttcgtctctatggatttgcctattctggacatttcatataaatggaatcgtacagatttttttttaatgta

SEQ ID NO: 220309 - DNA, 478 bp, Homo sapiens
cgaaagtctcaggccatccccatgcagatacaaaaagatgctttttctttaaccctcttttatttactcctttattttataaatgcctggtgaaggaggttagcctgtttattagagtgaatcaaaatggttaaacctagttatcttgggatactgtgagacaaagtttgattatgttgtatttttgtatttgtatactgatatataaatacctatgtggtaagatgtaaagcagcttcagaagccttgggtaataaattgtttcttgttcatgaactaagccacaatccacagccatgtactttttgtcccatacttgcttgattgtagtacttataatcttgtgatagacacacttgtttaattaacagttttccatagaagtttgtgagctctgtgaggaaggaactgtgtctatttaattcactgtttctttgccagcatttaggaaagtacctggtccttggccacataaaga

SEQ ID NO: 220310 - DNA, 300 bp, Homo sapiens
cagtatttgtcatttgcatttacagctctttggattctacatttttttaacctagtaaaagaaatttagcatacaagaacgctaaaatttttgttttatgtcaaactgatggcaggctgtgtatattcccgccttagagaagtgagttgaaatataccttttaaaaacagcaacttggcctggcccggtggctcacgcctgtaatcccagcactttgggaggctgaggcaggcggatcacgaggtcaggagattgagaccatcttggccagcatagtgaaacccatctctactaaaatac

SEQ ID NO: 220311 - DNA, 410 bp, Homo sapiens
tatctttccctttactggtttatgattcagatttcacatttttgttactattatctcctccctgttcgctgtgttcttctgtgtttccatctcttaaaaaaccttttgctgtggagagagtgtctcagagttgaggacactgctgtggtttgaaagtgttgcctccaaaattcaggtgttgccaatgtgataggattaagaggtggggcccttaagaggtgattgggccatgggggctcctccctagtgaatggaattaaggcccttataaaagagccttcagggccgggcgcggtggctcacgcctgtaatcccagcactttgggaggccgaggcgggcggatcacgaggtcaggagatcgagaccatcccggctaaaaacggtgaaaccccgtctctactaaaaatac

SEQ ID NO: 220312 - DNA, 445 bp, Homo sapiens
gcactcagctttcactagttttacgtgtgtgtgtatttagttctgtgcagtttcatcacatgtatagattcgtgtgactaccaacataatcaagatatagaccaattccatcacaagaatcccttgtattttaccattttacagccacagctacctcctgccttcccctcactaacctatgacatcagctaatttgctcattatttctctaattttgtcatttcaagaatgttatataaatggaatcacacagtatctaaccttttgacattagcagattttgcttatacattcactcaaatggttgcatatatcaatagttcctttctccctgagtattccatggtatggatgtactatggagtattatggtacatctgttgaaggacatttggtttgtttccagttttgggctcttgactaataaaactgctatgaccactta

SEQ ID NO: 220313 - DNA, 699 bp, Homo sapiens
cgtcgagttaaacgtctggggctgcttctgaggaatcagcttgactgggtaagtttgattggagaaaacacctatatctcaattgagcttcctgcagacttttgtattctggcccggtttggggcctcggcgtctctcagtcataggaattgcacattaatcttcgtcctttacgtttcctattcagacacctgtagccacccgctcccttgaccctcccacggtcgcctcgcacttttaacggccagtgcccctggaatccccactgagctcccgtcccaggacccagcccccgcagccccaccttggaccccacagccctaccctgattcctcggccctaccttcaccctgcagcctcacatccctgaaccccgggcttctttatgctcctccaccctttgtgtactttactcttactctcagttttctgtttttcatggcggtggaagaagggtccccattccttctttccgatccgcgattaccctggactcgaagtcagcagacccggttctaggccagctctgcctctcaccctctgtgaccttgggcaaatcatacaactctgggactcagtttcttcctctctaaaacggagatgactgttgctccatcagtctcaggtgaggagtgttgaggagccaacaagctagtatgtgtgaagatgccttgtaaactgtaagaccttcacaagaga

SEQ ID NO: 220314 - DNA, 484 bp, Homo sapiens
tatatcacacttcaggtcctacaaaatgttcggcattttcccaactacatccacctccttggcacattaaaatgagtgttgtaccaaatgcccatcaatgatagactggataaagaaaatgtggcacatatacaccatggaatattatgcagccataagaaagaatgagttcatgtcctttgcagggacatggatgaagctggaagccatcattctcagcaaactaacacaggaatagaaaaccaaacaccgcatgttctcactcaaaagtgggtgttgaacaatgagaacacagggagcggaacatcacacaccagggcctgtagggggtggggggcaaggaaagggagagcattaggacaaacacctaatgcatgcggggcttaagacctagatgatgggttgatggatgcagcaaaccaccatggcacatgtatacctaagtaacaaacctgcacattctgcccatgtatcccagaactta

SEQ ID NO: 220315 - DNA, 171 bp, Homo sapiens
tctcaaactcctgatctcaagtgatccacccgcctcggcctcccaaagtgctggaattacaggtgtgagccactgtacccagccaagtctgggaagtttgttaaccaatcagtcccccacagataccaagggacaactgtgtattatacctaaaacaaatcagatatttat

SEQ ID NO: 220316 - DNA, 429 bp, Homo sapiens
acataaaatggacgttctgtgaaaatcaattgactgtcccggctggaccagacagctctgacaccacagtaggtggcaggtggtgaacataaggtacccagaaaccttggccgcagtgacacagtgaatgcagccgctggcctccttccttgcaacactatttgtagtttcttctctctgtgcgtccatggcatttccagaaaatgcatcttgagttgacttcccttcgttatgacacagcactgcaagcagggtcgagctgcagttgggaagtttcagggcacatttcggccacatctgctggtaccagtaggaccgtgattgttttggtggttgtatgagtgcagattaattaaacaacagtaacaaaacagaacaaaacaaaaaaacagcaattcgcagcagatctgaaatatcagtgacaaagac

SEQ ID NO: 220317 - DNA, 488 bp, Homo sapiens
atggttatccccaaactcatcgagctacataattaaatatgcacagctttttacatgtcagttgtacctcaacaaaatggttaaaatgaaagaagaagaagaagtaatgtggctgcaagcaaaagctccagccctgttgtgcacacagagaacaagtgtatgcagagggtaaatgaattgactcaactggacagtgggcagcacctgaaataaagccccactgtgctggctccttgtgctccaagtgccgtaccacgtcttctcccctgtattgcctcattattattcacttaagtgggtgtgatctgaaagggagcattgtttcagaatcaataaggggctgaattcgtgtagtacagtgaatgtctgcgcttcaagcacctccttatcaccagcacacagtagaggacaggtccaaataaaacacattatcaggctttgttgactttccaggcccagcagctgtattaatggagctctttatatcc

SEQ ID NO: 220318 - DNA, 914 bp, Homo sapiens
cattatacatttatactacccctatgggccagacactatgccaatgttttacatggatgatctcatttaatcttcaagcaacctcataaagcagaacctattttctactagattggaacagagaaaatggaggcttagagaggctgggtaacttttctgaggtcataaagcaacttttgggagaaaaagaccagatgtaggtttgtgtgactctgaagcacaggttcttaaaaactccagtacacttgtgggtatttttttgtactcaggctctcattagcggtacaattttatagtgacaaggtatgttaatttcttccatagataactgatgcataaaagcttagaagctgtaataatttaatagttcacatgaacaaccctaactgacagtattcaccaaagttgaagaaggcaaatcagtcagttgtattaaagaaagaatcagatttccttacaatttccctcttactctcaaatgagactcatataccaagtatcttctgaggggaaacaacaacaacaacaaaaaaaaacaactcagtagctagaagattacttgacgtgataacaattttgtgaactcgctgtggtcaaagttaagtatttgacacaccggcaattttgcaatctgaaaggactctggtgtcattcttctgccgatttgggatccgaaccctaactgagaataccataaagatgtagatgtagatttttatgatgccttaagagagatgctttaagagataacttggaatcaaggttaacatcaaaggtgttaaagatgatgtatttgacataaacgtccttacctgactacaggttgaaacctgaatctctttaggtagatgtaaatggacaggcatgaagttaatgaatgaactgaaagtaagttaattaaattatcctatcat

SEQ ID NO: 220319 - DNA, 188 bp, Homo sapiens
ggccccggcgggatgaggagaccatgccgggcgcgcacacacggcagcttctgtttgaaaacggcgaccttcgggcccttttctccagcaactgcagaggcatttcaggagttggagaagagacgtgtttcacctccccgacgtctggaccagtctggaagggatggaggcgctgtggccaagtgcag

SEQ ID NO: 220320 - DNA, 1030 bp, Homo sapiens
cttcctagttgcaggacaagaactcaagacccatcaagtggcagggccaaaaaagctgtaacaccaacagggctgaaacatgccccctgcttgccacgttgaaggtgaagagaaggaggtaaactactgtcaaatcactgtaacttgaggagttttggtgtttcaccttgctgaacaggtgtatggaaagcccaagtcgtttggtaaacctctcaacttttgacaggccacaaactccaaactggatctcctgtggtaggcagtagaatatctatgagtcatcagtgtcctgagaagctaaacgtcctactaaggatcctgcaaagggaaaacagaagaggaacttgcactttttgagaacttgctgtgtgccataagcctaagtccctatgtgggaaggattctacccacacatgacagaggaggagactgaagcatgaaaaagaaatggcgttttgctggagaaagcagcatagcggaatgtaaagcggtaaagcgtgtatgctctggagccacagacctagatggtgaagtctagctctggtacttgacagatcccattctccatcatctccaccctgctctgtgacccagtcggctgctctgcttgaacgacatcaacaagcttcctgcatcctcatgtctagctgaactcaaccagtgggaagtaccagcaggagatcaaaagaaaggagcaaagtccactgtgggatggctgcttctcttgacccatggtttcagctcctgacagcattttggcatgctttggttgacttacaactgctgcacctgcatcctgtgcctgcaaacattttctggaaccttggaagtctcctttgcccacaactctaggaggccagctgtgctgggaaactaacatcctccacccatgagcagatctccaacaatggctctcaggagttggtgaatgaatacccagctccctcatccttgggtggtatcatgctaaggcatgtgttttcaacaactatgcacagagttttcctaggtaataaactctagtcaacca

SEQ ID NO: 220321 - DNA, 929 bp, Homo sapiens
cttcctagttgcaggacaagaactcaagacccatcaagtggcagggccaaaaaagctgtaacaccaacagggctgaaacatgccccctgcttgccacgttgaaggtgaagagaaggaggtaaactactgtcaaatcactgtaacttgaggagttttggtgtttcaccttgctgaacaggtgtatggaaagcccaagtcgtttggtaaacctctcaacttttgacaggccacaaactccaaactggatctcctgtggtaggcagtagaatatctatgagtcatcagtgtcctgagaagctaaacgtcctactaaggatcctgcaaagggaaaacagaagaggaacttgcactttttgagaacttgctgtgtgccataagcctaagtccctatgtgggaaggattctacccacacatgacagaggaggagactgaagcatgaaaaagaaatggcgttttgctggagaaagcagcatagcggaatgtaaagcggtaaagcgtgtatgctctggagccacagacctagatggtgaagtctagctctggtacttgacaggctgtacaagaatcatggtgccagcatctgcttctgacaaggacctcaggctgcttgcacttatggcaaaaggtgaaggagagccaacttgtcacatgacaagaaagagagaggccagagacaagagagggaagatgccaggctgtgttaaacaagctcttgcatgaaatgatagagcaagaactcactcattaggaggagagggcaccaagccattcatgagggatctggccccataaccctaacacctcccagtcagccctacctgtcacactggagattaaatttcaatgtaagatttggaggggacagatagccaaactgtgttagaagtcccaaataaagaaaacagtcttcgtatatttggaactttaa

SEQ ID NO: 220322 - DNA, 335 bp, Homo sapiens
gcaaagttgaatataagtactggcagcctggctggaaaactacaacccttctgtgtttcagtcaacaaactcttttaggttcatttgaggaaggaacattcgtatcggttatagaaacctttttttgtgcccttctggtaagatcaagaaagtgccgtcctaagaacttgcagaatgagagtcagtggctgtggtggagccttcttttcaaaaaatgctatgtcccaagaggacattactaattgaaaacacatggacaccaacaagtctgagttgaagtaatttggaagattcaaattctatgtgcgaagaagttttagggatatcttaagcag

SEQ ID NO: 220323 - DNA, 305 bp, Homo sapiens
atgcaatatatacgcattactgttatccctttttcacgtctgagaaaaatgaggtgcagagagattgaattagttgctctactgacatgggaaagagaggcaggatttgaaaccagtgctttcaactattcttttctctcaagagacagagcctgtgtaagtttaaattaaaataaaaccaggtccctacttctgtgttcttgtttttccttgtgatcctgaagtaactctatgctatgaatgtttttcaatcctgatagtcttctttgttttgaagccttaaataaattctttattatattcta

SEQ ID NO: 220324 - DNA, 135 bp, Homo sapiens
caggggccggatcacagaggcctttgtgagtcatacttaggagattggatataaaattgcatagctcaaaattatagagttagttatatttcatttggattatagtggctaataggtttaagctgctagcatgac

SEQ ID NO: 220325 - DNA, 1260 bp, Homo sapiens
tggtcaggagatcgagcccatcctgaccaacatggtgaaaccccgtctctactaaaaatacaaaaattagctgggggtggtggcacatgcctgtaatcccagccactcgggaggctgaggcacaagaagcacttgaacccaggaggcggaggttgcagtgagctgagattgccgcactgcactccagcctggagacagagggagaactccatctcaaaaacaaaacaaaacaaaacaaaaaaacaggcattaccagcctgccacagaatatgcctagagaaatctacaggtgaccctgatggggcatgcagaacccagagccgtggaaatcacctaaaaggaggggaccacctaaaaggaggggacaggagagcatctgagcagactgtctgttgcctggagcaacaggaggactctctggggtcagctgaaagggaagcagtcaggggacttgcaaggggggagtaccactcgggcaagggcaggagaataacaggcggtgccctggaggaacactgcatgctgctgaggaaggagggcggccttggcgatgatgtcaccatgaagcacttggaattgagacagaacattctcacttggggtcagtttgtaccctcgtactgaaagttactccctggtgctatctgtactcatcatattttgacacactttagagtaacccttccatctctccctgcttctttttgaatttaaacatcaagcatttgaacacaagtcttcatgtccatttatctcagtgtaaagaggaacaactgggctgggcgtggtggctcatgccctctcttggtacttgatatagtcagttgcctgactgcaaacccaggcctaccctgggtagaaagaaaagggagttgtgacagttgccaggaagatttctctgtggaagcagctggtgtttttctgagtggaaactttgtggagggaactagcatttaattaaaaaacaggctgggcgcagtgccttacacctgtaatcccagcactttgggaggccgaggcgggtggatcacttgaggtcaggaattcgagaccagcctggccagtatggcgaaaccccatctccaataaaaatacaaaaaattagccaggtttagtggccggcacctgtaatcccagctacttaggaggctgaggcaggagaattgcttgaacctgggaggcggaggttgcagtgagccaagatcgggccactgcactatagcctgggcaacagagtgagactccatctcaaaaaaaaaa

SEQ ID NO: 220326 - DNA, 586 bp, Homo sapiens
ctgatctagaggatcccagtcaggctgcaacaatctatgctgggagtgcagtggcgtgaacatagctcatggcagcctagtactcctgggctcaagtgatcctctcacatcagcttcccaagtagctggactacaggcgcataccaccacatctggctaatttctttatttttttagagatgggggggtctcactacgttgcccaggctagtctcaaacccctggcctcaaacaatcctcccgcatcagcttcccaagagtcattagggttacaggcctgagcccctatgccaggcttatgtatataaatttgaactttaagaagtgttaacaagtatcaaactccagctaattatatgtatgtcaaaatgtttaggggtaaactgtaaggatgtctgcagcttattttgaaatgaagcaaaaagtaagatgtaatgaaggttaaatagtggagtgaatagatgcatagatgtaagatacagttaatgaaagataatgttaattgcagaatataggctgcactaattgcagaatatatggaggttcactatacaactcttccaactttttgcatgtttaagctttt

SEQ ID NO: 220327 - DNA, 705 bp, Homo sapiens
aggataagaacataaatcagactctaccttttcacccggaagacggtctatgtgcctggggtctagagcttgtacttctttttgtccacgacaaagacttcctagtcactaagtacttgttagtctcttgaattagtctcctctccagctcacaagcaaagcccagtttaatcattccctgttctggaggtacagactctagggccatgctaactctgatttctctagattattaaagttttaccatcacatgatttcaaatcattggaaatatgcttgcttctaaaagccttctccgaacaacagggttctgaggggttttgttttcaattaatagttagtataaagaaacaaacgttagaacatctctaattttctttgagaaattttttgttaaatttttatgtcctacctcccccaccccgcttttttaacgtgacagagttccctcatagctcaaggacagaaaaaatgtctgtcctgaaagatggttgagtgcttttgttattcaataggatatatttaacccatttgtttccctttttgccttggttaccagggagttcagaactgcacattaggctcaattgtattcacttccctcagcccagatttcttgtataggaccttctcttcctcatttgcctttgttatatgggtcttttttttcttattttaatggattcatagttacatatctgtacg

SEQ ID NO: 220328 - DNA, 543 bp, Homo sapiens
aactgccagttattaaaaacaaacaaagactacttagtggattcctgaggctatgctcccttgtaggtcagcttctaatgcaacctcggatggatgctgtaatatcttaagcgcataatgccatgtagtatatagcagagtccaggtattgctagagatctagtccatgccccttcagaaagcattccaaaaagtgtgggaaataattcatttactcctatgaggaatgttaccctccagatttgctgagaaagcctttacatttgaaggctgactcactgcttcttaggttagccaggtaccttgagtaatatgctatattaggctagcttcctaatagtccaaaaatggtagcaatttgatattcccttttccctagtgaacctgtaaggggttggatagttgctatatctttctaagactggatcttgtgaatatgaacatactattctacttttttcccttctcttacttttcatgacttttatattctttgttattatttgaaatcacaatggggaaagaagtcaataggttgaagtg

SEQ ID NO: 220329 - DNA, 391 bp, Homo sapiens
agaattagatgtcctttgagaaaaaccaaactctaatgatagaagttaggaaactaaagatgtgacaataattacttccaagttattagagaagcaagctgaactgttattctccatttccacataggaaaggtttttccaactttaaatgggtcagatgttggaattatatttccaagggagtccagggcctggatatctttaaaacagatatgaacagctgctcaaaatgacttaggctaagattgatgatatttcccaggcagcaccctaacttgccattcattccttcactaccaaacagtaagaagaagtgagggggcccaagtcaggagtcgggcaattaggcacgtgctcacacacacacagaggactctgttctctacacccc

SEQ ID NO: 220330 - DNA, 191 bp, Homo sapiens
tgacaggcaaggaaaagccagtagagcatcatcgccactggcctggcaggaggaggtggccctcgggctgcagttcactgtgctgtttgcactctgattcttggaagaatctttcctgaagtcacggagcctccagctcctccggaacagaactagttgtgtaggagtgtgtccttcatgcccctcaggtc

SEQ ID NO: 220331 - DNA, 396 bp, Homo sapiens
tagggtttttaatgtttattgccaatctgcctccctgaaagtttgtacaaatgttcacatccaccatcattgtgtgagaatgccagtttaaccatatttttggtatcatcaagtgtttttacctacagtgttgatagggaaactctggttttttacttggcgtatctttaattacattagaaaagttacagaattttttttcatgttagttaactactttgcattctttgtgaattatctcttcatatttgtccatttttaatgaggtgtaatgttttttgacagtttgcgtaaacattttaaacattaagtacattaatcatttcatagttgtggtagatattttccatgctcattgacttttaattatatttatgttgtttttggtgaatagaa

SEQ ID NO: 220332 - DNA, 364 bp, Homo sapiens
ttttttttgtatttttagaagaggcggggttttgtcatgttggccaggctagtctcaaactcctgagctcaggcaatccgcctgcctcagcctcccaaagtgctaggattacagacgtaagccaccatctctggcccattaaccatatgttctaacctaagagtactaatggatggcaaactagataaattgtgctatgttcactaaatccagggatgattagggcccaaatggctattgcatggaaacagagagaaaggggtagtcaggtacactctcaaggaagcagcagcaagatttagaaaatgaaaggatacaaaatgcctaagaaagcagatgtttgatccttttagctgataaaaag

SEQ ID NO: 220333 - DNA, 417 bp, Homo sapiens
tacctgtagatgccaggatctatattggacacttgggaaacagcagtgaataaaacaaagatctctgacttgtatatggacaagcaataaacacaataaatgagtagtaaactacaaggtaaaccatgtagtaggttagggagaaatagtatggatgaaatagtagagcaggtaaaagagactgggagtgccagggaatggtccaggtaggcctcactgagaagacgataactgagcaaaaatttgatggaggtgagggagttggccatctgggggaggggcattctgggcaaaggtctaaaagtgagagcatgctggggtgctcagggagtggtaagagggcacgtgaggctgggaaggagtgatgatggagaagatgaggatgacagacaatgaggggccacatcatatggggtg

SEQ ID NO: 220334 - DNA, 475 bp, Homo sapiens
ctggcagggcttaaagaaccaggatccactcttaccagctgaggtattcccctagagtggcatatctgcctgctgccccggaagtggcacccttcaagctctgcttgaggttggaaatggaggtcagcgtgtcgtattcgctaataatgatcattcacacccaagctaagttcaaactttacaagttgcttctgctgttgccttggagcagtccttgatgggaaactgggaggtagttattgggctgttcccattttacagatgaagatactgaggctcgggaggggaagcccttgcccacggtctgtaggcaagaatctcgctagaagtcactgtcatgtgtgagtctgtgagggctgacattcttacccacggctggaggcccttctgtctcctggcttgctttcacagctccttaccaccttccctgccctggggagtgggtgcctttgtagggggctggccacagagcaga

SEQ ID NO: 220335 - DNA, 457 bp, Homo sapiens
aataagagtttattaatgaggtcaatgttaggcttaaacactagattactaaggtcacgtaatttcctggtgactggcagtttaaagatgagatataccacatgtgaattggtataataaaccatttaatggtgtatagacaacatttatgtgtactatacaacagtatacttccaattcctttctcccatcctctgtgctattgttacgtgttttacttttacatattctataaagacactttacatttcttctcttactgatgtagactgctagttaatctttcacagtgattaaaaataagaaaaatgcttttatatttaccttcatttatgccatttccagtattcttatttctttatggaggtacatgtatctctaatggcataatatttcctccagcctgaggtactttcttgtacccctttttgctggtaatgacttctctgtttttgtt

SEQ ID NO: 220336 - DNA, 488 bp, Homo sapiens
aggcacagtggttcacgcctggagtccctggccgacacaggaggatccctggagcccaggaggtagaagcttcagtgagctgtgatggagccactgactgcactccagcctgggcgacagagcaagaccctgtctcaaaaaaaattaataataaataaattaatttaatttaaaaaaaaagaaagtctcatgggtctcagtatagaatagatgtagaataggtgtcgttattaggtagaattaccattataaacagagcccactgaaatcacagtaggctgccagtctattgatttctggtgtcaatttatgaattttgagagtataaaatccaacataaaaatctgaagtaagaaatggtatacaaatttcactgctagaatttctgaatgaaaacaaggggcaaataaacatttttaaaattattagctaccaaaaaatcctaggggcatatttatttgcacaattgctaatcctgaacacccagg

SEQ ID NO: 220337 - DNA, 439 bp, Homo sapiens
taggagtcactaggtttagcctaccttcaaggggaggggattacaaaatagtttgagtaagaggaggtggggaactttgagagacatcgtaatggctgtccaccacagtcttcctccgtccccacctcccagtgattcatttcccttccagatgcagaatacactcactccttccaaggcccctctcagagtctcacctcattacaggatcacctcaaagtcaataatcttgtcatctaacataggtacaggtgctaatgaagcccataagatatactttcttaagtatgggtattgatctgcagacctttagacttaaagaaaataaagaacaagttatctgtctcccctcctccaccacccctaaccgatacagtggaatcactgctccatagcaattctgaaatctaaccagacaaatgtttggaaattcctttat

SEQ ID NO: 220338 - DNA, 433 bp, Homo sapiens
cacagaagtttttttttttttaaaaaaaacaacccccaccacccccccaaaaaaacagtgttactgtgttgcccaggctagatgtaaactcctgggttcaagcaatcttcctgcttcttgggtagctgggattataggtgtgtatgtaccatgcacctggcttgtttttgtttcacgttttgtataaggttgtagtttttgcagagtcttttgtgatagtttttatcatgcatacccgcatgacagcccttccttcatagccttccctggctgtttgtcagggtgttttttttttgttttgttttgtttaaaaaaaaacagaacaaacactactactactccagtttgattctgataactttcatataagtctgttcatcaaggtgttgttatccatccaaactctttgttgccttaatagattttgtttttg

SEQ ID NO: 220339 - DNA, 428 bp, Homo sapiens
ctatgtgaagtaactcattaaccaattccaagtcctaaatttcccatacccattatgaatgcgctataagttataaacattctccaggttaccagttttaaatagcaattgtgaaagactaatgcaagtataaaaacactttgtgaggctgggtgtggtggctcatgcctgtaatcccagcactttgggagaccaaggcaggcagatcacgaagtcaagagatcgagaccatcctggccaacacggtgaaaccccgtctctactaaaaaaatacaaaaattagctaggcatggtggtgcgcgcctgtagtcccagctactcgggaggctgaggcaggagaatcgcttgaacccaggaggtggaggttgcagtgagccgagattgtgccactggactctagcctggtgacagagcgagattccatctca

SEQ ID NO: 220340 - DNA, 472 bp, Homo sapiens
ccgccaccgcttgtgtgttgcagctgtaagcttccctttacatgggtttgagatctttcttctttttaatttaaggatctgcagctgtaagcttccctttaacatgggtttgagatctttcttctttttaatttaaggatctgcagctgtaagctttcctttagcatgggtttgagatctttcttctttttattgtgtgtttgcagctgtaagcttccctttaacatgggtttgagatctttcttctttttaatttaagcacctgcagctataagcttccctttagcatgggtttgagatctttgttctttttaatttaaggatttgcagctgtaagcttccctttaacatgggtttgagatctttcttctttttaatttaaggatctgcagctgtaagctttcctttagcatgggtttgagatctttcttctttttaatttaagcatctgcagctgtaagcttccctttag

SEQ ID NO: 220341 - DNA, 403 bp, Homo sapiens
taaaacccctggtctgagtcttgatgctgtactctggctggctgtgcttccctgcagcctctgtttccctatgtgtaggaagtggggtaaggcaattaacatgtgcctcctcttcctgcctcaaggcaggagtccatgctgatggtcatgtttgggccagactgactccctcccagacggcggcccactgagtggttttcccgccactccagggagctgctcttttcccctcccacctgctgggatgaagccgggcattactgctttagatgagtgaggagcctggccaggtgccaggatgttaaaagcactggggtgggagtcaggcactttcttgtcacaggactgccactgctttgctttgtgaccttagacaagtcacatctgagtgtgctcatctgta

SEQ ID NO: 220342 - DNA, 512 bp, Homo sapiens
ttgccctgttgccatggtcaagttaattatgtgcctctgtttcgtttccttccctccctcccttccctcctttccttccttccttccttccttccttccttccttccttccttccttccttccttccttccttccttcctccctcccttccttcccttccttcccttcctttcttttcttttctttctttcttttgtctcactctgtcacccaggctggagtgcagtggtgcgatctcactgcaacctctgcctcccaggttcaagtgattcttgtgcctcagccttctgagtagctgggattacaagtgtgtgccaccactcctggctaatttttgtgttgttagtagagaccaggtttcaccatgttggccagcctggctgatcttgaactcctgacctcaagtgatctgcctgccttggcctcccaaagtgctgggaggcatgagccaccatgcccggccttgtgcctccattttcttgtcattaaaacacggtaatagcagctaccta

SEQ ID NO: 220343 - DNA, 569 bp, Homo sapiens
agctttcataaggcataatcccgagagtaggttatgattagtgatggaggaaagaaaaatctccatgaagcccgcatctccagtatggtgactgggtctgataagcgcgccatgcatgtcttgtagaggcagcttccagaacttcctggtcaggtttagaggtggtgatctgattggaaaagctggagaggggcaggcggggaagtgtctggaagctactcattgcttttacttagatgtttgttatttggaggcttggaaagaggtcgatggggtaccccttggccactgagtcccctatcaacgggcatcagcatctcactgggtggggatgctctgcttccatggttggctctgtagtcataggaacttgccgtggtggttgttgtttagaatataatatacaagcctttattaatatattaaataccaagagctagtagtagctctataattttaaagtagtgatgaatgtaatgatattttaaaatatctataacaactgtaaaatgatatgaaaataactgtggatttcattggtgataaagtcatagatattgctaacacta

SEQ ID NO: 220344 - DNA, 367 bp, Homo sapiens
acactccagcctgtgtgacagagcaagactccttctcaaaaaaaataaataaataaataaaaataaaaaagaatttaagtgtcaaccagtaggatctttggaggtctcaacacctccctacccatccttaaattttattgcggagcaatgtctttgctcctgtacctttctctccataatggtgctatttattgcgtggtcataaatacagttcattattattcctgttagacttcctatgtttatcacagcattccaggttgaattggattctggtaacacttatgttcaacctacctcccagcttcaaaactgaatcctataatatttaccaaatacctactacattctcagcactggggtatga

SEQ ID NO: 220345 - DNA, 545 bp, Homo sapiens
gtatatcaattttctaatctttaaaatgatatatgacatcatgatgatgatagctaataggtaatgagtgccaggcactgtgctaagtgctttgcatggcttatctaattgaatcctcataactaccttgggggcagatactattagtatccctgtgttacagatggtaaaccaaagctcaacagtttggttacttgtccagggtcatctcaccagtaaaagtaaagctagtctcatttggtagtctgtgattctctgtgtgtcagatgttagtagttgcatacattagctgccttcttttgcatttgatttttctgatcataattacattttggctgatgcttcatgggttgtcttaaggaaaacatttgggagtaagtttgggatttgaggctaaattgtagttaataagcatttaaaggccaggtgtggtgggtggctcacacccataatcccagcactttgcggggctgaggcgggaggattgcatgaactcaggagttcaaggccagcctgggcaacatagtgagaccatcatctctaca

SEQ ID NO: 220346 - DNA, 485 bp, Homo sapiens
taaataactttacagaagtataatttacaaaattcaaccatgttaagtgtataattaaatggtttttagtaaatgtaccaagctgtgcaaccatcaccataatctaactttagaacatttccatcacccaaatatgatccctcatgcccttttttaaatttttttttattttttaaaatttttgtgggtacatagtaggtatctgtatttatggggtgcatgagatgttttgatacagggatgcaatgtgaaataagcacatcatggagaccttatgcccttttataattagttcccactcccagcccctggcaaccactattctactttctgtctctagatttgtcttttctggatatttcatataaatggaatcatataatgtatgatgatttgcttttggcttctttcattcaacatgatgttttggaggcttgtctgtgttgtagcatgtgtcaatatttcttacctttatgttgctgaat

SEQ ID NO: 220347 - DNA, 876 bp, Homo sapiens
gcacgagtagtgttagagttctgttgccaggcataaacatatgctcagatgatcagaacattgctgacttaaagttttatgaatttatttgctggttaatatttcttatattttacatggtacaaaatgacttttcttctttctgaataatatctgacaatgtagttcaacagattttgcaggtgaaatactccttgaaatagtgaagtctattgtgtgcctaccttataacgttttctggcactgtacttgtgtgaacaacatgaggataaattcagatgcaaaaagtcaagcgttctgtattctcaggttaggaagggtgcgggggtggagatattcacttgttcagcattaaggctgaagaagaccttggcatctgtagatcctagggagctgctaagttcaacttaaagaatatttcctttaacaaaggcaaatcattaaaggcatagagacgaacaacaagacagctttgtcagctttgctacaggccttaatgtcgtttgaacagaaaggcctgtgaggttttatcttgactccatgacaggttatgtggataaatcactgtgaattaaaccttaatcaagtgtttagtcaagttcaatccaactatagctctataaagccagtcttgcttttactccaatttttcaatatggtaagcaatttattgaactctggaaaattctagatgagtttcctaatttctcatatgctataacaagaagaacaataattaaatgctgcctaattttacataaaattttaattatttaacaatttgcattttgaggtatttatacttaaaagcctttgaaaaaagtgactgaataactattttcttcttagatgaaaaaacaaattttccttttacta

SEQ ID NO: 220348 - DNA, 916 bp, Homo sapiens
caagaagcgggaagcttgatggaacatggcaaactccctgagctgaacacacagagctgagaatcttggggggccaaacagctagggtttacagggcagggtaatggaaagctgcacagagggaaaattccagaggtctacggaagtgtccccgccagaatactcagcagagtgctgatcagtgtgtgcatgtgaagacactaccgaggctgaacaatcaatcaaagggctttgaggggatagtcccctaaagctcactgggcctgggatactgcctgtttcaccagccagactggaaaacctcataactcttggggtatcagtagagttctctaaagggtcttgctattagtgggacataattagttctaaactaaatactgctctggtcctgcctaacaaatcacaaaagcaagatccaaaagaatcaaactgtttccaagtcacttaactatagtccagaaaaaaagctcaagaatattcataggaatacaaaaatatccaatacccaaaaaggtaaaattcacaaagtctgccacaaagtctggcatccagttgagaactaccagacatacaaaaaagcagcagaaaaatataatctataataaagagaaaaatcaatcataaccacccagaactaacacagatattagaattagcagataaaatggaaagttattatagctatattctatatagttaaaaaactagaggaaagctcaaagatagtaagaagagacatgaaagataataaaaacccaaatcaaacttctagaaatgaaaattatctgaggttaaaaaaatacactggatagaattaatggcaagttagacattgaagaaaaatggtgaatatgaaaagagatagcaatagtaactatccaggatgaaacccagagaaagactcaaaaaagaa

SEQ ID NO: 220349 - DNA, 440 bp, Homo sapiens
gagctttgacagaggacagggagggtgaagaggagtaagacctgagagtgagaactgaggttccaaggctctggggccagaccagggagaccgaggtgtcgactccccacctcagcaggtggggttggggctttctgcctgcacctgcttccctgggattccccaggttggctctgcccttccgaaagcgggggtgggagcggccgtatctcctacctcatgggcaccagagtcacttctcaggaggcgggcttgccactgctgccaaggagccagctaacctcttgttatattagaactaggatttcagctgggcgcggtggctcacgcctgtaatcccagcactttgggaggcaggggtgggcagatgacctgaggcccggagtttgagaccagcctggccaacatgcaaaaccccatctctactaaaaatacaaaaa

SEQ ID NO: 220350 - DNA, 410 bp, Homo sapiens
tttccattgttctgggaatatgctattaaagaatgaatggttactatcaaatccagtctggtcatcagccatagttaaatagctcataatgggggctataaaattaccattcatgtcacagacatttgttgttagcgttactacctttcaggcactgctctaagtgccttacaactgtaaactcatccaatcctcataacaattctgtgagatagaaattattattatcctcgctcacagatgaggaaactgaaaaacaggggagctcaataattcacccctggacacagagcacacactcattcattagagccagtgttcaaatccaagccatctggagccaagtctacactattcattgtgactgtttaattcttgcatcactttcttacgaggaagatgttttttgt

SEQ ID NO: 220351 - DNA, 592 bp, Homo sapiens
ttatttgataatttaggagtgctcattttggtgggacacatatattcttcaataacagtaatggagtgagttactgcaggctttttttttggataaaagtttctagaagttatatcaatagcaattcactttcatgacaggttattgcctctttttaagtatattttctttctgaataagtagagagaaatcagtccttcattttaaagaggcttgttgtatcttcattactcctgtaactgtttatttaacagcagccttatgttctgtaaattgccatggtattaaaagagagctggaaaaatcagaggcaaaggctgtcttcaaggaagtttcagttagagagaccactttaaaatccatgagttgacaagagaagagcaaagttattgaggtgctgttatagcaaggcaatattctgggttcttcattcactttttcatttaatcctcatcatggttttcaatgtagaactgagaatccagtgataaaattgtgagataaagaaaaactattagatgtttagagaactagatatcgttatgagctgcatttgcagaaaaacttgtagatgatcatcaagacttggaaa

SEQ ID NO: 220352 - DNA, 500 bp, Homo sapiens
acttgataaagctgtacaatttgtgatataaatgttaagtaaggattcttgacatagaaaagaattcttgacatagaaaagacacactgcaagggcaattctataactatattaaaagtgtaagtgacttcagaaaaatccaggagttgaacaaaaggggaaatgaaggatgtaaaagtgttaaaaattcctcaggcacagatggggtaagaggttcagagatggagagaatgtaggtattctaaaagtctcatcttaaagtggtaggttaagctgagaaatctagagcttcttagtagaggacatggccagtgtcctgttttcagagaacagttaacaacaacaaaaaaaggtatatggtgcatggagcaaggtaagaaaccataaataagatgtaacactatgctagaattacaacctgacagagaaaaaagctggagtgaatagttccttgaatgaataacaccctgatcaaacaaaaagcaaaaacgaagaacaaa

SEQ ID NO: 220353 - DNA, 510 bp, Homo sapiens
atgggtctcgtggggcctggtatcagttcccagctggcggtcgagttctctaggggaacagggcctgcatgtagcagtatttttattattttcaaccgcagtcgcttcttcctgttgccttctgggtactgggaggcacccgggaagagctgggattctggggtcccccagtatggtttacctgctctggggcaacagggacaatttgggtttctaagcaacattctggctgggtgccgtggctcatgcctgtaatcccagcactttgggaggccgaggtgggcagatcacctgaggtcaggagttcgagaccagcctggccaacatgatgaaaccccatctctactaaaaatacaaaaattaggtgggtgcggtggtggaccctggtcatcccagctacttgggaggctgaggcaggagaattgcttgaacctgggaggtggaggttgcagtgagccgagatcgcgccattgcactccagcctgggcgacagagtaagactccatctca

SEQ ID NO: 220354 - DNA, 401 bp, Homo sapiens
agtggccctgctgtgctgcagttggaatgctggcattctctgttttgagtctgggccttgaaattcacagaccatgctctcctctggcacagtggagaggctagcatggccagggcagtgtctctgggcctggaacatgactcgatttcccagtatgtgcaagcctcagcttccccacctcacagacaacagtcatggggatgcttcccttgtcagaaggatgtggggcccttaggatgataacatggacagctgtgttgaaaggaggatgcttcaggagtggatggcagggacctggcttcctgccttggcctgtccccaattttatgtctggcctgagcaagtcacagctctgctttagtccttagtgtccccctcatgagggacgttgagtgacccac

SEQ ID NO: 220355 - DNA, 291 bp, Homo sapiens
agattggggtgaactggtgtcaaggcacgatgccactctttgagcttctctcatctgattccctgatggaagtgcccctctcatggcatgggtgcttcttgcaaatcttccacccatgagaaagtcactgatcagaccccagcatccgctcccctcagagccctaaaaacccctcagagccatcagaacagatgagaatttatgtgggtacaggggcctaactttgggaggggggagctttggttagtggcccgaggaggggagagacaggagagagtaaaatatcatttt

SEQ ID NO: 220356 - DNA, 610 bp, Homo sapiens
ctgtatctagctaatctggtggggacttggagaatctttatgtctagccaaggtattgtaaatataccagtcagcactctgtgtctagctcaaggtttgtaaatgcaccaatcagtgctctgtgtctggctaatctagtggggacttggagaacttttgtgtctatctcagggattgtaaatgcaccaatcagcaccctgtcaaaacggaccaatcagttctctgtaaaacagactaatcagctctctgtaaaatggaccaatcagcaggatgtgggtggtgccagataagggaataaaagcaggctcagccaacattggcaacacggtggggtggcttccacaccgtggaagcttagttcttttgccctttgcaataaatcttgctgctgctcactgggtccacactgtctttatgagctgtaacactcactgcgaaggtctgcagcttcactcctgaagccagggagaccaccaacccaccagaaggaacgaacaactccagacgcgcagcattaaaagctgtaacactcaccgggaaagtctgcagcttcattcctgaagccagcgagaccacgaacccaccagaaggaagaaactccgaacacatc

SEQ ID NO: 220357 - DNA, 221 bp, Homo sapiens
aatgtagtaagtgttatgaatgaagaatgcacagaatgctagaggagcacagaaaaagttcataaagcaaggactacaagtaccaagtaaggtttcccaaagtaggaagtaccagaggcagattattaaagaaatcaatgaggtcataaagtataaggtattgtaggcatatataaagcacagaccacgctgtaagtcactcactacagctaggctaggga

SEQ ID NO: 220358 - DNA, 370 bp, Homo sapiens
gggaactctcccatttaaccagcccacagacatgaagacaccatggggagtgtggggagagccacgagatgtgtaccatgactgcctcatctttccaccctctgatctcctgttgagggttcccactgatcaaatccaagaagccagaggggaagagagttcctcaatgtagtcagcgtcctggagcaaagagaggagaggagatgatccaggagcaaataggagacaaccagcacagttcccaaatgtgagaaactgactacagcagaatcgacttgaggcacattttaaatatacacatgaattcctcagactcccccactcccaatttcagagtatgtcaggggtgggacctaaataatttacgtta

SEQ ID NO: 220359 - DNA, 295 bp, Homo sapiens
ggctgttgtggaaatgtgggttttctttgctgtgagaatttatgcgtacaaagagacctgcttttcagaaagaacattgagaacccagagcccaagaggaagggttattaaagttaatgaaccagggtaaccttatccagagggtgcccagaaacactataaaacaaaaggtcaattgctattgctattttagttatataccccctctccaggcttcagaatttaacagggttaatttcctttatagtgaggacttggcaaataatttttaagccagatgaaaattctttaattt

SEQ ID NO: 220360 - DNA, 430 bp, Homo sapiens
cgctgattagcgcggctggttagagccaggactaatgaggctgaggtcacggactcggccccgtagcccaggtagcccggccaccctccaaacggccgctccgcctggtcagctgcctcacagatgctcgctgctgtctggaaaggggccagggaggctcgagccagcagccagcacgggctctttgtgtttaaaaccaaacaaaataaaaacaggttctctaatgtaccaccccctgtgatcctctctaggaatatcagacttaatgatttaaatttaatttgttagccatttggtggttaattttttttattaaaaaaactaatgatttattagcattcttataataagcaacatttaatatctattcatgagagttcaaatggatcaactatttaattttgtaataaaatgaatcagaaaagtatta

SEQ ID NO: 220361 - DNA, 691 bp, Homo sapiens
agcatcctcaggccaggtgctgtctattctcattttacagatggggacactgaggcccagggtggcttggtggcttgtcctcactgctactgagccacagagctatgtctgcccgctccccactaccaactgcaccttcctgcactcagcccaccacctgcctccctcaacactttaatctcacccatgccctcaacagacatttactgaaggcctgcttctaggagggcacagcgtgatccctccaccctccaggcattaagaatgtagtgagaggggccggtcattacagcagcttttccatcaaatcaacttcaggaagtgtcccttgtcaaagtttggggctatgggagtgtggaggcaggagggacttatttcatttgggggaacctagggtcatcttagagcagggcgttggcctgcagcaggcagcggccccaagcatagggaatgcagtcacgcaccgcataaccatgatggactgcatatgtgacagtgctcccgtaagattatactgctgtatttttcctgtgcctttgctatgtttagatatgtttagatacgcagctacttagcattgtgttacagttgcctgcagttttctgtaccgggccacgctgcccaggtttgtagcctgggagtaataggctagaccacagcccaggcgtggagcaggcgctgccttctaggt

SEQ ID NO: 220362 - DNA, 603 bp, Homo sapiens
tgttcctgctatgtccccagcatcgagaatggtgcccagcccgtagcaggtgcccaacaagtctttgctgaacgaatgcataagcgaatgaataaatgatgcaatggatggatgggtttaattacatcccgccctcgctgagaggagctttggtttggggtgaggaagagaaaaagaggaaaaagaatgaagaggcaaagtgggaccatctgggtctgactcatgctctcccgggctctgtctcttccgcctcggccctcctcctcccgctccatttttattatggttgctgacagatccctctctggactagactagaagcgatctgccaccaatttggaaagctcctgtatactgagcatggtttcatcttccctcgatcagtctctgtagaaacccaagccacctccaggctattattatgaacataaattaccatcccattgcagatgagctgcggagtcattaataatgacttctgattgatagaatgacaaataaacccagtttgactgcaggaaaccctcaggatctctcatacaaaaaagacaagtgggttaaaaaaaataatacaatgaactggagaaccaagggaccctgctg

SEQ ID NO: 220363 - DNA, 500 bp, Homo sapiens
atgagcatccattttgaccatggaaaaacctacattatgctactggtacaataaattgtacaccagatcaaaagttctttgagggcaggggccttaccaaagtcatatttggaacccagaaagtgccctggcacattaataatcacgtataatgtggcagaatatattaattctgtgagtgctcagtaaatgtcattgaatgatataagaaaggaaggacagcctttatattatattcatcataaacactggactgaatataagaccttcaacatccacttgtactacaaatgatcagcacctcttccatgtttactcagaacctctctttcatagcgcaaagcaggtaagttattttctttggtctggtttgttttttcaggaaagtcccctcttggcattttgttctgcgcctcaattttctgtgctcctactatcacctgacctcctggaggccattaaccatcctgatcttgtgtcaatggaatattttcctccag

SEQ ID NO: 220364 - DNA, 459 bp, Homo sapiens
gtcttcaatgaattattttgcccattactcttcttatacagaggtgaattccagattggcttgggacaatgactgtttatgctttaaccatctccaaacgcaaataactagcaaaactctttatctcattctagtattaggcactccaagttctgcagcaaatattcactctgatgaccatatggaaaataacacataatttctgctttcttgtatcttaaaatcagaagatgaagccaaaacacaagataaataggaaatccaaacagtgaccccaaaattgtgttttgtgaaagaagaatagaaacacaaaagtggagagagagacctcattaggatgtgagtagcaaagggggttcagtgaagcagcagagcttccgttatgtttataagagggataacatttagagataaatcttaagatagagaaaaaagaagctgatgcaccaagaaagagaa

SEQ ID NO: 220365 - DNA, 325 bp, Homo sapiens
cctcttgttctcatgatccctctgttaatagtgagtcacccaggtcacacagagagtaaatgtgctgagctaggactcaagcccgggttatttagataatgaaatgaaaggatcaggctgagcatggcagcctgtaatcctagcctttgggaggccaaggtgggaggactgcttgagtccaagagttcaaggccagcctaggcaatagaacgagacccccatctctataaaaacaaaaacattagctggtcatggtggcacacacctgtagtcccagctactcaggaggccgaggtgagaggatcgcttgagccctggaggtcga

SEQ ID NO: 220366 - DNA, 345 bp, Homo sapiens
acagaaggttcccttctaagatagggacgccaaggtgggttgatcatccggggtcaggagttcgagtccagcctgggcaagaagagtgaaactctatctcaaaacaacaacaacaaaaagctaaaaaaactatcagtgtaaatttgtgaagttaataatggtactgtgattgattatgtaagagaatatccctaatcttataaaataagcactgaagtatttaggggtaaagtgccgtgttgtatataatctgcttcttaatggttcagggaaaaaaaatcaaatgtataacatacatatataatgtttagagagagagaaacacaagtgcaaattataaaacaa

SEQ ID NO: 220367 - DNA, 282 bp, Homo sapiens
aatgaaaaactgagacttctaattcccaagatagtgtttatgaaattgtgttgcatcttttttcttttctttcttttttaaaagagatagggtctcactctgtacatagtggtacaattgtaactcactgcaaccttgaactcctgggctcaagcaatcctcccaccttggtctcctgagtagctgggactacaggcgtgtgctaccatgcccatttaatttttttatttttggtagagacgcagtctcactatgtgcccaggctggtctcaaactcctggc

SEQ ID NO: 220368 - DNA, 803 bp, Homo sapiens
aaaacctttttatcttaaaattccttgccactgttttggaaaaagaaaaggagagtcgttgttgcaggagatagtatttaaaattatgtgtgcatctatatatgatatggtaatttcctcctcataaaataagcaagtattatctcaaaccttgaaacctagacgcattttgttccagatcaggtagaggaatatggattgggagaaatatttagaattaaaagaaaattttttttcctcagctcgactatgtctgaaagttttaatgattctcaattctggcccagtgtagggctagtcatagagttcatttctggggattcacaaacatagtagactcaaggttattccaaagccttcacacaatgtgaaaatatcagtacactgtctctgggaaagacactgaaatttgtcaaatatttgagcaataagttgttattcacccagcttcttttcagagtgtcacagacacaccgatttagagacatgactctttggcttgaaatgtatgccataaccattaacctgccaaatgtacaaaatatttgagttttctgattttagcaatcatactctgagttttagaaactgggatatgaattttatgtgatcaccttcattgtgtgatggtatggataatgggaaaccactcagtgccaaatatctccttcttattcttgaaattgtacccaaaatgagattatattgttaaaattcatgcaagtaatttcttggttcagacatagtaaattacagatagactagagactataacagcactggatcctaagggacagaaaaga

SEQ ID NO: 220369 - DNA, 542 bp, Homo sapiens
ttgtgcgtaacacggtccctctcgctcaaccccaccccctcaatattgagagctactctaacttacaagaaagcccgacatatgacactgcagaaatgaactagcaccagttaagccaggatagagtagtaacaaagaaattacaagataccaagtcagctgagacactgacacttttaaatgctgaataagagccctctgatttaaaaaataaaaaaataaaaaataaagcttttcccaaacaaaatgtaaaagctacgaaaaatttagagcccagtttataattaagagtgccaatttctgggagtgttcattatttttgacaattcttaaatatgtttacagaaaaaattgtccccattacattttgaggcatgaatttttaggcaacatgcatggacatgagactgccttttatgaagacatttttgaaagtcaatggaaaatgtattttctcatggcctagaaccaagatttctgagacatctatattttgcataatgtgacacatccatttatttattttgagacggagtctcact

SEQ ID NO: 220370 - DNA, 545 bp, Homo sapiens
cactaggttccttaataactcaaatattctaggtgtgctcccatcccagggccctgccatgtgttttctctgcctggagtgttctacccccggaatgtcacatgagtctgttcctttactttgttcaacttcctgcttcaatgtcacaagatcacactatctaaaatagtgtaccctcttactacatcactctatttgttaccctcctttattattattttttttcataatagacatgcttacatgacactatactgtattagtggattgtcctttaggatttttttttttaaccgctgaatcttatacctgaatcagtgcttggcatgtctctgatgctcaataagtgttttgaatgaatgagtatgtattaaatatacgtgtatgcttaaacattgtgatacattagaaacttaacagcaggttgcctgggaagtgagactgagtctagcagtcagatttcttatatccatggtgagtgagagaaggggacattttaactttcatttcataccctaataaagtgtttgaatttaaaaattttt

SEQ ID NO: 220371 - DNA, 322 bp, Homo sapiens
tctgagatgggctttttcttggaggagtcatgattttggagaaaggcatgtagatggctactgtagggtaggaggctgtctagttaagggtggatcattgagggtataagagacagaaatccaacaggaaatgcattggtttctggaactgagaaggccagacatgtagctggatcccgtaggcagggtctgatctcccgccatcgttctctctctctctctgccttcctccatattggctccattctcaagcaggctctcccctcacgggggcaagatggctgccacagctccagactgcctctcagtaatcctggtaaaa

SEQ ID NO: 220372 - DNA, 218 bp, Homo sapiens
ggggcctagttccctgctcagtaagttactagcaatgagacttttcacctctctttcctgctgagtgaggtagcaacttccagcctcctttctttctcctttatccccagaagtaacttaattaactttctgggttagtagactaaatctcaaattgtttttaaaacccaaaaagcagttataaacttaaacattagcttgttggaagcctgatagtc

SEQ ID NO: 220373 - DNA, 408 bp, Homo sapiens
atcccctctcctctcccaaacataaagccctacaaagttcttatttccaaccttagccaaagcttcttagctctcatttctacagcttctttcctcaaaaaatctgctcccagccctcaaaccaaacccatcaaccaacgaacatgttactgtttggtcagctgctcatgtgatcagagcaaggcagtcttaccaagttaagacagtgcccaaagtggctttgtaaaattagccacaacaagtgtaaaatgagccatgaaacagtttttaaagatgcctggacacacctccctcacaaaaaataaacatcaaataatatacacaactaaaagtaaccctcaatccacaaaacaaaatcttccacttgatcactgacaactacagactgttaggagagtgtcaaaatta

SEQ ID NO: 220374 - DNA, 363 bp, Homo sapiens
ttaagtccacacaaaaatctgcacacaagtgtttatagcagctgtattcacaattgcccaaacttggaagcaactgagatgtccttcagtagagtagatacataagctgtggtacatccagacaatggaattctattagcaataaaaagaaatgaggtaccagccatgaaaagaagtggaggagtcttaaatgcatatcgctacatgaaagaagccagactgagaatgctgcacactttaagatcccagataacgatatgacattttgaaaaaggcagccactatggcgcactatggaaatacgatggtcgcgatgggtatgcaagtacaatggttgtgatgggttgaggagagggagggatg

SEQ ID NO: 220375 - DNA, 495 bp, Homo sapiens
ggagaaagttcactttatttacataacttatacgtaaaaatttaataaatctccctgcttcttttcttttgcatcataacaaccactgaaaataatatttctatggcagttgggggtaaatggacaatagcttttgtgaccagaggtgaatggcccagggtctccagcactccaggtcccactgagcctgccccacagctgagggcatcggtatttccacacacctataatgtacagtgccccagaacagagatcggatgctctgctttattcagatggggtgttgagagtattgtcattgtaattgaattagtaagtaagtatttatacactgttaaaatctggttggatttgtgtcccttcacaaaacaaattgcttaaatgaaaccacagagttaacataattgactacatctgcttctatgagctgctgttctaacatttaactagaatctaatttgaaattagtcaataaaaagtttattcaactgaaaa

SEQ ID NO: 220376 - DNA, 471 bp, Homo sapiens
cttttttttttttcctcccttcccttcctccctgcctctttccttccctccttctcttccttccaaccgtctgtccttgttttcctccctgcctctttccttccctccttctcttccttccttccttccgtctgtccttgttttcctcccttcccttcctccctgcctccttccttgttttaagaatttgaaaataaagtttcccaggagttttgaattggagtcgagatttaagtggctgaagttttgcatttcactaggaaaccaacagctttaatcatgaaatgaaagcacagctgggcattgggccagtcacagagtgtcttttgctctgagcacttcacaaacccattgtggaggggaggaaagagttaacataattgactacatctgcttctatgagctgctgttctaacatttaactagaatctaatttgaaattagtcaataaaaagtttattcaactgaaaa

SEQ ID NO: 220377 - DNA, 1038 bp, Homo sapiens
taagatagcatgtggcctattccccgcgcttttccagtggagaaagtagccccagaaatcagaagggtttgtccacaagcatatggctgtctgatgtcatccaaaccagaactaaagcctattgccctagtcgtttcccttctataacctaggcgtatttacagagtcttccttcctgtggtgttgtgtggattagaaaagtagctaagaaaagcacataccttattaaaattcactgcaatagatgataagtctgtagaattatagtgcagtagaagtttacctgtgagatcatctattagaatcccatctttttaaaactgaggaaacgatgcactaccccaagccactaagttaattcaaagccaggaatagatgctatgttccttgacttcttatccaacgttccttccttgtatgtagcccatctctgaatcatgagaggggagaggagagaaaggaaaggagggatattctcactctcttacatatatatgaaaaaatatatatgcctctgtgtgtgtgtgtgtgtgtgtgtgtgtgtacacacacccataataatgtttcagtgaacaacagaccacatatattactgtgatcccatataatataatactgtatttttgctgtacattttctgtgtttagatacacaaatacttaccattgtgttacatttgcccacagtatttagtacagtaatattctgtacaggtttgcagcctagaagcaataggctaccccatatagcctgagtgtgcagtagcctatatcatctagatttgtgtaagtgcactccatgatgtttgcacaaagtcgcctactgatgtatttctcagaacacctccccataagctaattgacgcatgattggagatatatatatatatatatatatatacacacacacatataaatatatatacatatgtaaaatagatacaataaatattttatacacattaatatttttggtatataataatatattacaaatataaaaattttaatatatgataataaaggatttctaaaaact

SEQ ID NO: 220378 - DNA, 330 bp, Homo sapiens
catcctaaactcaaagcaaagtccaactcgtcatcacctgtgacagtgcataagaaagaacatcttccaccaagttgttaaagtggtgtgtgtgtgtgtgtgtgtgtgtgtgtgtgtgtgtgtgtgtgtgtgtgtgtgtgtgtgtgtgcgtgcagatatatctccgggagcactctgtagagaggattacatatcagcacagcatgtgctgtgcactgtctgagagaaacagggttccctagccctaaaataactcgtggaacaaaactccacgagggcgctgacatatacagtggtgccaaagatctatagtggagagaggttcccagg

SEQ ID NO: 220379 - DNA, 416 bp, Homo sapiens
actgttttgttaaccttgttagcttgagtttttgtcactggtgacacaaaagtcctaacgtatcattcaagaatccaaaactagctgaacaggtagataattgggctcaaaactcaacaagataaatgcagcgcttgacctcaatgttaaaaatcaaccgtgtgtccaggaagacttttggggtgctggtaatgttctgtttcatgatctgagtgctgattagttacatgggtatgctcagcacatgaaaatacaactagttttacccttttctgtctgatgattatgcttcaacaaacagttttttgttttttttttgttgttgttgttgttgttgtttttaaatcaggatggggaaaatgtagcttcattaatgggaagctgacttgggggttttgttttcttataaattcaat

SEQ ID NO: 220380 - DNA, 553 bp, Homo sapiens
gccagatcaccttcaagccttctgttcaattctgggtgccacattttgataaaaacgtgataaaattagggcccgtcaagaagtagctagaaatgaaatatgtgaccatgtttaggaaaagatgtttgaaggagtcttggatgattgacttggagaaaagaaaaagcagggaagcctctgtcatgtgagtggaattagacttgctcagtgacagataagaggagaaccaaaggagagaaattagaggaagacaaattgcaactcgaggtgaggaatctctggctagcactttgggactgggtgattttctcctcatcaaaaatattaaagcacagactgaacaacaacccatggggatgcatagaggggactgaagcacatggcagggaaccaggcaatagttggatgtccctgagagtcctacgaccccatgggaggaggcagattggaacaacagttataagattaggagccacctacagggagcaggcagctaaagctacaaataggtaaaatgcccaagataccaactgcagcaagagaaagtaagtaa

SEQ ID NO: 220381 - DNA, 425 bp, Homo sapiens
cactctgtcacccaggctggagtgcagtggtgcgatcctagctcactgcagcctcaagctcctgagctcaagtgatcctcctgcctcagtctctcgagtaactgggactacaggtgtgcaccaccacacctggctacacacacttttacataactgagatggtatgagacacactgggtttatgcagcagtgcttttcttttggtttgcttccaccagatcagcccccctccctgtgtccagcctccagaaacttcacatatacctttctgtaggatactttacattcacataactatataaaaaattacatatacattgtgagcatatgtgtacatagagatacacacacaaggggtaagttttctggttgttgatttataaaactagtgttatataaacttatctgcatcttacaattctcac

SEQ ID NO: 220382 - DNA, 447 bp, Homo sapiens
tttgacttaactttgatctcaacgtctctaggaatcgaagtcaactatgaaaatgatttttattgtgggtaatggtaaaaaagagagagaggcgtgagccaccacacccggccaaaaaaattatttaagtatgcagtaaactcaaagtctgtgtggactctatttgcagggtatgctttttccaagccagatttgatcacatggatggaacaagggagaatgctattaatcagcgaacagggatgcttagataaaacaagaaggacaactagccctcctactgatgaacagttgaacatgaagaatactggaaagttgctatgttttggtgagtaagatggatttaagatcatgaattattttattttcctagccttgtttcctgaatctttctttttggatatctgactagatctagtcaataaaaaaagttgttttgatggagaa

SEQ ID NO: 220383 - DNA, 384 bp, Homo sapiens
  misc_feature (368)..(368): n is a, c, g, or t
ggaggccgtgccaggcagggccggttcgtgcggaaccgccatggccgagccggcttcggtaactgtgacatttgatgatgtggccttatatttttcggaacaagagtgggagatcctggagaagtggcagaagcaaatgtataagcaagagatgaagaccaattacgagacccttgattccctggggtatgctttttccaagccagatttgatcacatggatggaacaagggagaatgctattaatcagcgaacagggatgcttagataaaacaagaaggacaactagccctcctactgatgaacagttgaacatgaagaatactggaaagttgctatgttttggtgacgaaggaactcccaggacanaagaagaggattgccg

SEQ ID NO: 220384 - DNA, 1147 bp, Homo sapiens
gcaattcactttggattttctaatatcccatttctaagaagaatggcagactattgaacaggtgtattttaggtcacgtggggactgcatccacctgaaaatccaccgttgacttatcaggaaactcagagatcaggatctttcacagagtagtcttttaagaagattcagttgtcaacagctagcagtctctttgccaaataattatatctgtgacttctgaaactatttggctgcctaaagttaaaggacttggggaaagtccttccactgctcttctgcagtagtgtcacaccactcagtgcagggcccaccaagaagaaagcagtgtcaggatccacatggcactatggtaactttgtgaaaggggacattttctccctctgaacttctcttcataaagtcattgtgcttcctcttggggatcacctgttcagtctcaatgggctttgatgtgctcctggatcaagtgggtggcatggggagattccagatttgtctgatagctttcttttgcatcaccaacatcctactgttccctaatattgtgttggagaacttcactgcattcacccctagtcatcgctgctgggtccccctcctggacaatgacactgtgtctgacaatgataccgggaccctcagcaaggatgacctcctgagaatctccatcccactggactcaaacctgaggccacagaagtgtcagcgctttatccatccccagtggcagctccttcacctgaacggggaccttccccaacacaaatgagccagacacgggagccctgtgtggatggctgggtgtacgacagaaagctctttcctctccaccatcgtgactgagtgggacctggtatgtgaatctcagtcactaaaatcaatggttcaatccctatttatggctgggtcacttctgggaggtctaatatatggccatctttcagacagctcctgctctcagtctcttgcgtcggtgcctgggtggcttgccgcccacactaattaaactaaagagcttctgcacagcaaaagtaactatcatcagagtgaacaggcaacctacagaatgggagaaaatttttgtagtctatccatctgacaaacagctaatatccagaatctaaaaagaacttaaacaaattta

SEQ ID NO: 220385 - DNA, 517 bp, Homo sapiens
tttcaacacacgtatgagtaattgtcaagagtcagtgagtgctcgagtgtgatgtggtctgtggcgtttgcctcgcagtgttgctttggcttgggataactgggcgacagctcccttccttctgcagctgcctgggagtcccaggagaaccccactgataccatttataaatgctggacatgtgacattctgcttggtgccagcacatctggaatccgacagcgtagttagattcttggtcagcaaacccgtacaggagcgtgtgaactctgcatttgcttctcccggacaaaggtgagttcctggtcactgtgctggatggcaacaggtgtggcctcaggagcaggacagagactggcacccacgtgcaggagtagcatctgcaaggaggtgggggatgtgacagacacaaaaccactgaaatcctgaaagtgcgagctcagctgttaccatggaggagaggcgcaggtaagaccagattgtttctcattgttgcacgtttctgaaaatgacccta

SEQ ID NO: 220386 - DNA, 446 bp, Homo sapiens
gctgaaaagtattgtgtaaagcataaaattcaggtgtaagtactaagaaattttgaagacttacaaacaggcaaggatcaaatacttcttgttacgtaaatcatgttttatttgtagaacattgtgaagcattcataacaaaatctgagattcacctggtttcagtttcaagtaaatgtgaaactcagactggttcagcaaaagttttgccaaggttcataaactttcatcaatgtgggctgatttttttggaagggggtgggaagtaggactatccaataatttttaccatgtttggactagatttctttgcaaatgaaaacatgcagatgaaagccaaaggaggtaaaatgcagacaatcttatgcttactttttataaatacgatctggtgcaaattttctttacacttttaagaaaagttttatgtcctttttggcaggcca

SEQ ID NO: 220387 - DNA, 471 bp, Homo sapiens
cccaccacctgggccgctctggcagcccaccttcttcccatctgctctaaggctctttggagtcagccagcctccttggaaaacgctggagctgagggccgacccgccgccccttcaaggcaaatccctcgagagcacaggttctagacgcccagggcggctggacttagaggcagagcagggaggttccgaaggtcgcctgggtgaggggtgcacagcagaagggccacccaccccaaagcccaagagccgctcagcccagctccctgctggccgagccgcccccggctctgcgcttcctcccagggcaccaaggccttcaacgccaacacgtggggctgtcaccaggggaaaccggaggcctgagctcagcacctctggacccgcacccggctagcctccagcctcccttcaaacttcggtcccttcccggctgtagaggaggtgactgaggcggaagccggcggccgc

SEQ ID NO: 220388 - DNA, 165 bp, Homo sapiens
tcatccagcaaaagctggtagaggaactttggtgtttttccatttccctagtattgtagtgagataattttacacatttgcaaaccttaaataatcctacacaactcctttgtgtttaaattgccctagaccttataggtgaggtttattctccctttacatatt

SEQ ID NO: 220389 - DNA, 414 bp, Homo sapiens
ctgcctcagcctcccaagtatctgggattaaaggtgcccgccaccatgcctagctaatttttgtatttttagtaaagacaggatttcagcatgttggccagcctggtctcaaactcctgacctcaagtgatccatccaccaatctcccaaagtgctgagattacaggcgtgaaccatggcgccaggccagtctttccaatttttgattgttggctgttctctgggtctagaatgtcttccacttatctgaaaatacctctaattgcctttctcaacattttcctgctgtaggaaaagatacaaataaatagcatctactgaacccaggtttcagtatgtgaaagacaagcattctcaatagacaaatatgccgttatacctaataaattccagaaagagagtctaattgtgttg

SEQ ID NO: 220390 - DNA, 643 bp, Homo sapiens
gcactgtactcattgtgaaataacttgatgagaactgacactggctgtcatctagttcaaataatctgtgttacacatttcagatgaagaaccccagttaagaaactgtgttgtgttgtccagactaggaacttctttcatggttcatcagaaaataggattatatttaaagcataaaataattatacttttaattagtccacttcttcacatcatcatatgtggtaactcacatgaatgtaagattaatctcccttttatctactaccctgaaaacattaaaaaaaaaaaaaaccccacactcttctgatttactcagaaaactttagaggaaagtatccatttttgagttgattaacataaaccacaacaaacacagacttggtttactatagctgtttcaaatctcactgcacatgagaatcactggagtaccttgttgaaaatagagacctctaattttcatgttacacccactgaatcaggatctcagtagtggttccaggaatttcctacttttagtagttttcaatgtgatttttatgtactcagcctgaaactaaccagtgggcctacaatttgggaaccatcacttttaatggtttacctgtagttttcatgttttatatgtttggctttggta

SEQ ID NO: 220391 - DNA, 573 bp, Homo sapiens
aatgccaggaacatcggggctttaaaccacacaaacttatcacctgacaggtcaggaggccccaagtgtgaaataagtctcccaggaatgaaatcaaggtgtcagcagggctgcctgccttttgggggcctctagaggagactcccttgcttagcttcttccagctagtagaagctgcccgcagtccttggctgggctgcgtcccccatggtggaagccagcaggcagcatcttccaagctctctgactgcatcttgcctcccttcctaacctgaagacccttgcaatggtgttgggcacacccagaaatccagggtcatcccctatctccagatcctcaatggcatctgcaaagtccctgtgttagtctgttctgaaagtccctgtattagtctgttctgaaagtccctgtattagtctgttctcaaagtccctgtattagtctgttctcaaagtccctgtattagtctgttctgaaagtccctgtattagtctgttctcaaagtccccatgttagcctattctcacactgctaataaagacatacccaaggctgggtaattcataaaggaa

SEQ ID NO: 220392 - DNA, 311 bp, Homo sapiens
gggtagagctgagtgcggtggctcatgcctgtggtcccagctactcaggaagctgaggcaggaggattccttgagccttatagctggaggtttcagtaagctatgatcatgccactgcacgctagcctgggtgacaaagtgagactacctcaaaaaaaaaaaaaaaaaaaaaacatgcagggcaaacaaggtagagaggatgaatgggagtacagcgtagacgagtggccaagagttaattgctaatgaaattttatacacagagattcattgtactgctcactctgcttctgtgtatgcttgaaactttt

SEQ ID NO: 220393 - DNA, 268 bp, Homo sapiens
agaaaacaactttatttgccagtatttttgaaacactgctgagcagtatcttgttcttgtaataccggctgtcaaaatagcatgccgactgcttccttcatcaatagaaaacaaatgcaagattccagagagtcatttttctatttttgtggtctctagccttcttgtaattatttattctcatcattgtatgtgaatagaaacatttctcaattgaaattaatgactgaaggtggaacagaaatacagttttcagtgatgtgctatt

SEQ ID NO: 220394 - DNA, 521 bp, Homo sapiens
agagaccatgtgacaaagtttacttctgatcagcgccacaagtccaagaagtcttctcctggaactcaagacttgctggggattcaaacaggaaccaggaaaaggacatacagatgagtcagcaaatactcactgtacaggaggaccagggttctgcgtatgtggactactccatgacctcatgcaatcacaatgctttaaataacatttgctactaccgcaggggctttgtaaaaaggaaattaagccccaatgaaaaagaggagaaacacagagcacagcatctgacacataataaatttttgttaaatggatgtttgataaagaatgaccatgtgaaagatttagagtttcaaaatataacctgaccttttgtccacattaccatctttatttgtattgggctttatttacaaacttgaaagttattctctttaagtttaacatcttttgccgctgctaccacctgctgtctccaccctgctcaacctcaggcaaattcagggaagattcggagaatc

SEQ ID NO: 220395 - DNA, 539 bp, Homo sapiens
tggcatccccagactccatcctttgacaccttaagccaataaaattgcagccttctgcttgggttctggctagcctgcacatgcaggaaggcaagttctctcagctgaagggccactcagtgcagagctcttctttgaagggtttaatctcttccagtctctgcctgcttttggttgcttctccaatcctatcaaatagatgtcttttatattttgtccagagtttatcattgtgaccaatgtgagggttaaccaattgccaggataagaaccctcagtatagtgtcattttaaaaatgcatttgttgtgaaatatggttagcttttccattaataaaataatgcatttttaaacaaaaataataataaaatgaatgtttatgtgtcagaaaaaaatctgaaaagatatgttccaagttgttatttctgaacagtaggattattggtgatttcaatgttttttaacttatatattttctacttttttctgtaacaaacataggtagaacagtaaagtcctttctttgttctcctgggta

SEQ ID NO: 220396 - DNA, 460 bp, Homo sapiens
gctagtccattctggctttcaggctcagtcacttggtcaccagtccccagtcctggacctactgctactgtccttttatccggtcctccctcgctgtcctcttcagttgcctttgctagggaccggcctgtccctttactacctaagtcatcgtcagttcgcccaacttccctccaaatctgcccctcacggtacgcagggatcgcccttccttcctgcctttggactggtccaggtcctcctccgccctccttcacgcaaaggcctcctccagggggactacctgtccctcagcccagaggtccccctgtccaagcggggtattccaccaggccatatgacctacccacccgacaactgaagggggcgtggatgagctctgtgactctgaatgctactttataaatcgactgtcagcgttttctaattaaaggagctctggggtaaagatcttaaaaac

SEQ ID NO: 220397 - DNA, 472 bp, Homo sapiens
taaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccag

SEQ ID NO: 220398 - DNA, 428 bp, Homo sapiens
tttaaaggttagcagccatttgaggctaagatccggcacagcgaattccttttcccaggcctaggctggtgaaaggctatctaatggctttctaagcagagtgtggaaacatagctgctttggtaaggaaggggcagttcacgaccccatccacaccagtggcctggccaggactactttgcgattctattcctgttcttttaaaaaaagggttccagcttcttggcactgtgtgtgtctggtaccccaggccctctgttcaccctactgaggagatgggcctacagccttcagcaaggagcctcccagctgggaccagcagccctgtctcttccattagctttctaaagtggaaggccagccgcaaacacaggtgcattgagcaacactttgcccacctggcagcatattccaggtcctatgccaag

SEQ ID NO: 220399 - DNA, 390 bp, Homo sapiens
tggattattagtttgaaaaacagtaagaatgccaactgccaaaaccaaacttgtcctggaggtttccacatctgaatttggaagctaacctcctttaggtttaagctactttgttaaaaaaaaaaaaaaaaaagaaaagaaaaataaaacaatggaataaacagccttttttcccctagattctgcaattctgtccatttcatagagccataatgaacttaaaagttaggttttatataaaagagattaaatagacaccatggaatcaaatcttacctgaaggataaattctatttaaacattccagcagagctgtttttctactaaagaaaaatagtcattcccttaaaagcaattctagcacaatgggtatatttggtaattaggcaa

SEQ ID NO: 220400 - DNA, 482 bp, Homo sapiens
tgtcttgccagggggatcatatctgagtctggtcaagattcacattctagctgccaatttgcaggaaacccagaggacaaaggagcgttcagcaaaagctagatggcaggtcaaatgcaaggttcatcaacagataagttgcaagaaaaagagcaagacagaaagaaacttcagatcaaagagaatgtaaaagacaaatcatgcttttaaaaatgtgcaagattaaactacaacatataggaatgcacacttgggtgataaagctataaacacaagggctagagtgagaaatggtgctgtgactgcaatgaggtgtgtggagggggcccctcaggtggctgccaaggctctctttcttgatctggatggatttaggagtgtttcctttatgataattcactaagctacacatttgtcttgtactgttctgtttctctgctttattttacaataaaatgcatatataggtaggtgtatatata

SEQ ID NO: 220401 - DNA, 406 bp, Homo sapiens
ctattcttggaataaggatcaataaatgagtaaagtgccactggctctggtagaaatgaaaatggtatggccactgtggaagacagtttggcagattctaacaaaactacacactgtctcaccatgcactccagctatccagctccttggtatttacctaactgagttgaaaacgtacatgcacacaaccaatgtttgtaatagctttatttgtaattgcccaaacttggaagcaaccaagaggtccttcagtagatgaatggatacgtaagcgttggtacatctagacaatggaataatattcagcactaaaaggaaatcagctatcgagccatgagaatataagtgaaaaccttaaatacatatactaaatgaaacaaaccaactggaataggccatatactgt

SEQ ID NO: 220402 - DNA, 344 bp, Homo sapiens
tgcatattagttctctcaccaattatgttaggcaggtccaagcatcaagtgtcaagatgataaataaaaaataacaccacgtctggagaattgcagagatcagcacctccatcaaagactaaagatgcagggaggatggttcctatcatatcgccatttggctcatatgtataaaaaaccatatggattgtggtggatgactgtgggcttccatcaacttaaccaagtgatagccgaaattgtagctgctaggctggatgtttacctgaacagatcgatacagcctgtggcacttggcatgcagctattgatctgataaatgcattcttttcaatcctcatgag

SEQ ID NO: 220403 - DNA, 520 bp, Homo sapiens
aatgatgcagaccactaaggaagccataaagtaaactatcagaagaaagtgactgaggagatttgcccagcttttcatcactcaacatatcagtccaagtgggacaacagaagtcagttctcctgaataaaaaaggcagcaacattgcaactgtgcctttgacagttcccatataaagcttagcttagaatttatagacaaaccagaatgtactctgggaatagtactcattcttaattcatttttctagaagaatttgtgttgactagaattttaaatgaaacagaaaggggcatgttcctatttaactaaaatcacggtgtgtgtgttattacaagggctagactgtagatggaactaagtggcataacactaacaagagcaattcagtgttatgttcaggttttttacattcctgctagtattttatttcttttaagttcattatatgccactgtgtacttattttaagttcagatatattatatgacaaagttaaccaagaatattttctttcacc

SEQ ID NO: 220404 - DNA, 423 bp, Homo sapiens
tcttaatctttaaagttgtacttgatactgaaggcatttgatgacaagtgatactgtaaaaccagctgcactctggcagggatctagaatcaggaggatgggtgggccaacccattaatcactgtctttagaccacagatagtcttcaagtaagccactgtggagatctaagtcattacacatacatagtcacacattgtagaggatatgaagcatataatgcaaattttgactatatttattttaaagtctttcccaatgattaaatggtataatcctatgtccttcacaaccaaatttgatcttcttgaccttggatgtgccatttgcacacagcatgtggatcatgctgaaaaaggagttactaaatcagaatgaacttagccaatggaatgagctcaaccaaccatttactgtaatggc

SEQ ID NO: 220405 - DNA, 566 bp, Homo sapiens
ctaggagtagcttggaactgggtaagatcttagaatttagagaagccatagcctgaacaccacacacttctcactgaggaagataggggtgataagatcatggaggaactggagaggaatatgaagacagtgcctacaaccaccacatacacagtaaacattctctcttctcagtggttgaagttgttcctgattacagctctcttatctgttctccctttgatttgctgactgatggatgcagtccatttaagaaatgagcatagcatattggaaagagcactagacttagattctagtcccagttctgtcacttaacagctatgtgttgaggtgaggtgagggaagagtacttggatctctggatctcttttaactttaatattctcctctataagggtagaagatgaactagaggatcacaacagtaccatttagttttccgttcagtggcaattttgacatacttttttgagcatacataatctcagaatcctatgcctcaaaactttgattcattggacagatttcaagaaaaatataatttaacaaatgtaataaagaaa

SEQ ID NO: 220406 - DNA, 440 bp, Homo sapiens
tttctataaaagtatgaatttctccgctaagtagtctgagaaattatctctatacaaagagctccgtgggggatttgcagggtttggaagtgaagaagagaatgaaaggagcccctgaacagtttcagtgactctcaggaatttcaattctccattgctacatggcttattattattattattatttttaccaaaacatatgatacccctttctaggccactactgttgctccattttagcgttttcagagaatgttttttcttccttctgattagcctgtttttctgctcctgctgccgctgctgctgctatcctgatgtaagtgcctgtgagtaagcagtgagctccagtgtacagggtttattttttttctccatgattctcaacagcttttctattagaatgattttatgcctggatggtttgactatctttttct

SEQ ID NO: 220407 - DNA, 467 bp, Homo sapiens
ggagatggttgaataggaggaagactggtgagttttatatagtgatgaaactcttctgtgcgatattgtaatcttggatacatgactctgcatttgccaaaacccatagcactttacagaatgaagagttatccttaaagcatgcaaattatcaaaaaatccacttaggtggttgggggatcccaggatagaatgaagaatgtgacaaaaacaatctaactgtatcaaaaatgtataaaacaacttaagagcgtggaaaaaaaagatgctgagctaagtagctctggaaatgattggagtttataaaatgaaagacaaaataaaacacacaaaaacattctgctctaacagaaaaacttaacagaaaaacttgctttccacatgaatacaattaataactctgacagtgctacatatgtatactgcaattgaagagttaataaattcttatggctgataatgggagt

SEQ ID NO: 220408 - DNA, 1176 bp, Homo sapiens
tttttttgagacagtctcgctctgtcacccaggctggagtgcagtggtgcaatcttggctctctgtagcctccacctcccgggttcaagtgattctcctgtctcagcctcccgagtagctgggagtacagtcacatgccaccatgcctggctttgtatttttagtatttagtatttgtatttttagtagaaacaggatttcaccatgttggccaggctggtctcgaactcctgacctcaagtgatcagtccggctcggcctcccaaagtgctgggattacaggcataagccaccgcgcctggctgtgacattcacattctaaacaaagccagctgagggtgtatggaatcaactagtgtgcccctcactgggtaggccccaaactgggagcatgaagaggtgacatgccatctgtagtttcacagttgagggctggtgacaagggaagaagaggggagggctctggtcatgtccagaatggctggcctggctggtgagggtcacagaccagtcatccatggaggtttgcccatggactacacgcaaagatcctaacaaagaggaatcactgttggcaaggccccactgtgtccccagcaatatggaaggaagtgtgggtccatgaagacagtgcctggcagtgtgcagcaggagagccttgggtagggcaggggtttgcacctcatctttcagagctgaggggacagatggcagtttggactctgggctgctcagaggctgccttgtggattttttagttttgacaaaatcagattccccagcacctctgcaagccttctgcaatcctggcccctctcccagaggcctctgtgtactaagtgctgctccatcctcccccatgccacccctccccatacggatccaagctgtttccttatgaggtcaaggaattctagatttgccttctccctaaggagcaccccccacccgttctgtacctgcctcgacactctgccttttatgtcccacccctttgccccacaatcaggtcccaccacagatggcaccaggaagctgaactgtgatggtccccctgcacccaccctgtgggtacctggagcctaagtccagccccattgcagtgcagctccactccagaccactggaagccaggcaggctcctgagcagcagagcctccatcttatacagggaga

SEQ ID NO: 220409 - DNA, 479 bp, Homo sapiens
ccccaggttagagctcatgggggtcaactaagcgagggagggaaggcgaaggcaaagctggccttgcacctggacagcggcctggctcctccccacacctgccttcatttatgactctgaaacatcccccacctgaccaagggagccactctccagttctctcactccaccagggccctccgtgagccaggaccgggtcacatctctcagccaagtctagaagctctggctagaggagaggaagcgtgcagagggtcctctgccaaagctccctgcctggcccgagcccgggcatgctgggattagtgcaacaccgccccagtgtgcctcctctgccttctaccatgccagtttaaaagcaagaagactcccccttcacatcctgaggaaatccccttcctggtgaccaactgatgcaatgaaagtttgaaaagttcttcattttctagaagttcttgaataaacatggacttactaaa

SEQ ID NO: 220410 - DNA, 1630 bp, Homo sapiens
ccaagcccggagctccaacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggttttttagtgctttttggcccaagaatctcagagtgcttctaatcatcacagtagttagtgtgatatgtattgttttgttttgttttgttttgtttttttcacaatctcagccagacctgtggggggacctggggagaaagttgagtgtcaggggacatgatgagccagttggccctgaaacaggaatggggcaaagagaaaggagagccaggagcatttaaaaatcagcatctgggccaggcaagatggctcacacctgtgatcccagcattttgggaggccgaggcgggtggatcatgaggtcaggagatcgagaccatcctggctaacacggtgaaaccccgtctctactgaaaatagaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaaatcagcatctgccccagttgtggccaagacactctgacctcagggctcagcaccttcaccatcaagttcagcctgagccaagctcccagcccactgctgaaaagcccctgggcctccctccgcaggcagagttacaaccgggagggctgggcagggagggcaggaattgcctgcggaaggcaaagggaatggctgcccctcccaggctggaaacaagagggcaagcggggtcagcaggagaattcgggggcagggtgagtgttaagagaaaaagagtagagaagagcctgaaaatcagcaacttccagggcttttctgatctggaggcccaagagcaagggtggaggggcgcagattgtcaggtcccgaaatgtgtgttgacacacatgggcttcgggttagctggcctgacatggagatagagtgccaatgttcccaggccacagaattatggaggcctcacccacagtattcacagctctcaactggcctttgagaatggaagccttttcctgccctggatatggcgcttcttcctgggagaggagcagagccacagagaggtaggaagttgaggcagagcaaagggaaggcttcagagcttaggcccggttcatctcagatgtgttttctaggcctggggctgaaaggaagaggagtggggcatgcatgctgggattagtgcaacaccgccccagtgtgcctcctctgccttctaccatgccagtttaaaagcaagaagactcccccttcacatcctgaggaaatccccttcctggtgaccaactgatgcaatgaaagtttgaaaagttcttcattttctagaagttcttgaataaacatggacttactaaa

SEQ ID NO: 220411 - DNA, 1355 bp, Homo sapiens
ccaagcccggagctccaacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggttttttagtgctttttggcccaagaatctcagagtgcttctaatcatcacagtagttagtgtgatatgtattgttttgttttgttttgttttgtttttttcacaatctcagccagacctgtggggggacctggggagaaagttgagtgtcaggggacatgatgagccagttggccctgaaacaggaatggggcaaagagaaaggagagccaggagcatttaaaaatcagcatctgggccaggcaagatggctcacacctgtgatcccagcattttgggaggccgaggcgggtggatcatgaggtcaggagatcgagaccatcctggctaacacggtgaaaccccgtctctactgaaaatagaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaaatcagcatctgccccagttgtggccaagacactctgacctcagggctcagcaccttcaccatcaagttcagcctgagccaagctcccagcccactgctgaaaagcccctgggcctccctccgcaggcagagttacaaccgggagggctgggcagggagggcaggaattgcctgcggaaggcaaagggaatggctgcccctcccaggctggaaacaagagggcaagcggggtcagcaggagaattcgggggcagggtgagtgttaagagaaaaagagtagagaagagcctgaaaatcagcaacttccagggcttttctgatctggaggcccaagagcaagggtggaggggcgcagattgtcaggtcccgaaatgtgtgttgacacacatgggcttcgggttagctggcctgacatggagatagatgtgcctcctctgccttctaccatgccagtttaaaagcaagaagactcccccttcacatcctgaggaaatccccttcctggtgaccaactgatgcaatgaaagtttgaaaagttcttcattttctagaagttcttgaataaacatggacttactaaa

SEQ ID NO: 220412 - DNA, 1618 bp, Homo sapiens
ccaagcccggagctccaacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggttttttagtgctttttggcccaagaatctcagagtgcttctaatcatcacagtagttagtgtgatatgtattgttttgttttgttttgttttgtttttttcacaatctcagccagacctgtggggggacctggggagaaagttgagtgtcaggggacatgatgagccagttggccctgaaacaggaatggggcaaagagaaaggagagccaggagcatttaaaaatcagcatctgggccaggcaagatggctcacacctgtgatcccagcattttgggaggccgaggcgggtggatcatgaggtcaggagatcgagaccatcctggctaacacggtgaaaccccgtctctactgaaaatagaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaaatcagcatctgccccagttgtggccaagacactctgacctcagggctcagcaccttcaccatcaagttcagcctgagccaagctcccagcccactgctgaaaagcccctgggcctccctccgcaggcagagttacaaccgggagggctgggcagggagggcaggaattgcctgcggaaggcaaagggaatggctgcccctcccaggctggaaacaagagggcaagcggggtcagcaggagaattcgggggcagggtgagtgttaagagaaaaagagtagagaagagcctgaaaatcagcaacttccagggcttttctgatctggaggcccaagagcaagggtggaggggcgcagattgtcaggtcccgaaatgtgtgttgacacacatgggcttcgggttagctggcctgacatggagatagagtgccaatgttcccaggccacagaattatggaggcctcacccacagtattcacagctctcaactggcctttgagaatggaagccttttcctgccctggatatggcgcttcttcctgggagaggagcagagccacagagaggtaggaagttgaggcagagcaaagggaaggcttcagagcttaggcccggttcatctcagatgtgttttctaggcctggggctgaaaggaagaggagtggggcatgcctgggacgggaactgcctctgtgggctccccactcccagggaaggggctccataagctttgctcctgggctggatcttgagaggtgggcagggtcttcccaccagtggcagggtgtgcagttgtggtcccaagccttggagggaatggggaatgggctggcacccggctcaggg

SEQ ID NO: 220413 - DNA, 1309 bp, Homo sapiens
ccaagcccggagctccaacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggttttttagtgctttttggcccaagaatctcagagtgcttctaatcatcacagtagttagtgtgatatgtattgttttgttttgttttgttttgtttttttcacaatctcagccagacctgtggggggacctggggagaaagttgagtgtcaggggacatgatgagccagttggccctgaaacaggaatggggcaaagagaaaggagagccaggagcatttaaaaatcagcatctgggccaggcaagatggctcacacctgtgatcccagcattttgggaggccgaggcgggtggatcatgaggtcaggagatcgagaccatcctggctaacacggtgaaaccccgtctctactgaaaatagaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaaatcagcatctgccccagttgtggccaagacactctgacctcagggctcagcaccttcaccatcaagttcagcctgagccaagctcccagcccactgctgaaaagcccctgggcctccctccgcaggcagagttacaaccgggagggctgggcagggagggcaggaattgcctgcggaaggcaaagggaatggctgcccctcccaggctggaaacaagagggcaagcggggtcagcaggagaattcgggggcagggtgagtgttaagagaaaaagagtagagaagagcctgaaaatcagcaacttccagggcttttctgatctggaggcccaagagcaagggtggagggatgctgggattagtgcaacaccgccccagtgtgcctcctctgccttctaccatgccagtttaaaagcaagaagactcccccttcacatcctgaggaaatccccttcctggtgaccaactgatgcaatgaaagtttgaaaagttcttcattttctagaagttcttgaataaacatggacttactaaa

SEQ ID NO: 220414 - DNA, 364 bp, Homo sapiens
acacttaggattctgcctggaacagctcaataatgagctcaataacattttattttattttaaattttattttaagagatagagtcttgctgtcacccaggctggagtgcagtggtgagtcatggctcactgcagctttgaacttctgggctcaagagatcctcttaccctggcctcctaaagtgctgggattacagctgtgagccaccacaactggccttcaaaattaataaaggcttaagaattgctttgttgtgctgtgcttgcttcagcatcacatataaataaaaattggaatgagacagagaaaattagcacggcctctgtgcaaagatgacacataaattcataaagtgttcatatt

SEQ ID NO: 220415 - DNA, 244 bp, Homo sapiens
ttcttttctttctgttccttagactataatctcaaccgatctatcttcaaatcctctgattatttcatctgcattctagaatctgctgttgagcctctctttaaaactttcatttaaaaagtgcttattgattagttcagtgattttcatcctttctggatgtttctgactgatttttatcctgtttattgctcatattttattgtactttacatgtgtaatacccttttattgagtcttgaac

SEQ ID NO: 220416 - DNA, 387 bp, Homo sapiens
aactattactatattggggcctatctttctctagctctaatatttgctttatatatctgggtgctccagtgttgggtgtgtatatatttaaaattactatatcctcttgttgaattgacccctctatcattatacagtgaccttctttgtctgttcttgtagttttagtccttgtcaggaaaaaaaacaaaacaaaactcgctctgttgcccaggctggagtgcagtggcatgatctcggctcactgcaagctccacctcccgagttcacgccattctcctgcctcagcctcccgagtggctgggactacaggcgcccgccactgtgcccggctagttttttgtatttttagtagagatgggcttttactgtgttagccaggatggt

SEQ ID NO: 220417 - DNA, 365 bp, Homo sapiens
agagagagagagaaagaaagaacagtcaaaaacaaacaaaaaaaaaaaaaagaaggaatggacttctagcaagtttctttgcctcctgcatgcaagacccatgcagctgcttcttgaggcttgctttgcgtagggccaactttgtccacataaactcaccaagagattttttccattatgatcccattgatggcaccaatcaatttagtttaaactcattcttagttagtgatgaaagatgaaaatcttaatttctgtgcaagctgttttgcatactgctgattagaatgcatgcattgaaaacgaacaaaagaaatctacaaaaacaaatataccttttcattttgctgtacattttaccacag

SEQ ID NO: 220418 - DNA, 665 bp, Homo sapiens
gagccagggtctccctctgtcatctaggctagaggctggactgcagcgacatgatcataactcactgtaacctctaactcccgggctcaagcaactctcctgccttagcctcccaagtagttaggaccataggtgtgcaccaccatgcccagctaaaaatcattttgggtccaggcacacagtggctcacgcctgtaatcgcagcactttgggaggccaaggagggcagatcacctgaggtgaggagtttgagatcgtcctggccaacatagtgaaaccccgtctctatgaaaaatataaaaattagctgggtatggtgacacacacttgtaattgcagctactccggaggctgagacaggagaattgcttgaacccaggaggcggaggttgcagtgagccaaggtcacgtcactgcactccagcctgggcaatagagcgagactctgtttcaatcagtcaatcaatcagtcaatcaatttggtagagatggggtcttgctatattgcccaggctaatctcaaactcctggcctcaagtgatcctcctccctcagcctcccaaagcactgggattacaggagtgagtcaccgcacctggcccagtttcacaagttcacacagctatatattagccacataatcatgagatagaaaaacatttctg

SEQ ID NO: 220419 - DNA, 507 bp, Homo sapiens
ctatttatacgtttataattcctctaggttcaaactcctgctttcccaaagctcattctctaacacctaatctatcacaatagtctaactggttttcctattttcagaaccctcagatctctctcctttacaggagatgtcggtaaactttttctgtaaaggggcagataacaaatattttagactttgcagacagtacagtctctgctacaagtaccaactctggtcatagcacaaaagcaatcatagacaaaatgaaaatggacatagctatgttccaataatactttattttaaaaaatatttggcctgtgtgccatattttgccaactcctgctctaaattgatgtcaacataatatttttaactggcaaatcaaactgtctcactcccctacccaatctgtgagatctaattctctatttctattacctacagaataaagtcaaggcttcctaatagagtaatataaagtccttcaagatctggcacttgatactctctggc

SEQ ID NO: 220420 - DNA, 432 bp, Homo sapiens
gcagattatatcaaaagtctggacttaagaggacctcgacagagaatcacccaaaatgcagggaatcacaaacataagtgattaacttattgatctggaggactagctccttttccgctcttgctggtttttcttatggttaggtatcttcctatcccgccccctttcaggactctactaaacgtccaattatcttttgtacttttatgtctctactggtacccactgcaagacctagcacagggcacactgcacaaacagcgcgatgctggccaggcgcggtggctcactcctgaaatcccagcactttgggaggcggaggctgggagaggcgggggaaggagggaggattcgaggccaggagttgaagaccccaaaaacaacaaaaaaaggtgcaatgcttgctgaataaatatgctaacctgctggact

SEQ ID NO: 220421 - DNA, 407 bp, Homo sapiens
cgtgatctgcccgcctcagcctcccaaagtgctgggattacaggcatgagccaccgtgcctggctgggaacgacatctttatagaggacctactgcaaagaatccctccagacagggtcagaacctggacagtggatagcttgggtctcctaataagggtgtttctttttcttttttctgagatagggtcttgctctatcacccaggctggagtgcagtggtgccatcacagctcactacagcctcgacctgctgggctcaagtgatcctcctacctcagcctcttgagtagttgggagtagctgggagtagctgggaccacaggtgtgcaccaacacatctggctaattttttaaaaatttttttctagagatggtgttttgccatgtttcccaggctggtcttga

SEQ ID NO: 220422 - DNA, 531 bp, Homo sapiens
agctcctcaaggagcttgccacagggtggaggtgacaggtgacatgaatggaagtaactagtagttaccaaatacttggtgtgagccaggcactttgcatttcttcctctattatttctgtgagttaacagtaattgtactaatcttaatcccattgtttgaaagattatatggcttacccggggccacttagctaataaaggaacagagaagaggggctgggcctggggccgctgtttgatccacagccttgttcctaaccactatgccctgtggcctctcacaccaaaaggaagtaccaaactgcttccttactcaaataaatgtgctgaaatgcagttgcagttttctcccagtcccttaggagctggttagagagtcccttaggaacttgagagggtagtgtagtctaggtggtaggcacagatgtctgagagctttaacctcagtctggaagacaatgtggtgacttaatttgttgagaactatgttacaaataatgtgttactaataaaacattgaggcttcgca

SEQ ID NO: 220423 - DNA, 413 bp, Homo sapiens
tccttggagcagtcgggccatcatgcactggcttcagccaccctgcggagaataggaattcctccgagcatgctcgtgccagcctcttgccataacctaccagaatatccgtgattgtcaccactaattgacttcttgtaaagctagaattaaacttttaaattcactcccttcttttgaaacatgaggagcatgctcctgaaatttaacacaggaggcagccttgctctcctctgtagaggatttgctgcagggagcagggcagggattgcatttgtgcatgtaaattgcatttgtgtcaaaggaattttgtaaaatgttaaaattttggtcaaaataattcaagaaaatgatattaaaaaacagaatagaatgatgaaaaactgctatttcatgtcctgcttcttttcagc

SEQ ID NO: 220424 - DNA, 972 bp, Homo sapiens
aaagggagcttcaccttgtttcaaatgttgagtgtgagtgctcatgctgtgcctccagtgaatcacctactgcctttggaagagtgtcctaatgactgggggaggtgaaactgacaggctaaggattcatgtggggttacaaggcttgctcagaaggactcttatcagaaggttggaaactgatgaagtccagcatggatgttgcatttcttggctagtctgtctgaggttggctggagtcctgctcatatagctgagtttgttggtgaattttgtctcctccaacagtgaaagtctttgacttaacagggcagcctgttgcattctatagaagtcccagatgttggctccagagtcttacatgctttggtattttttcttaaaagcataatagggaagaaaccacaagtaaaggaagtagtttgattttaggatcatacatctgaaaaattaagttaaataactgatatatctttaggggctgataatctattaataaaagccttgaggtttccaagagttgcatttagtgagagcataataagggcaatgtatttgtaatgagataatcaaacaaggcacggactgtgtcactccaggagataatataaggtacaaattgtgcaggtggtgggatactggagggtggccttttccacctaattggaactccttaggaagagctgacaattattgagaggctggtagcttgtaaagaattcatttactagaagtgaaggcagaaggattttatgatcttgactccacattttaggtggcactggataaaggaggaatttatttatttttatttttatttttggagacagagtctcgctctgttgcccaggctggagtgcagtggcgtgatcttggctcactgcaacctccacctcctgggttcaagcgattcttctgcctcagcctcctgagtagctgggactacaggcacgcaccaccacacccggctaa

SEQ ID NO: 220425 - DNA, 517 bp, Homo sapiens
aggtttttccagcatcatttgttagactattcttacctccatggtgattcttggcgccattgtcaaaggccagctgactgtatatgttaaccctgggacttctgtaatattggatcatactgataaacctaatttctgacaaattcttcctcatccaattcatgctccccattctgaacaccagcatcatgcatcctttgctctgttctaggcacaacaatcaaaagtgcttattcccaaactggacctgacttcagccagagcattgctgggacatatataaatctacgtttaatatttgaagacttgccagactgtttcctaaaacacctgcagcattttacattcccaccagcaaagtacgaaaagcttccaatttctctacatcctcaccgacaatcagttttttattttaaatgctatagttacaaagaaaagttttagaatgaattaatgctgtgattttaatcacaaagattaattttgcaataaaaatccctgataattatgattatat

SEQ ID NO: 220426 - DNA, 542 bp, Homo sapiens
ataattttaataacactggatccttatattaaaccatttttggtatcttttagggatagtacttggttttctttccattcatcatttccccaaaacctaaagcatgatttcccatggttacaagctactacattgtatgaatatataattattgggagtctctgtgagcctactctgactcagaaagccgctcctaaagaagaaaaaagaacaaacaaacaaataaaaaacccgaattatttttaaaactctttattttggatttttcagtttctacattttgttactgtagattttactagattgaacagccttatccataaatatttgcatcaatctctaaatttttttcttcaacactaacttttatagttggaattttgggggcaaataatacaacattttaaaggcacttgccatgtgtacatggccaaatgcttccagaaacatttccacttccattagcaaagtatataactacagagtatttaaggttttattcctttatatttttttctttggcaaaattgtctatagtagaa

SEQ ID NO: 220427 - DNA, 405 bp, Homo sapiens
catatatctatatacatgtagaggtaataatggtagctattttatggagctgatctgaggataaaatgaaataatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctca

SEQ ID NO: 220428 - DNA, 267 bp, Homo sapiens
ccaataactgcttccccttcagaagttctacattccacgagctcccagcactgctaccagctcccccagacagcaggcatctggccacatggggtgtctgctaaaaaagccactcttggctggggtgtggtggtgcacacctgtagtcccagctactcaggaggttgaggcaggagaatcgctcaaacccaggaggcagaggtttcagtgagctgagatcacaccatcattgtacttcagcctgggtgacacagcaagtctcaaaaa

SEQ ID NO: 220429 - DNA, 107 bp, Homo sapiens
catacaagccaccttcccaccacccaatttctccaccctttaaccccgcaccccaaagcccgcccctgactccgcacccagagcggcagtctcaccactgcggccgc

SEQ ID NO: 220430 - DNA, 541 bp, Homo sapiens
ttagtaaaaacctgtgggagtatgccacaagatgatcttcgccgcctcggccttccaaagtgttacaattacaggcgtgagccaccacacccagcctggatttttaaatttgagatttcttctggtgctgtgatgtttagaaggccttcaccatccagagattggttaaatactcactttcatttccttctgatttttaccgttttacactttatatttaattctttaatttgtattgaacttactttgaagtaccaaaccaatatgtttaatgcctttgtatatctgagttccagatctgtatttccagctacctgttaggctatgtggatagtccctgtacgccatgcatctgcgtacacccagattcactaaggagaaagcttgaggttgtacttaccactttaatacttttctccacccacatttgatcaatccccaagtttggctgattctgccccaggggtgataagagttctttaatcagtcttctaattcagattccccttttagttttttgccagagtccttgagtccttga

SEQ ID NO: 220431 - DNA, 409 bp, Homo sapiens
tctactaaaaatacaaaaattagccaggtgtagtggcagacacctgtaatcccagctatttgggaggctgaggcaggagaatcgcttgaacctgggaggcagaggttgcagtgagccgagattgtgccattgcaccctagcttgggcaacaagagcaaaactccagctcaaaaaaatatatatatatatataactgactcacgtactcccatttcacaaatgagagacatgaagatgaaataggtgaaatgggagaatcactgctgacttttaaaggtggtgggatacatagggcacattacttgattttagcagtcatgtttttaaggccagcaggagaacacctaagaggtggaagaggatcacaaaagtaggtctggcaatcctggtagtaacttctatggttaga

SEQ ID NO: 220432 - DNA, 309 bp, Homo sapiens
tgtgggcatctaacccagactagagagaggcttcctgaaggaagtggtaacagaaatgagccctaaagaacaggcaagaattgggggaagagaggcatgtggagtgtgttgcatgcacacgcatttgcaagtgctttattctagaaggtgacagagaagggagtgaattcagagaactgaaatgaatctgactgagaactgcaggtcaatgtcacacatgaggctggagaagcaaaataggcctagagggctgcactttgttctgggagcaggagattttatgaaattgagcagtatgttcagacttac

SEQ ID NO: 220433 - DNA, 411 bp, Homo sapiens
attatttgaatactagtttctgtgatcatgttataaattgttatggcaaaggactgcttcttggatcaatcaaaacctacctcttttctattctaataggattgtagacttagttttccaaggtagtaattattttgataatcaagagaccagatcaagtgaccagatctctccaataggagagatttctattttagttttttttttttttggtcttcccaagaaacatgcatatttcatgccatcatcaaaatgattccctagcataactacaaaagcagtaaatctgatggctggaatttcaagcgggataggaggagaggaccttgccttagcaggctggtgaaagagatattttgggagaggtggggcttcgggatgcttctcaaattgcaatgtgttggcagccga

SEQ ID NO: 220434 - DNA, 317 bp, Homo sapiens
agccttcagtcccgcagctccattccatctgtaaaggcatcggattcctctgctcagactccttcaagggcacccccatccactaccaactgcagccaaactcctcagcttcacgatctggcccctgtgctcttgccaatttgaaactggaaagtggcctggctgtttcacttgcatgtccttgattgagaagatcgtctatctcagtttttatatgtgtggatgagtttctttctgtttttttttttttttttttttttttttttaagggaaaaaaaaaaaggaagagttttcgggggggaaaacttattcccttt

SEQ ID NO: 220435 - DNA, 364 bp, Homo sapiens
ctgttatccatgctagagtgcagtggtgtaaacacagctcactgcagccttgacctcctggactcaagcgagtctcctgcctcaacttcccaagtggtgtggaccacaggcatgcaccattatgcccagctaatttttattttttatagagacagggtcttgccatgttgcccaggcttgtctcaaactcctaggctcaagcaatcctcctacctcagcgtcccaaagtgctgagattacaggtgtgagccatgtgcccagcccagtactaggatcctattaccgatagatattaggcaagaaccttgagcgaaaaaaaagccaaaatgtcgtcgacgcggccgcgaatttagtggtagtaggc

SEQ ID NO: 220436 - DNA, 277 bp, Homo sapiens
taaatgtacagaaaaaacttcaaaaaggacacaaagtaaatcatttgcagtggtttcccagaaagtagtaggtggggagaggcagatggtaaagagatagggaggtattaaaaataagtatttaagactttttgtgattttaatgccaaatataacatttgaatagaaataatgctccttgacagaagtaggcaagctatcatgatatatattctctggtgggtttttctgtttggttgggttttttttttttttgagacagagtttccctgtgtca

SEQ ID NO: 220437 - DNA, 658 bp, Homo sapiens
tcttaacaactaatacatgattggttgagctggaatttaaacaagtgtagtttgagctcctgctctgtgccaggctctgtgctgagcattgacaagcctaagatggtcccctaacctcatggaaatagagctgagggagtctgacttcacatctgatgctccttcacagtcaggagaagtaatatgagtgaggacttggcaggctactagttatctgcttttgttcttaccacttgacagctctggtttcatctggattatgggctttaggaatgttaccccacctgtcataatttatacctcattttgattcatgactctgggttagcattccagagtagagtaaacataaatgcagaaagtggagatagcatgcatatggcctgttttcaagttatacaactacagcaggggtatccaatcttgtggtttccctgggccacattagaagaagaatagtctggggccacacgtaaaatacacttaacactagagatagctgatgagctaaaaaaaaaaaaaaaaaaaattgcaaaacaatctcacagtgttttaagaaagtttacaaattcgcattgggccccattcaaagccgtcctgggctgcatgcagctcatgggccacgggtttgatcgagctaacggtagcgagctcgatt

SEQ ID NO: 220438 - DNA, 420 bp, Homo sapiens
cctgcggtgaaagcagaaaatcaagttgtcacccagggtgcagtgataaagccacagcctcatttctctgttggtgccctataatagcaaatgccagacagctggatggatgggaggctttggattaaggccttgatgcactctggccagagaattagtagttgctgtttccgtgtgcatatcctgttcaaaacaaacatctggagagaggcaagtttcctgggacagaaatgtcctttgcttcttctagaatcaaagaaaacagccaaaggagagtggtatttcctttctcataagattccaactctaaatttgctatgaactttatcaaggacctagagctatgtgaagtttaagaagttggcaaaaagtccaggaccaagacaaatcttggggaaaaaaaagaaaaaaagaagaaaa

SEQ ID NO: 220439 - DNA, 468 bp, Homo sapiens
atggcctgagctttgggggtcagacccagctggattcaaatcccaactctacaaccttggggaaatcactttgcctctctgagcctaacttcctcatctgtcaaattgggattaaaaataaccccatttaagagtcacagagaatacatgtgcagggcttagtccacagcgggtatttcacacatcatagctggtttttgtggttcaaggctccccagcacacccagtgcggtgtcttcagtccattcccaagctgggttactcagtccatttttttgctcttccctgcctcttccatagcccttgccctggctccggcccaggcctctggcttctgagggtcttagggcctgagtgtccctggagacttggaatagatccatggacttctcaggattccagccaccattcaagtcaggggctctcattcctggctgtacattagaatcgttgtttttttcaccaaaa

SEQ ID NO: 220440 - DNA, 801 bp, Homo sapiens
caattgacccagacccttcaggaatgaaggttcaccccaccagacgcatgtaacatttggtgctgaaacccaagacaggggactccttcagaagaccagccccctgtcctcaccctcagtccgggaggagatccacctacgacctcgggtcctcagaccagcccaaggaacatctcaccaatttcaaattgggaccccactggaagtcggaccatccaacttggattacagctgctcctagacctactggagcaaaaagctaaggctcctggctgattccttcccagatctcctcggcttagtggctaaagactgacgctgccaaatcatctcggaagccccctggaccatcacggatgccgagcttcggataactcctacagtggaggacaggaatgtcaggcctgtgagcccaaagtaagccatcataacccctgtgacctgcatgtatacgtccagatggcctggagcaactgaagaaccacaaaagaagtgaaacagccagttcctgccttaactgatgacattccaccattgtgatttgttcctgccccaccctaactaatcaatcgaccttgtgacattcctcccctggacaatgagtctcatgatctccccaccctgcaccttgtgtcccccatccctgcctgtaagagataaccacctttaactgtaattttccactacctacccaaatcctataaaactgccccacccctatttccctttgctgactcctttttcggactcagcccacctgcacccaagtgaataaacagcctcattgctcacacagagcct

SEQ ID NO: 220441 - DNA, 484 bp, Homo sapiens
tctccgtcagcatgccacatgtcagggctacacagcctagtccagcaccctctgccatgtcttaaagatgttttactgatgtccaacctgcaactgtgccttcagcacccaacacctctggttaagtctgttgatcctggcagtggccagctcttatcagggttcttaatggggaggggaagactctgccccaccaggagatatttggcaatgtccaagacatttttgattgtgacagtaggggaggggatgctactggcatctggtgggtagaggtcagagatgccactaaacatcccacaaggcatagggaacccttacaacaaagaattgcccagacccagacatcaacagtggcgaggcagagaaattccggcttttggggttatctataatgcagagttcccaaccgactgaatgggactctggcactgtttacatttgcagtccttcccaagagaagttcaccatgatgccaaaggca

SEQ ID NO: 220442 - DNA, 477 bp, Homo sapiens
cttattaacattctttgatgattcttatggtgttgttacagtaaaacatttctaacaattattctaacaattattcttgatggtgtatatgaagaatttattgtcgtgtatttgtaagctgctatgtgcagaagaatttcagtcaaataaagttggtaagataggtatgtaagtaatatgaaaaaagatagaaggtgatgagtgacttaggtataaattaagtacaatagaaatgttgaggaaagaaaaatttcttgtaatagaaatcggaagtacaaactgggcatggtggtgtgcatctctaatcccagctccttgagaggctggtatgggaggatcactttagcccaggagcttgaggctgcagtgaggtgtgatcatgtcaccgcactccatcctgggtgacagcaagaccgtctctctttttttttttttttgagacggagtctcgcctatgctggagtgcaatggcgcgat

SEQ ID NO: 220443 - DNA, 422 bp, Homo sapiens
aatccacattcttctgtcatgacttcagccggtccctccgtttggggtccctgacttcccgcaacaaggggggccttcctgggcccccaagagtgcaaggatgcctgggtctgcagccacggtttgggcagctggagctgtgcctgggagggtggagctcccacctgcccctctgggccctgagagcacagggatgcctgggtctgcagccacggcttgggcggctgcagcagcatccaggaagctctcaccccaacttggaaggggcgggtctcgcgcttgtccctggcttttgccttctccatggagcatgcagccctggccatgcctagttgctgcagccagcgtgatggcagcagctgctccagatggcctgctgctgccatcattaatatgtagctattaaacacagttggtgaatc

SEQ ID NO: 220444 - DNA, 487 bp, Homo sapiens
cagcaccccctctccaaaaggtggcactccgccccctcttcagagaactcctctccccacgtctgtctccagcctaggcctcccctctgagccccagactcaacgaagcaacagccccgtcctggacataccccaggcacctcacaccaccacgtcaaaaccaacctcagcatcacccgaaatcccactcctccacatccccatctcaggggaaggccagctgtccaccctctcacccgctcatgccccaagacccacctgatgtgcctcctgaacacgcctcccactcagcccctcctctccaaccccgaagcccccagctgggtccaggcccctcctcacctgcctcggcccagcaccagggcacccagactccctccctctaatctgcactccgaagcccaaacctgagcctgccctacccttcaaatgaccctcacctaccagcccccagccccggaaaccctttaggaccagagtctggtgg

SEQ ID NO: 220445 - DNA, 496 bp, Homo sapiens
tgctgggattacaggggtgagccaacacgcttggcccactagcccttttaaaaggtgctaatctcatccatgagggcagagccatcatggtctaatcacctctcaaaagccctacctctaaatactgttgcattggaaattaagtttcaaaatgacttttggagaggccacaaacattcaaaccacagcatctacggaacaggttttcatggagaacagtattcttttgctgaattaaagaaaatagaacaaaaggtagaaagtactgtcccccactccacccctattccaggaaaaactgaaaagagctgggcagcaaaagcatccacatgttcaaatagtggattctagctaatgggagagtatgtggcttccagagggcttgggaaggtggggtgggggtcagacacctactgtagagatgctcacatttatttctttcaaatattagtctctactcaagagggttttttggaagaaagggttccacagctga

SEQ ID NO: 220446 - DNA, 651 bp, Homo sapiens
actttcttaataaacttgctttcgctttacaaaaaaaaaaacaaaactttttttatatagtgaaaactgaaatgtaccaagtgtgcatcatgtggagaacacctaaatacagttgacctttgaacaacatggggtctaggggtgccaacccccatgtggtctaaaatccgaggataacttttgagtctcccaaaacttaactactaatagcctaccactgactataagccttactaataaaaagagctgattaacatattttgtatatgtattaacactgtctatttacaagaagaatcatctatctgaaatggcaggtaattgcagttgcagacctcaatttacaatatgtatcaaggaattctcgggagcacttccaggatcactagtggcacttcttatgggtttccatattgcattaaagatgatgaaaaaatatggaggcacctcaagcaataactttttactgagaaaagcaatttacttactggagagacaaactgctcacgtggggatggttagtatcacatggccttgcaacacttttcacagtaacagcaacaggaagtggctatgaaattattgtatactgaatatatagaaaataatggcaaaaactgcaattactttggcacaacctaatagtactac

SEQ ID NO: 220447 - DNA, 506 bp, Homo sapiens
tagtcaatgaaatctctttaggctaagcttgggctgcattctgggtctcccaaggctaagactgttaaaagcatgtgcattctgttccctcctgccttccggtccattccagttcacagtcttggccaaggacacttagctgctaagtggaagcagtcaggatttgggctcagtggaccaagcaggccttctagggttctccagcttagaaacagggtggagagggcccggcgcggtggctcatgcctgtaatcccagcactttggaaggccgaggcgggcagatcacgaggtcaggagattgagacaatcctggctaacacggtgaaaccccgtctctactaaaaatacaaaaaattagccgggtgcggtggcgggcgcctgtaatcccagttactcaggaggctgaggcagggaaatggcgtgaacctgggaggtggagcttgcagtgagcccagatcgcgctactgcactccagcctgggcgacagagcaagactccgtctca

SEQ ID NO: 220448 - DNA, 350 bp, Homo sapiens
acactttctggagattaacccattgctcctggcaccacagatgaggaggcagcataaaatatggaaagagccctagccttggaatcaaaagctgtgggttcaagacctggcacatccatcctgtaccatctccaagccttgttttcttcattttaaaatggagatgataatacatgttctattgacctcacaagtttgtcatgagcttcaaatgagataatgcctgtagtcccagctatttggaaggctgaggcaggagaatcgcttgagcccgggaggcagaggttgcagtgagccaagatcgtgccattgtactccagcctgggcaacaagcgtgaagctccatctca

SEQ ID NO: 220449 - DNA, 383 bp, Homo sapiens
ctttatagacattatgagttgtgaaatcaccagcaaagagttgcgcttccctcctaattatagcttgtatgaaaacagtggaagtaaaatattttaatgataaaataatttcagtactggttaagcaatatatattagtcatcagattatggaattttgaaatattttaatcttattaacaagccataggatacttgaagatatcatatttgaacatattctagaactacatttctcttgggctttaattacagcatttagaaatgaaatctgggagactcttctgtgttgtagtagatgatttgtaaccctctttccataatatccaatttaatactaaaaaaacttctagtgtacaatgataatgtaatgaatatatcata

SEQ ID NO: 220450 - DNA, 397 bp, Homo sapiens
ataattgttataaaggattggattaaaatctgatcaatatgagaatggttgatattttttttttcttaaatttgaaccatgacagttaagagattaactcaataaagcattccatgtccgtttccctaaaactcatgaatttagaagtaaattaaaggtcaagtgtagaaagtttttaataccacgtctactgatcatctatacacagtataattttgggcttttttttaatctataaaaaatcatagtaataccctctttgcacaattcatttcattagtgtattaggatgcctatcaaatatacatgggatttaggtttatttttatttatttctctgtctagccatcccctttccccctccttcccgtctctctcttctctcctttcctcctcc

SEQ ID NO: 220451 - DNA, 422 bp, Homo sapiens
aaggtgaggctaagcaggctcttgaggtgcgcccatggccaggccagaatgcaggcctggcactcttcgcccaggcgccttctgggcagcagcagttttgagtaagtaaggagcctaatgtttaatggcctttgtgtaagaacatgatgatgacagcgagagcagggaggctgggagggagtgtgtggatggacatccgagtaagagttccccagtgtctccaggaaccacttgctttgtaaaatgacccaaatccaccatccctggacctggcgcagattctgagttgggccaaggcctgggaaacctgagttggaaagtcttttctcagcccgtatcatggacttgcttttggtgctctgggctggggtcagatttgtaagtgtgttcctgttgtaagaagttgccttgccaaaagatca

SEQ ID NO: 220452 - DNA, 222 bp, Homo sapiens
ccgaaaatgtgtcactatctggaaaaccattaactccactgattgttccagccttacacgttgagatgtcagagccaaatacatttattcgctccaagcatcagtaatgtgacagacatgtggataccctaccaggacacaatgctgattccacttgcagtgaacacagacactgtgcccaagagaaataaagcagagggaggcaagaggacccaaagctag

SEQ ID NO: 220453 - DNA, 398 bp, Homo sapiens
gcaggcttccaaactgaggaaagctggagcctgacgtcagagcttttaactcggacatcaccctcctgaggccctcagctcatacgggcagactgctcaggcgtgaggctggatcgtagggttcgaggctgcttgcttttgttgttgttttgtaaactcagacccttgtaagccccttccttcctcccttgcccaaagatcctttgctgagtgttctgtttttgcagaataaaagcaaaggatgcagacttaccccaccctccacccctagctcagccagatccttacacgtggagcccccagcatgggaatgaggggctctgcaactgagcgaagctgcgggctaggaggctggaaagccatttatcctaggacataaactcagattttgggggtca

SEQ ID NO: 220454 - DNA, 334 bp, Homo sapiens
ctaattaataattaaagatgacacttagggtctctctgtatttgttcactcagaaagtcattcactagaagctataaacgcacttcctaaatccggccatctagcaatcatatacaaatgctagagggcaaactatttaaccagagacaaatcagcagcggtgagaacaaagcctttcccttcggcaacttaagttggcacagcgatatatggcataatattgacagcaaacgcgtttccagcagagaaaaggaacaaaataataaaaagtggtaaagttcccacaagtaagacactcatatctagagcaaacaccttgatatttttatcatta

SEQ ID NO: 220455 - DNA, 463 bp, Homo sapiens
agtgggagggaaatgcaaggacttgagccggggagtgcatgtgagtgggagacaggtggggaaggggtgtccgcatacactataggagtgggagagagcagaagaaacagggctcagggaagggtccctgtcctccttgtttgttggtgaagaggaagaatatggaccatccacttagcgattgtagcaaagaccaagcttgctctcaaaacttcttaaaattcattatgagagtgtgttacttaagccagtttaaatactattagcttttgttaataaaaactctataatttactcttgtacttttttgatttttgtgttatctgaagtagaaggaaataaatttaaaatttttcagaaaatctgtcacttgacccctccctgatttgtatttttatttgcaatatcacatgtattttagtttgcaaaattaaactagctaaataaaatcattcacaagatt

SEQ ID NO: 220456 - DNA, 746 bp, Homo sapiens
actacttcataactgtttgtgccctgtggcattccaacaggataacgggcaggttctacatagcactggtatatctaagtttatctaacttttaaatttaccttgtctctcttcaaaataacgtatgtgccacaaggctatgcatttgaaatataaactgatcaagttacccgaacaattaacgataaggaaggaagccgagtaaacacagaaagcttcacagaaccaccaattttagacaggacaatttctgttttaggaaaatttgacatgtgaaattccttcatataaaatacccctatgccgtcacaaattctgtttcttcttcctgggatgtcatcccttctctctcaactctacactctcaaattcttcctcactaacctttcaagccctgagcaatgaaacttccccctaagtgttggtgctgttttggaagcaccttctcagagctcccatcacaccatctggttaccactgacaagtctctaacaataccacagtaaaatttttcgttgtgttttcttattctttcaccacgtcatcatgtcctctgaggctaggaagttaagacaggtttgtctttgtacatccaaagcttagaagcatgcttagcagctaaaaaagtaaacacatgttaagtaaatggtgtacaactaaccaaataggtacatccttaagttaaaatatatatatatacacaaaaagtaaaagaaatctcaataaactacttactttgttggggt

SEQ ID NO: 220457 - DNA, 367 bp, Homo sapiens
atcagtgctgatatcagtcatatgttagaaaaagtaataactgtagacaccacaatgttgatgagagcagataaaacgaagccccggggcccacaccccagcagctaatatccggcgcctgccggatccggtctggacccacgtggcttatcctccacacaaagctgctgagacactccagaaatgaaagtcctttctctatcaactgcttcatcttgcctccatctctggctggtggtgggcttcacacgtgggccaatacaaacagctcctgcctgggagctcagcacctgcaatcttatgtgtgatttcatccgacagaagtaagacgcagtcattgaaagaattagggaaccgtgagataaac

SEQ ID NO: 220458 - DNA, 552 bp, Homo sapiens
ctcagacggtacaactgcacccctgccccccaccccccgcctcagaatttaaaattagtccaaaacaggaaacagctggaaacagagttcagagaaaagagaggaagaaatacactggtatttattttttcatctgtctttcaatcagagctagttttgtcacggttaatattgaaagtgtcttttcctcctagacatttcctgatgaaggcccaggataagtaagtcctgtgtgtgctctcgtgtttaagaaataaacaaattgaggctgggcatagtggctcacagctgtaatcccagcattttgggaggctgaggcaggcagatcacttgaggtcaggagtttaagaccagcctggccaaccatagcaaaaccctgtgtctactaaaaatacagaaattagccaggcgtggtgctgcatgtctgaatcccagctacttgggaggctaaggcaggagaatcgcttgaacccaggaggtggagattgcagtgaactgagatcccatcactgcactgcagcctgggtgacagagctagactctgtcaaaaaa

SEQ ID NO: 220459 - DNA, 407 bp, Homo sapiens
ttcacctctcagtgccacagttcctagactgtaaagtggagctaataccaagatttcgttcctagagtcattgctaaggatgaaaggaattagtatgttagaacactgccgggcacataggaggctctgtttaagtgtttcttaagtaaattaaggaaatgaattctgaggcgattgaatcatgcagttttacactttcttaccgtggagaagggcaaaagctcagacagtgtctggtggccctgatgggacagacacatgaggaggaggcgcccctgggtgccaaagaagctctaacagtgtgtcattattaacaatggtcgtggtgaccatgtcttgagagcagttccaggccaggcgctgtgctgagtactttccatgtgttcgttgattaaaatctgcatgac

SEQ ID NO: 220460 - DNA, 466 bp, Homo sapiens
aatcaggaatgtgatgtgctagaggtcaagaaagaaacagaactcaacagtgtcagatgttgcaaaggaggcagtaaagtaaggattcaaatggacatttagtaaccagaaggtgattgataattttgtagagaatgactgaaagtcatttcaaggaggaggtgagacagatagcagtgggttttttaatgtggacgtgaacacaagaacattaaataatctttcatttggcttggctgcaaatggacagatgataaggactggagaccaaggcacacaatcctaacgagttttttgttttcttttgcttttatagtgggagaaacttgagcatgcttatcagtttgagtgtctgaagttagcagagggaggtgagattcctgacaaggcaggtggaaataatcatcctagaaattttgcaaagtcctgctttctaccgaggagggagggaggaagggatatttcc

SEQ ID NO: 220461 - DNA, 527 bp, Homo sapiens
  misc_feature (518)..(518): n is a, c, g, or t
gcaattacaagcatgagccaccgtgccaggccttatgtgcattcctaagtaacataataataaaaataacttcagctagggtaccaagaccattcacagttgagaaaggatagtcttttcaacaaatagtgatgggaaaactggatatccacaggcaaaagactcaagtttgacttttaccccccaccccgcacgatggagtctcgctctgtcgcccaggctggagtgcagtggcacaatctcggctcactgcaacctccgcctcctgtgttcaagcaattctcctgcctcagcctcccaagtagctgggaccacaggtatgcatcaccatgcctggctaatttttgtatttttagtagagacagggtttcggcatgttggccaggctggtctcaaactcctgacctcaggtgatccatccgcctcggcctccccaagtagtgggattacaggcgtgagccactgcacctggcctaggtaaatacttcagagttggagcacatttcatggaaggggantttttgttt

SEQ ID NO: 220462 - DNA, 539 bp, Homo sapiens
gaaattttgaaatatctctccagtaggaaatgggtttgcagagctcttctctcttccctgggaattaagtacagctagccatgggaaataccacttgggtttagagtggatgaaaccatcagatgtggaaataccagatggaggaatgggagggaggctgtggacagcaaatgtgtttctccagtgtgcaagatttcttggcactttgatgaggatgttgtgtgtcacaactgtaatgatgcaagaatattgtcctttgtcttaaaattgtgttgctctttggccatgtcagccggaccctgtgtgaaggggctggaggcaggcagagaaaagagatgctcttgtaatcatcagggacacacctcagacctctagttccacaggacccgagtggtcgtgctaccatctctgcacaatggcaaccctcagggacagactgtcacaatgtatggcagcaccaagaaattgggggctcgtctcctccagctcagcgcctactcaaacctggaggagttctggtcacaatgagcacttgagcc

SEQ ID NO: 220463 - DNA, 560 bp, Homo sapiens
tgtccctataatatcataattatttaatatcataatttctctttatagttatgaacaccatatagtcatttatcatttcatgagtccatgcatcaatgacccctgtaagaaaaatgccctcattgtataatgctaagttgtccaaaacgatgtctgatgctttggcaatttcacaggctgtatttatgtgtgtttagtaactgcctataacattaaggcaccttttctgtccgctcctattgtttatattcacacatgccaaactgtgagttgtttttttttttctgctctgctatcattttgatttctaacaatattggtgttggttattggaccttccttccatgaagcccagtgagctgcttctgacagaggtaccaagagactacaggggaactaatgggattgtcctcagtgacatcagttttaccagctggggactttgtttgaatgccctggatttactcactgaccactctggaaatgcaatctattgattgataaccctccttgaacttatctgtaaaaccattcatgaaatattttatgtttccataggc

SEQ ID NO: 220464 - DNA, 463 bp, Homo sapiens
caataaacaactttcctctacagtatcttccagggtctaaactattagacaggttcctaagtttatccagatctctcctatgtctgaattcttggtcatcttccttgcctctggctccacaggtaaagaagaaataataataaaggaacaaaaattatatgtttcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaa

SEQ ID NO: 220465 - DNA, 797 bp, Homo sapiens
cttccgggataaagcaacctcttaaggattttttatagtttatgatacttttgtaaatggactttttttttcccaacttttggggatcattgctcatgtagagaaaaactaccgttcattttatatctagccactttaacaaattatcttataattcaaaagtttttaagatttttttgggttttctagatagtcacgcttatcaccaaaagctggtctgctctctgcttccctggtgtgcacatcagtcacgtcaccgtcacgtcaccgtgggcctgatgggggaggaggatgtgggcatcttgctgtgctccacagaaatcgctgttttgccttctcagaacatttgttgttgggctgtttttaggagggtggctgactttttagaggtttctttgttagcatctactatgatgattctgtcctttttctggtcctcccgggatttgtggatgtggccactacaaggccagagtggatgggtgtctccgtggcattctggggtgaaccctggcctgtcgtggcttcgccgtggccttctgccagctcactgtcacacgtggtctcggttgtgtggactggctccagcaggttttgctgtgacaggtgtggcccctgcatgttacgagcagggctggctgtggctttgtggcctggaatggttaaaatcacagggatggccaggcgtggtggctcacacctgtaatcccagcactttgggaggctgaggtaggtggattgcctgagcccaggaattcgagagcagcctgggcaacatggcaaaacccgatctctac

SEQ ID NO: 220466 - DNA, 480 bp, Homo sapiens
aaaaattggctatctcttgccccaaattcaccaactactccctccagtctccttatccaggacagtctgtatcttttgtgggctctttcttctgtgtcaagctccccctcccccacaccacaaaataaccagccgcacatactactggcacatctaccctgtggtcccactcactatctactgaatggatgagtgtttggggctaaatgttcctcagtgtggtggaaagaaagcagcagcctggaccttccagaaagtccttggcagtgcagggatggggggatctgggctgccacccctgccacctgatcctgaatgacttcccctcatctggagttccttccactgctacttctcaaaggtgctgcgcatgctaagagggaatttgaaagttcgggagtgcgggtaggggaggatgagaaggggagtggctttactcttttttttttgagacggagtttctctcttgttgcccaggct

SEQ ID NO: 220467 - DNA, 438 bp, Homo sapiens
taagatgagtgcatgtgtgcttaatagtcacatacatatgcacacaaacatatgtaccctattacactcatagtctcctttgcacagtagtgactgctgattgtctaccacaactgtatttccaaataggggcatggaaattgtctcttagcctaagcttacagagctttgttatcctactaaagaaaatcatagacatgggttctatttttgaaggacttcaatactaggcagactgaatcctcaaagtggtctcaccaggagacatatctgtatatactgatgtgttaagtgagaaaacagcaaggtatagacaagtgctatcatttgtgttaaaaggagaaaaagaagagggctgaggtgggaggatcacttgagcccaggaggtggagtccagcctgggcaacatggtgagacaacatctctacaaaaaggaaa

SEQ ID NO: 220468 - DNA, 430 bp, Homo sapiens
atgtgacactggaatagagtattcttgagtattacctaagagctagctaatcagaacaggtgatatcacacgtagatccaggttctggagctctaccagggcagttccattttctatttagaatcagcttgagtctttcctgcctggatcaacatagggtcatcagtccatggtcactaggaatcctctcacagtcacccgggaatctttaagacatttcaggatgtcctgtgcagacttgggtcaggctggcaggagtgtctaattctgcttccatgttagaggaagggaaatgagtcattcagtgtctgttccttcttttgtagaaagattctccgtggttggtacccagatgagagtttctccagtttccttggcaaaaaattcaggagttctggagactcagactgataaacaaattggtcgacgc

SEQ ID NO: 220469 - DNA, 540 bp, Homo sapiens
caaggtggtgtagcttttaaattaagcctttgtgatatttgattatacgccaatctttgatgacagaaacgatgtcatttatcttaatattcccagcgcaagagaaaaccgataatcaaaatatttgttcaattaagtagagtaaaaatcagcgggaataagataggaaaaatgagaccgaaataacagaacatctattattggatgctaaaacttttacaggatttactgcaggaggactgcaaagggaaagaaacttcaacggagcagtttttcagatgggctgtcaacaaaccacaatttggaagcagcagcagaaagctgcggcgttgtcttagaaaggtgatcggcgttccttagaaatgaaaactggtcaggtaacaggtttgagcccctcgagtcaaaagagaaaggcaagagcgacagcgacccgcagattggcagaatggaggagcgtctagggtgagagaaactccgaacacgaagccgaagcgagagcacgcagggcagctggcgggagaaccccggtcccgcggccgc

SEQ ID NO: 220470 - DNA, 433 bp, Homo sapiens
aagtgatcagagttaattaagagaagggtttgccatcacccggatctggccaactctttcgtttggaaaatgcctacaagctcagttcgtggcaccttcccaccctcactccctatccctctgcaaagaaaccagggaacttttctttggcattgtgggtactaagatgcgccaggagtcccgggtggtgcgcgagcggcggaattcgtgacatcgccaagttgcgagaggcaaactccccgattccatccaaagcctctcgcggagcctttaagagacgttgtgtgtgcgcgctgcgctagtctccccgccggggcggaaacctcgggtgcgggatgtggggagagcagaggcagcgctcgcagggccagcacgggcccatccccctctcggcgacgccgctcgcgctaggaccgggctgcgcccgcggccg

SEQ ID NO: 220471 - DNA, 486 bp, Homo sapiens
aaatgaaaagacattccatgctcatgtattggaagacttaatattgttaagatggcaatcttccctaaattgatcaacagagtcaatccaatccatatgaaaatcccagtaacttttttgaagacattgacaagttgaacattctattgacaagttgaaaattctattggaaatgcaaggtagccaaaacaaacttgacaaaggacaaagttggagggctcaaacttacttgatatcattttattacatgcctccacctaaatcttgtgtcgaaatgagatctgttcgtttaaaagtgtgtggtacctaccccgcaaccttgttcttgctttcaccatgtaacgtgcctgctccccctttgctttctgccataactggaagcttcccaaagcctccccagaagcttagcagacattggcaccgtgcctcctttacagcctgaagaaccatgagcgaattaaacctcttttctttataaattaccca

SEQ ID NO: 220472 - DNA, 677 bp, Homo sapiens
cgtgactgtggtccagaagcattacctcctaaggcaatttaacaaagaaaaagagtctaattcctttgaatggggaactctgcttaagcccgagctgggactcgcaggtctggctaacaccgagacttaaccagccatgactatatgaattccgccagagagaagcagctggatccagtaatgaagccttggtcactgggggaggaggctgatcctgggggaggaggatgacctgccatgtctgatgctcagatttgtcccttggttcagctcttcctgagtgccatgtgcgtggcgatcaatgattcaaactctcaaacagctctttcactaaaaatcctggaaggccctggggtacacataaaaagtggggcgagatcttgacttcacaatgcatcaacaagaaggtcccaccgctctgggtatggacaagaaacagccaggtctggtagacccaatgggtggttggcaggaccagctttgctcatgaggaaccaagagacatccttggcactcccagaaatagacatggagcccttgctaaggcctgaagttcatcacgagcagccagggcatggagtggaatgcaggttattcctaatgtaacctcatcggtctgtccaagctggagaggcccggggtatctcaggttacactaaacatatttaacttacatc

SEQ ID NO: 220473 - DNA, 462 bp, Homo sapiens
tcagttgatggtctttttcttaatgacttgtaggaactctttagatattaaggaaatggaaatgagctccatgatatatgttgcaaaaatgctttcccaattttgagaactgggagactcctttgattttatgatggattctgccaagaagaaattctttacttgcatagggtcaaatatattaattttttctcttatgacttctgggttttaagtcattcttagaaagtactttctccaagttcatttttaaaaatatttaccatctttaacccaactgaaatttattttgttttaatgtgttcgttttttagatggccatctagttaaaccaggtcataattttttaaatgccatctttttttttttttttttttaagagatagggtctcactatgtttcccagactggattcaaactcccgggtacaactgatcctcccacctcagcctctagtgtagc

SEQ ID NO: 220474 - DNA, 448 bp, Homo sapiens
ctactttcccaaagcagccactgaaaccatgttaactgaaataaaacttcaaatgcagtcaatcttcaaatggagtaaaggacaacagactagatcagaaagcccagttgcttccagtgttgacctgcatcacagagatgataagctgattgttaataaagagagactcagagtaggcctatgttgagctttagtgtgggctctgttaccaaaattgattctgaataaatcccttaagcctatatattcagcggcaaaatgtcagggttgtacgggtaataaaacatttagttccagctttgagccggttataggcataccttaaagatactataggtgcagttcaagaccatggcaataaagcaagtcacacatctttttttagtttctcattgtatatgagttatgtttacactgtatccggtagtcttttttttttttttttttt

SEQ ID NO: 220475 - DNA, 461 bp, Homo sapiens
ttgagacggggtccaccctggcccccaggctggagttgcagtgagctgagatagcaccagcctgggcaacggagcgagactctgtctcaaaaaaacaaaaaacaaaacaaaaaaaaaaccttccaaaagaagtttgagataattttatgtttagaaaaattagaaattggattgagtaaaatttacatattttacacaagaggactaacatctttataatatttaacctttcagtaaatttatgttttatgtttctcagcctatcttttctagtataggtgatttttttagtgtggttactattgtaaatgagatcctactactttaaaaaatgaaaattaaatctatcgcttttatgactttaaaacattagacttatgtaagtgtaaacattatttaaaaacataatgtagaaaattaaagtcccccataattaaaatccctttcccccagaaaaagtc

SEQ ID NO: 220476 - DNA, 1079 bp, Homo sapiens
ttgcctcaaattgccttccagaaagacagacccaattatactcccacccacagtgtgtgagtgtgtactgcttcctctttaacacggtgcactccagcctggggaacagagcaagaccctgtctctaaaaaaaattttaaaaacctctgatctatctggaatgtattttctaaattaccccaacactgtttattgggaagtctgtcctttattctatatgaaatcccatttttgccatacacctagtagcccttctgttgggtgccaggataagcaccctggccttgagtgtgctgtgaactctttattatgggttgtgatcttcctgcacattctagcactggtaccacattgtttggatcgccatagcttggactaaacttccccattaaactttttcaaaacttgcctagtatattgtgcaggcgggcacggtggctcacgcctgtaatcccagcactttgggaggccaaggtggatggatcacctgagatcaggagttcgagaccagcctggacaacatggcgaaaccccatctctactaaaaatacaaaaaaaaaaaaaaaaaaaaaaaaaattagctggctgtggtgataggaacctgtagtctcagctacttgggaggctgaggcagtgaacccgggaggcagaggttgcagtgagctgagatagcaccagcctgggcaacggagcgagactctgtctcaaaaaaacaaaaaacaaaacaaaaaaaaaaccttccaaaagaagtttgagataattttatgtttagaaaaattagaaattggattgagtaaaatttacatattttacacaagaggactaacatctttataatatttaacctttcagtaaatttatgttttatgtttctcagcctatcttttctagtataggtgatttttttagtgtggttactattgtaaatgagatcctactactttaaaaaatgaaaattaaatctatcgcttttatgactttaaaacattagacttatgtaagtgtaaacattatttaaaaacataatgtagaaaattaaagtcccccataattaaaatccctttcccccagaaaaagtc

SEQ ID NO: 220477 - DNA, 1054 bp, Homo sapiens
ttgcctcaaattgccttccagaaagacagacccaattatactcccacccacagtgtgtgagtgtgtactgcttcctctttaacacggtgcactccagcctggggaacagagcaagaccctgtctctaaaaaaaattttaaaaacctctgatctatctggaatgtattttctaaattaccccaacactgtttattgggaagtctgtcctttattctatatgaaatcccatttttgccatacacctagtagcccttctgttgggtgccaggataagcaccctggccttgagtgtgctgtgaactctttattatgggttgtgatcttcctgcacattctagcactggtaccacattgtttggatcgccatagcttggactaaacttccccattaaactttttcaaaacttgcctagtatattgtgcaggcgggcacggtggctcacgcctgtaatcccagcactttgggaggccaaggtggatggatcacctgagatcaggagttcgagaccagcctggacaacatggcgaaaccccatctctactaaaaatacaaaaactggctgtggtgataggaacctgtagtctcagctacttgggaggctgaggcagtgaacccgggaggcagaggttgcagtgagctgagatagcaccagcctgggcaacggagcgagactctgtctcaaaaaaacaaaaaacaaaacaaaaaaaaaaccttccaaaagaagtttgagataattttatgtttagaaaaattagaaattggattgagtaaaatttacatattttacacaagaggactaacatctttataatatttaacctttcagtaaatttatgttttatgtttctcagcctatcttttctagtataggtgatttttttagtgtggttactattgtaaatgagatcctactactttaaaaaatgaaaattaaatctatcgcttttatgactttaaaacattagacttatgtaagtgtaaacattatttaaaaacataatgtagaaaattaaagtcccccataattaaaatccctttcccccagaaaaagtc

SEQ ID NO: 220478 - DNA, 732 bp, Homo sapiens
gggtttcgccatgttgcctaggctggtctcgaactcctgaactcaggcaatccacacgccttggcctcccaaagtgctggaattacaggtgtgagccaccaagcccggcgaggtcttcccaattctgatggcaaggttgtataaatattcaccactatcttattcttgtacttttattatttctttctaaacagttaaatctgtgatctggctgggcgtgttggctcttgcctgtaatcccaacactttgggtcgccaaggtggaaggatcacttgagtccaggcatttgaggttacagtgagctttgatggcaccggtgcactccagcctggggaacagagcaagaccctgtctctaaaaaaaattttaaaaacctctgatctatctggaatgtattttctaaattaccccaacactgtttattgggaagtctgtcctttattctatatgaaatcccatttttgccatacacctagtagcccttctgttgggtgccaggataagcaccctggccttgagtgtgctgtgaactctttattatgggttgtgatcttcctgcacattctagcactggtaccacattgtttggatcgccatagcttggactaaacttccccattaaactttttcaaaacttgcctagtatattgtgcaggcgggcacggtggctcacgcctgtaatcccagcactttgggaggccaaggtggatggatcacctgagatcaggagt

SEQ ID NO: 220479 - DNA, 499 bp, Homo sapiens
tgtttgctgcttaccactgtcttaagttgtaattacgtatggtcttctctctaggtagggaacaacttgagactaaagacgttgtgactcacatgagtttgtataaatgaagaaaatgcgatgggacataagtagggtgtggggagagccttcatggggagatcatacttgacctgagtcttcccaaaagcaatccctctgtcttacaatacagctgtcaccacaattggcttgataaaatatggagtaacaaatgttaggttcacctagactaatcttcccttcctatacatgaagtacttggaggaaagagaaagcagtaaagtgattttccagagtcacacattctgacataggcagtgccagaccaaaaatcagtcacttcccataaggtggatatgcacactcacagaaagaacgagcctatgcatagaatgatctcattttcaagtaaaataatttttgagatacaaacatcagcaatgacaaccacacccca

SEQ ID NO: 220480 - DNA, 211 bp, Homo sapiens
aaagagataatattgaatccattctaatctatgggggaaaagtaaacccacttgcagattttgctatttcatatttagtaacatgcttcttgagacaaaccagtctgtggatgctccaacactgtcttcagcccctggccctgcacaccctcaggacagcttagcttgctggccacaccttgtgccaagacccagaagtcagaattcacag

SEQ ID NO: 220481 - DNA, 294 bp, Homo sapiens
ggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtgga

SEQ ID NO: 220482 - DNA, 508 bp, Homo sapiens
ttaaacctttgtacaagagcggggccagtcacccacatgatgctgtcaatgtgctttcaaagccccacttcaaagagggagatcaaatggggggtaattgaaagggacagcgatgtgagggggttcctgagacgccccccaacgatgactatgaatgcggcacacaccacccaaatgacaggaaggcaatgcgttgcggtggctggactccaggaaggagctctgcgggaacgatgaggtctgtgggttttgctgctgctgttgcttttgctgttggtgggctttgagaaaaacacgactggccgggctccctgccttctccttctcctgtcgaagtctctacagctaggaccctcctgtcctgacaggctcagctctgcatcttgaggtccctctgacctcccagctgaccctccatgtaacccaggctcacccaggactctttgggacctgaagatgctctattcatccatttgtgctgattaataaagtgaattctgaacatcac

SEQ ID NO: 220483 - DNA, 741 bp, Homo sapiens
ggatttatataacctcaatcttaactgtcactggacaactaagggccactaaatagctgaggaaagcctgctgcatcaaaggagagtctaaaataaacagaaaaacaaatgaaaggatttaccaagggctggacaggtgggattgaaatagatatgcaaggtttatacagccttctgttgtaagccactgctccagcaaaagaatatgggatctagaaagcagagtgataaggggaacttccaagatgacaagagcaaggcttagaggatagtcattctagattggcacaggaacatggagagctttagaagcaggagttacatgtggaaaaaagatttgaaattatcattgacagtttgaaacaggaggcaacaaagggatatattaagcaattttgggaaaaattgaaagtgaataagaaaggatatttaataagggcataccacttatctttgcatgaccaatatttacacattgtacaataagtaaaacttactgatttaatgaaaatagttcaataagatttgtagaggatgagaggtaggaaataggagttggcataagatgtgaattatcaacttcaatagcaagaagtcagatttgaagttgatcagtttaaaaagagaagtataaacacattatttgtaaatacgagggtaccttcagaaggcatagttgaaagagttaaaaaaaacccacttgcctctgagagtaagactggaatattagaagtggtggag

SEQ ID NO: 220484 - DNA, 999 bp, Homo sapiens
ggatttatataacctcaatcttaactgtcactggacaactaagggccactaaatagctgaggaaagcctgctgcatcaaaggagagtctaaaataaacagaaaaacaaatgaaaggatttaccaagggctggacagtatgattgaaagaagaccttatgcctagacacatcattatgaaattttaagacattaaggataaatgaagatcctagaaactttctgaggaaaaaatggtaacctataaaggagtaaaagtcagagtggcatcagatttttcattatgaatgctgagtgtggtagaggaatagtatcaaacttccgagggaagttttcaacattcaatattttcagcattaaattctgtatctgggaaagtattggtcaattgtgagggtgggattgaaatagatatgcaaggtttatacagccttctgttgtaagccactgctccagcaaaagaatatgggatctagaaagcagagtgataaggggaacttccaagatgacaagagcaaggcttagaggatagtcattctagattggcacaggaacatggagagctttagaagcaggagttacatgtggaaaaaagatttgaaattatcattgacagtttgaaacaggaggcaacaaagggatatattaagcaattttgggaaaaattgaaagtgaataagaaaggatatttaataagggcataccacttatctttgcatgaccaatatttacacattgtacaataagtaaaacttactgatttaatgaaaatagttcaataagatttgtagaggatgagaggtaggaaataggagttggcataagatgtgaattatcaacttcaatagcaagaagtcagatttgaagttgatcagtttaaaaagagaagtataaacacattatttgtaaatacgagggtaccttcagaaggcatagttgaaagagttaaaaaaaacccacttgcctctgagagtaagactggaatattagaagtggtggag

SEQ ID NO: 220485 - DNA, 538 bp, Homo sapiens
tcaaattagtgaagtaagaatgtaaataatggtaaatttggtattagaataactatccaattggaaaaaaaaggttaagctagatttttccctcacactataaataaaaataaattccagatgttttaaagagttaaatatttaaaaatgtaaacatgccagaaaaaatataaaataacactttgagaatcctgaggatgaatggcaagaggtttttaaaaagcaacatgcaaaatcttgaaatcataagataaaatacaacagatttgactatataaaaatgtaaaacttttatatgggacgcaaagttaaaagtcaagcaataggctaggagaaagtatttttgccacatactcagaatatatagagaacataaaaaagaaaaaagccaaatatcaatagaaaaatggtcagaagcacactcaaatcacagaaaaaaaaaaaaaaccaaaaagatcagttacacataaaaagatgctacacctccatagcaataaggggaattgtaaatagagaggtatttaagagcagggactct

SEQ ID NO: 220486 - DNA, 229 bp, Homo sapiens
catggagtttcgtgaccaccaagaaagtaaagtgcttctattttgtaatctcctagtgaatttttaaagatgactgatggtgtccaggcctgtgaacatggaaaactgaggtaaacccatcaagagacagttgcccatccatcttaaaaggcaagttaatcatgaaccatgaataaagccgctgtaatcattcacatacaggtttttgtgtgaacagaagtgttcactc

SEQ ID NO: 220487 - DNA, 319 bp, Homo sapiens
tgagagtgaatcccggttaccttgttatacaagggggtggattgagtcacatgtggctcatgaagtgagcaggtacaggacaggcctaaagtgtccccagtctgaaatactgtgtgtaatgactggtaaattttcactccccctaccccatatgaccctttttgggcaagagggggcagccctgcttgagcactcctcagtgggctccccagctgtttaatccgcagcaatttagaaagtaatgccccaatgccctttattaaggtgtcataaagggacattttccttcctctggacaccccatacaagacttatcact

SEQ ID NO: 220488 - DNA, 628 bp, Homo sapiens
atcactaccaatacagacccctcctgcagttgcgtcaccccgctggacttcaatcattgcctcaagaaccgggaggataatggcctgcccatgctcagcaccaatgccatgagctggaagacgatttctgcaatggagaaaaggggagcaagagagactcagcagcaaaggaagagagtgtttagaggaagaggggtcaacagtgccaaatgctgttgagaaatggagattcaaacaggatgggagtgatgaaacccaagaaagtggtctccttgtagaggactgaagctagggctgatacagggccaagacagtcttccatatgcataagttgtactgtaatagccagtttacatgtctgtctccctggagtaaaggtctccaaagtggaacttgtccaccctgttatccttaaagtctagtgcaagtcctggaacgtagtggacacttaaattttactgattagtgaatgggtgaatgaatgaatgaatgaatgatggcaaatgattggaagcagaggaagaatctctggcatctgcctggactagctactatccttcagctttttttcttttttaccgcaatggcccgcagacccaggaaagagacgacagagccccccttccct

SEQ ID NO: 220489 - DNA, 256 bp, Homo sapiens
ttccctgctgtctcacaaatcgcaagagtccaacgtgtggatataaacttttgttcatgggaggatctttctcccagtggaaaagcaactgggaaaagcaggacacactgcacagtgactgcagtttcatccaatgccaccacccatgcaggcataaataatgaacatggatgggggagtctggagctgctgaattgtaaggctcataaatgtttaaactttttccattaataatatttctgctttctgtgtatgt

SEQ ID NO: 220490 - DNA, 639 bp, Homo sapiens
gagcacagatgatatctcacaattttttttgagaattgtcagcctaaagatcactttcttattggttcttaaaaaaatatgagctaaaacagaatagtttatttttttggaattagtaccagttctgaaagtaaggggaataaacattttctactttacaaaataataacaaaatataccaatgaaattaaacattttgttaattagcattagtttacattttaataaaaataaataccttccctctttaaaaaagaatcaagtacacttatttttttaagtaaaatcaattcacattcagaattatagtgtagcatagcttaatagaattcattcacattaatctgcgctaaagcccaaatataatgctttcctttcaaaatgtaagcctttgtcatttaatttacatttgtacttttatagcataatgtctgtatctctaaaaattgtctgcaattctagtaatggcattataggaggctggttgctttgttgaaatgctcaattacttattccagagacatgaactggttattaacaaattaactgagaatttccatacactgcaaaattaaagttattaacaaaaattactattattccagtagtcatgatattagcattcttattccacatcag

SEQ ID NO: 220491 - DNA, 653 bp, Homo sapiens
ttgcttttgtacctctttagggcactgattttatattgctagtcttcatctatccctatctgtccctgtggtacctgtgagttcctgcaagtctctgtctctatctctatctctatttatctctatctatctatatctctatctatctctatctctatttatctctatatttatctcctttagctgtacttacttatctctacttagacttacttatctctacttacttacttgtctctacttatctctacttacttatctctgcatctttcctggaaaccttttctatgaccctgagtagagctcagaaatccaccctttaagcttcaccaagagaaaaacagggacactggaccctgcaccagattgaagggaacaggaagtgctctccccgccccaaagcaggaaaacaagagtttggcccttgcaaatttccactccacatcagcgtcatcctcaatttcctggaacattatagcaatgaatttgtggttatagctgatgaccactgatttcacttcagaaagtccaaatatagcccagaacagtgtcttaaaactctgttgtgaaggcttcattttgttttgcaccaatgtagtaggagtagacgttgaacattcccatcataaaggccacaaataccacaatgaaca

SEQ ID NO: 220492 - DNA, 499 bp, Homo sapiens
gggattaggcatggttcaaattttatctgaaagcagtattacatgtgggcacagctgagcagggacagatttcattggcgcttgatccattctattttttcttggcttgaaagaatctcaaggatcaacttctcttgtgtaaccgtgattacttttaaaatgcgacttttattttgttgactttgattgtaaagctttagtcattctgaagtcaaaggagtacaggcatgtgttgttaaaacttttagattgcttaggaaagagaggcgatgtgaagaaagcaaactaaaaacttagatcaatgtgttatacagcacaggtgcgaaagcacaacctgaaatggattattcacaacctccttatactaaaatacggcggcgcccccttgtccatggtttccctttccacggtttcaattaccctcagtcaactgcgatctggaaatattaaatggaaaattccagaaataaacaattcataagttttacagtgcatgctg

SEQ ID NO: 220493 - DNA, 465 bp, Homo sapiens
acaaagtatcacaaactgagtgccttaaataaacaaaaggaatttattactttgtggttcagaaggctagaagttggagatcaaggtgtcatcacaccatggtccctctgaaggcaccaaggatggatctgtttcaggactcctggcctgtagcagcataactccaatcttcacatgatattctcccgttgtatgtgttcttccccaattttccctttttataaagatagcagtcagattagattagggcctatcctaataatttcattttaacctgactgtctttgtaaagaccctatctgcaaataaaatcacatgtaaagtattggggcttaggactccaacatatagatatgttttatatatatggtgagatatatatatattttttatatatggtgagatatatatttatatatggtgagatatatatatatatggtgagatatatatttatatatatgg

SEQ ID NO: 220494 - DNA, 551 bp, Homo sapiens
atataaacaaacaaaaaacctttttaaacaactgtgatttttgtagttctttttatatttagatcatctgtgctctgttctatttcaatttggcattccattctcataaaccatgtagagaaatttaatcttgtgttgatactatcacaattggaatattagaaatgacactgaaattatacaattagccaaatgatacctttaccacagaatgaaacagaaaaaacaaacagttgtgagtaaaacaattttggaaatgaacacagaataaaaataaataggagagaaacaaatatgcttggaataagatatcaacaagtcttattttatacctgaatttgccttaaatatttaacagtacttaagtttatataaaaaaaaaccttatggggaacacttaaattaagaaattacattaggaagtactataatgaggtatataagttttagttaaattcacatatcagatagtataacgatgaaaaatctaatggcatttttctcactttcctacttttcttcattgtacacagagcttctatgcactgtat

SEQ ID NO: 220495 - DNA, 643 bp, Homo sapiens
ggacctaaatgtatatttataagagatattcttctctgctcctgggattttcattctgaaatacctttagtagaaaagcaaagcacataatagtagttgaacttttctgtaatgtgtttctggagattaggtcattatgcgggttttaaaagacatgttacaagcatcagatattgtgtttccattacatggggactcaataagtacttaaatgaaaccaaaaatacttttcatcgactaacgaaaagaagagcaatgcaataaaaatatgctagctaaagacagtttagttgtgtgtgaaatcatggattcacccagtccttaaaatcagaaaaaaatccctgagactcaagtttccttatgggtaaaacagggatactaatacttacactttggtattaactaaagagagcactaaagacaaagctcttagtacagtatagcagtacactgtagtttcctcttctttcacctggactctcctgacatctctctgatcaccccacttacatatacagatagctcaggaattgacagaaaggagtagaagaagttgggtagtacagcaggtttgagcagaaaacagactagagtttctatgtaaaatttttaggctattgatttgaaaatcagacttccccag

SEQ ID NO: 220496 - DNA, 527 bp, Homo sapiens
ggccaatagatgtaattttaatcgtaatcacttaagttcttccttatcactgaaatatgtgctcttctttattcttgaacgtcttgaatcatctgatgttgagggacctcctgaactggattttctttttttcttcttttcttctttctcagttttggcttgctggaatgctgtggcataaggctgtcaaagagtaggattctccccttaatcttctctgtcttctacttcttcagtttcttctactggttcaggaactttctttttttttctttcttctttggaggttcacgtacttcaagcatatttttcggacaggcgtaacttaggtgtccacttttcccacaaacataacacttagattcatcaaagtagttctgcctttgggtgaactcggctgcccttctgtcgtcaatagtgatgcttgcttttatcactctaccaaataaccgttgtttattgccctagtactgttttgtgcagagtattttatccaaaaataaaataaatgcaacctctttactctt

SEQ ID NO: 220497 - DNA, 526 bp, Homo sapiens
aataaattaataatttctactgctaaggacattttaagtgaaatgttttttggttttgcctgtgagcacgtggtgctgaagaatgtaattgctactggtacagcttggcactgctcgcttgattcatgcttaggttctgtcagtgcaaatgtcaacacagtgaaaaattatatcttagtattattatgaaaatagtcttggccttgcagaccttttgaaagggtgttagggtcccgaggaatccatggaccatacttcaagaaccactggatttgactatctttgaaagattatatcagagaccagtaataggaactgcctttgaggagggcaagtttgttttactgtcatagagcatccttttgaagtttttgcattgtttaccttagtcaagtgtttcttttttgcaatgtgaatttttattttgtatttcgtctttggaggagattgcagtgagccaagatcctgccactgcactccagcctgggcaacagagggagactccatctcaaaataaataaataaa

SEQ ID NO: 220498 - DNA, 437 bp, Homo sapiens
ataattcttcccgttggtgaaggtgtggtgagagtgtgagttggtaccttttgggagaataatttgataatacctatgatatttaaaaatacacatatgaggatggggggatatgggtatataaatgaaataattttagccatgaaattttatgggccaggcacggtggctcacgcctgtaatcccagcactttggaaggccgaggcgggcaaatcacgaggtcaggagttcaagaccagcctggccaacatagtgaaaccctgtctttgcaaaaatatgaaaaaaattagccgggcatggtggtgggcgcctgtagtctcagctacttgagaggctgaggcaggagaattgcttgaacccgggaggcagaggttgcagtgagccaagatcgcaccactgcacttcagcctgggtgacacagtgagactagctcaaa

SEQ ID NO: 220499 - DNA, 2598 bp, Homo sapiens
  misc_feature (1)..(1): n is a, c, g, or t
  misc_feature (3)..(6): n is a, c, g, or t
  misc_feature (176)..(176): n is a, c, g, or t
  misc_feature (418)..(418): n is a, c, g, or t
  misc_feature (1476)..(1476): n is a, c, g, or t
  misc_feature (2593)..(2598): n is a, c, g, or t
ncnnnntttatggctagatagtgctccattttgtctaagtaccacattttctttatccattcatctgctgatggacatgcaggttgcttctagatcttggctattgtgaatagttctgcaataaacatgagagtgcagatatctcttcgatataccgatttcctttcttttgcatntatacctagcagtggaattgctggttcatacagtagttctattttgagttttgtgaggaacacccaagctgttctccacagtggtggtactaatatacattcccaccaacagtgtatgaggattaccttttctccacatccttgccagcatttgttatcgtctgtcttttggatacaagccattttaactggggtgagatgacatctcattgcagttttgatttgcatttatctgatgatcngtgatgttgagtatcttttcatatagctgttttccatttgtatgtcttcttttcagaaatgtctattaaaatctttagtccatttttaaattggattgttaaattttttcatatagagttgtttgaggttcttacatattctggttattagtctctcatcagatatatagtttatagatattttctcccattctatgggtttgtctctttactttgttgattgtttactttgttgtgcagaagcttattatgtagatgtggtcccatttgtccacttttgctttggttgcctgtgcttataaggtattattcaagaaatctttgcctagtccagtgtcctgaagagtttccccaaagttttcttttagtcatttcacagtttgaggtcttagatttaagtctttaatccatttttattttattttggtaaatgttgagagatagaagtctagtctctttggtcttttagatgagatgcaagatatgcacatttacttgggaaatttatatataaagtataacttatacatgaatgcataaaaattaatctgtagctaagactagaaggaactagaccacaataagaatagaagcttttttagtagggatatattacttgtgggaattaggatggcttaaaaaaatagcttcatcatcaggaaatgaaaaaaaaagtcccatactcaacaaacttcaaatgatgtaaatgatttataatgtaattttcctgcagagtgaaatcatatgcttttgaaagtaaagtaatggattattctgacatggacaagtaattccacttattattaccttcgcattttaaagatgacatgaaatgtaaagatcatttaaatttaacaaatgacctctgattaccaggaaaaaaaggccaccttgcagggcgtgcagaagtgaacatatgtttaagagtgctattgcatttccaacataattagtcatctaactatgtattcaaatgaagctaatggatttctaagtacaattaactatgatttatctaagaacattgcagtttgaattcttttctcccaatttgttcntaattattcttttatataaatttgttaattatttatgggcgaatttcactttggccaaattaaaatctatttccacaatgcagcagctatcgaacagcaattaaaaggtggtgattgaagaaaatgcagctttacttattgttttccaaagggaaacattatttgagaagttaggcaaataatttctctcagttctactttaaaggaattaaagatgaatgagaactttaaaaatattttaagattaaaaaagtgaatatatactaatttattctataacagttttactttttattcatcttggtttcatttattggcatttaaagagaataaagtattgtatattcatgcattttcttttgagtttttgtagaaggatatgggaaagttaaaatatagcaaatgaatgactcattttataatttttagctaaatacagtgtgcttataaaatgtacatcaataaattcaacttggtttaaaaattagccaactatgtgtgattttaaaaattgatttggtatcagatacatgaaatactaaacaaaacttatctactgtaatattatgagataactatcttcaaattttaaaaatgctttagaaatgctcagcagtgtggtagagatgtatgtcagtattatcaataatttaaaacttattagatgctttttcagaaaaatacagtaatgttatcttgatgagcatggatttggactcagcataatcagtaaaatgagcctcaggaaaagtattataccatttctttttgttgagtttattatttcactttggtataagaattgctcattcaaaataccttaggaaaactttaaaattgataattcagcacatggacttaattcacatcaaaactcaatttgtctttgttatggaactttgagagattcctgcttaatggtataagagaaattcttcattaaagaagcccacacagttataccccacaaaaagctaatgctattgggcactgtagaagtgcctactgtgaggtctataacttgtaagaatcaagatgggtgatgtgttatgtagtttaattcatccatatgttcaaggcagttctggtaactctcaggtaaagtgcaggctcgagnnnnnn

SEQ ID NO: 220500 - DNA, 463 bp, Homo sapiens
cttcatttttgaagcctcctgagtcatgtaaaactttggttaaacaaatttgctatgattttctcttgttaacctgtcttttgttataggaatgtcagttgtgattgttatgatgggtgaggaaaggtatctgttcccccaacacttctttgaaaatttgtttatccaatgaaccagaatatcacctggcaaatcccacagagataatgagacaaaggactgacacgtattgatgaggaagccaggagggccagtgaggaggaaagaagggcatgaaaacccagaaaccaaaacgaaggagttttggatgtgagctgaacccacttcatatgtgtacaaaattacaatcttagtttttagctcagttgtcttatcttttaaggctatagcagaggtgaaatagggccaaaaggccaaacctagcccagcatgtatttttgcaaataaaggtttattggaacac

SEQ ID NO: 220501 - DNA, 469 bp, Homo sapiens
aaacttgcttcacaaagccatgtgcctttcttacaacatgatattcaggggcccttaattcatttgatctgaaaagttcccgtgcaggctaggtgttatgtaccataccttgccatcatttaaaaataccctgctgtggtttgaaataatgatctctgaggatgtgtgcacctcagaagactggtgcagaagcaagtatcacttttaaaatgagcctatgcgatccccagattaatatctgaaagctagctacctaataaagttttaattgcttaaggctactgggctagttgaataattgaaagaaagaagattgtaaattattagaattaacaatactaaactctgtggtaaatgtatagtgattgtttcttcaaagttaatgtgctgtgattttactgttattgtaattactttctcacttgagtgctggtttataaagctcagataaaataagcctgtagatatt

SEQ ID NO: 220502 - DNA, 159 bp, Homo sapiens
agatataatacgagatgtgccctggatttcagagacttgggaggaaaaataaaagaatataaaatgtcccatgagtgctttttctatattaggtagcaacattataatattttagataaataaaatttctttatagatgaaataaatgtaacatcatta

SEQ ID NO: 220503 - DNA, 469 bp, Homo sapiens
ggctgtgtagaaagaagtagatataggagactccattttgttctgtactaagaaaaattcttctgccttgggatgctgttgatctatgaccttacccccaaccgggtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaatactgcggaaggccgcagggtcttctgcctaggaaaaccagagacctttgttcacttgtttatctgctgaccttccctccactattgtcctatgaccctgccaaatccccctctgtgagaaacacccaagaatgatcaattaaaaaaaaaaaagcaaagaaaaatttatatattactcatttattaataaatcagaaactacaagaagctatcaccc

SEQ ID NO: 220504 - DNA, 314 bp, Homo sapiens
ttcttctatttaagtggagcatgctatcttcatgtgccaacttgctataaggaaaagaaaaatcctgtcccatggccacatgtaacacctctcatcaacaggggtcattctttaaaactgaacttttcctcacagtacaacatagataagagacaagtcatgagagaacctagataaaagacaattaaggtgatctgatgcaaactcatccttaccaccagaaaaacaattctaagcacatgccaaaaaattattaacagatcttcaggcttttagtcgagaaactaaaaggaataaaaaattaataacaaagc

SEQ ID NO: 220505 - DNA, 424 bp, Homo sapiens
cgcaggggctcacgcctgtaatcccagcacctcgggaggccgaggtgggcagatcatgaggtcaggagatcgagaccatcctggctaacacggtgaaaccccgtctctactaaaaatacaaaaaattagccgggcctggtggtgggcgcctgtagtcccagttactccagaggttgaggcaggagaatggcatgaacccgggaggcggagcttgcagtgagccgagatcaggccactgcactccagcctgggcgacagagcgagactccgtctcaaaaaaaaatagtaatttcttgataatatactctaatcatttactcagcatatcattccacaaataaaactacaaatatttattgagcatgtactatgtgccaagcactactgtgagtgctagagatgaagtcgtgaacaaaaaaggctc

SEQ ID NO: 220506 - DNA, 364 bp, Homo sapiens
gcaaaaccggagaggctgtgggaagctaagcctacagcagcacacagctgaatgggaccagagtcacagcacaagccaccacgaaagttctgagcaggtgggtggtcctgcataagcactgctctctccaggggtacagagggactcttggtgggagagcactgctacgtgacctccatgtcaccaacctccagtggtttcacatgtgtcttcagcactctcagcttcctgcagtgaaagaaagcaaatgagatccctgagtgtgaataacaaatagattgttaactgtgaagtgctgtgcacacatatgtgtgtgtagataggaagattggattaatattagtaaatttatccacccaacttg

SEQ ID NO: 220507 - DNA, 566 bp, Homo sapiens
aacatatttggctgataattcaatcatcagaattatttctaataattccacatttctaggtctcttttctattgatttttctcctggttatgggtcattttcctgcttattatttgtatgcctagtaatctttcattaatatattattaatgctgaacattttaattgttaggtgctggcttttactgtattctttaaaagagtttagttttggcacataattgagttacttagaatcagcctggtccaacaactgctaaaaatgcaaaacttagcgaggcatgcacacctgtagttccagctaccctggaggctgaggtgaaagaattgcttgaacctgggaggtgaaggttgcagtgacccgagatcatgccactgtactccagcctggtcaataagagcgaaactttgtctcaaaaaaaacaaaacaaaacaaaaacaaaaaccagtatgtggtccatccatacaattcagccacaagaaggagtgaagtacagattcatgctgcaacatggataaacctttaaaacattatgctgagtggaagaagccccgagatgttcggg

SEQ ID NO: 220508 - DNA, 409 bp, Homo sapiens
agatcgtgccactgcactccagcctgggcgacagagagagactccgtctcaaaaaaaaaaaataaaagaattcatggaattacacttgtgaaatacttagcatagccatcactataggaaaaaaatctaaggccaggcacagtgcctcatgcctgtaatctcagcactttcggagtttgaggcaggaggatcacccaaggctaggagttcaaggccagcctgggcaatacggtgaaaccccgtctctaataaaaatataaaaattagtctgatgaggtggtgcacctgtaatcccagctactcaggaagctgagacacaagaatcactttaacccgggaggtggaggtggcagtgagctgagatcacaccattgcactccagcctgggtgacagagtgagacctgtcaa

SEQ ID NO: 220509 - DNA, 455 bp, Homo sapiens
tcctgcctttggactacaggtgtgcaccaccatgcccggctggtttttaaattttttgaagagatgaggtcttgttatgttgccagactccgtctcaaaaaaaaaaaataaaagaattcatggaattacacttgtgaaatacttagcatagccatcactataggaaaaaaatctaaggccaggcacagtgcctcatgcctgtaatctcagcactttcggagtttgaggcaggaggatcacccaaggctaggagttcaaggccagcctgggcaatacggtgaaaccccgtctctaataaaaatataaaaattagtctgatgaggtggtgcacctgtaatcccagctactcaggaagctgagacacaagaatcactttaacccgggaggtggaggtggcagtgagctgagatcacaccattgcactccagcctgggtgacagagtgagacctgtcaa

SEQ ID NO: 220510 - DNA, 380 bp, Homo sapiens
gatttcttatataaaattagaatattttgcataaaatttcattaaagggtcatggtagatcaaaagatcttacagatttctactatggccaggtgccgtgggtcacacctgtaatcccattactttgggaggctgaggtacacagatcacttgaggtcaggagttcaagactagcctggccaataaggtgaaacactgtctctacttgaaaaaacaaaaaaaaaaacaaaaattagccgggcatggtggtgggcacctgtaatcccagctcctcgggaggctgaggcaggagaatcgcttgaactggggaggtggaggttgcaatgagccaacattgcaccactgcgctccagcctgggtgacagagactccatctcaaa

SEQ ID NO: 220511 - DNA, 422 bp, Homo sapiens
agttaccttgttgcataaatcttagacacttacctatctatatgaaaattattctgaagttttactcttgctgtggaaaatgagtcctgtaaaaaaatcacatggtatgatcaggttcctctgccccctctaacccctttcatttaaaatagtggtttttttttcttttaatgcatttacaggcactttttcttttcttttcttttctctttttctttttcttttttttgagacagtgtctcactctgtcacccaggttgaagtacagtggcaagattccactctgtttcccaggctgttatcgaactcctgggcccaagcgattgaccttccttggcctgccaaagtgctgggattacaggtgtgagccactgcctggccctacagccatctttttaggaaaaaatctctgcttaaaatga

SEQ ID NO: 220512 - DNA, 392 bp, Homo sapiens
tactgagacagggtctctccctgtcaccctgcctggagtgcagtggcatgataagctcgtaacttaaaactcctgtgctcaaggatctttctgcctcagcctcctgagtagttgggaccacaggcacgcgccaccacgactggctaatcttttttttttttctttttaaattgagatagagtttcattcttgttgcccaggctggagtgcaatggcgcaatctcggctcactgcaacctctgcctcccaggttcaagcaattctcttgcttcagcctcccaaagtgctgggattacaggcatgagccactgtgcccggcctgtccatgcttatgaactccagtcatgaacactccttctgtgtctttctcctcacccttctgtgtctttctc

SEQ ID NO: 220513 - DNA, 688 bp, Homo sapiens
agataaggtaatttgtccaaaggtgagttcccatctgtactgactctgatcatttactcttttttggaccacagagtctcactgttgcccaggcgggagtgcagtggtgcaatctcagctcactgcaacctttgcctcccaggttgaagcgattcttgtgcctcagcctcatgcctcagcctcccaaatagctgggattacaggcgcccgcctccacgcccagcttatgtttgtatctttagtagagatggggtttcaccataccagccaggctggtctcaaattcctgatcaggtgatccacccacctcagcctcccaaagtgttgggattacaggcccgtgagccactgcacctggcctgatcctgtactcttctgtgtattgttttgtgtttgtttgtttcttttagagggtctcactctgtcgcccaggctggagtaaagtgatgcaatcatacttcgctgtagcatcgaactcctgggctcaggcaatcctcctgcctcagtcactggggtagctaggactacagacatgtaccaccacacctggctaatttttttttttttttttttgtgacagtttcgctcttgttgcccaggctggagtgcaatggtgcaatctcggctcaccacaacctccacctcctgggttcaagcgattctcctgccttagcctcctgagtagctg

SEQ ID NO: 220514 - DNA, 367 bp, Homo sapiens
cctattctggccatttgatagaaatgaattgtataatatgtagcctttgggtttggcttctttcacttagcagtcagttttcaaggttcatccatgtgtcaagactttattactcttttctgttttgctgtgttgggtcttgtgttgcctaggctggattcaaactctcaggattagtcaagtgattcttatgcctcagcctcccaagtagctgggactacaggcgggtgccattgtgcccggctaaaacttcattcctatttatggccttttatgcaatagtcccctcttatctgtgctttccctttccatggttttacttacctgtggtcaaccgtggtctgaaaatattaggtggaaaattcca

SEQ ID NO: 220515 - DNA, 423 bp, Homo sapiens
attttagcaaccgcgatttccaatgacattacagcattactgaacagcattgtacttcgactatctcttactgttacataggtttagatggctgctaatgtggtaagaagtgaagcctctcatttgctggctctgctgaaagagctgtggaactgtaaaacatgtagcatgttccacttgtctcatcagtgatcgctatatctggttagcgggaggcgtggcagttcatttccagattacatacttttccatggaaatattctggtttcttttcaagccctttcaaggtgaaaagtatctgaggatggtgcaggtggagtgtgagcttcctaggaagcaggatggagtatgactatgtaccaatagtgtatagaaaaattaattcaggaaaactcccatttctattctgttgatgcaattagg

SEQ ID NO: 220516 - DNA, 549 bp, Homo sapiens
aggttgtccaggaaacaaataaccaaaccaactcaatcatgcctgagtcattgagcctggtctaaactgtaacccacgtcaaaacaaaacaacagaaaccccaccccaggcaatgagactgctcgagtcctccctgggagcacatgtgtcctgtaccttctcttgtttaatcttctcagaaacccagaacagtaggtattattattactgttttacagatgtcaaaattgaggctcaaaagcgaagttagataggcctgctggagggactcactatgccagtggaacgttgagatttgaaccccaatctttgactccagaagcagtgctcttggtgtttccatgaggaaaatatttgtcatctaatccatttgtttctctccaatgagatattcctgatgagtaaaaacttgtccagacagggccgggcgcagtgtcttatgcctgtaatcccagcactttgggaggccgaggcgggtggatcatgaggtcaggagatcgagaccatcctggctaacatggtgaaaccccgtctctactaaaaaataca

SEQ ID NO: 220517 - DNA, 675 bp, Homo sapiens
ctctttgtctgttttataacaaaaggatcaattaaaaaagaaaaaaaaacaacttagactggcagtgccaggctggcagggacagcctgtctggtcaccactgtattctcagtggtatatagtaggtgcataaagaatctttgctgaatggatgacaagatgagtgactgaggtagcctgttcccagtatgatcctgagctcctgactctcatgtccttgtagcgcctactctctttgagtacgggctaaacttattgtttgcctctaatttagcaataggatgccacttctgagattaggttataaaaaagactatggcttctgtcttgtccctctcttactctctctctaacatccacagctgtgatgccacgagaatactcagatagcacacggacaggcccacatggcaatgaattgcaacttgccagcaaccatgtgggttagcttgaagtgaattctctagtcctgtgtcttcaggtgactgtagccctggctgaccatgtgactgaacctgaggagaagctgagccaaaggcacacagataagctgcacctggattcctgactacagaaactgtgaagtaataaatgtttgctgttcaaagccaagggttggcaaaatatattccacttgtttctgtaaataaagttttactggaacacgaaaaagtt

SEQ ID NO: 220518 - DNA, 308 bp, Homo sapiens
tgatgccctgggaaaaccagtacactggggaaggcaggctctgcggctgtcagtgtgagaattctccacccggggcctcttctgcttaggacagtctggatcacacggctccctaccgtgcaagaattgaagttgctgcagatccatatggaattgctgccagtaactcggacaccttccactggtaacaaccgggctgcctaaaccacggatgggggacaacttgagtttacagaacaggttgtatgagtgttttaggcatggtatatgaatctccttgttaataaaagttttcatgtgttgcagaa

SEQ ID NO: 220519 - DNA, 412 bp, Homo sapiens
aagcacgaggaaatatattcatccattcctctacttgatgaccaaaaggaataatgctttagatttggcaattttggttaaaaggatgaaaaacttttgagctatttaaaaagcaagtaactgggccaggcatggtggctcatacctgtaatcccggcactttgggaagccagggtaacagaatcactcatgctcaagtatttgagaccagcttgggcaacatagtgagacccaaccccacctctgcagaaaaatttttaaattagctaggcatggcggtgcacacctgcagttccagttacttgggaggctgaggtgggaggatctcttgagcctaggagtttgaggctgcaataacctatgattccacccctacacttcagcctgggttacagaatgagaccctgtctca

SEQ ID NO: 220520 - DNA, 555 bp, Homo sapiens
atttcacaactagcaaaagaacgtttgttttctttaaactggagagcagtgctgtcattgggttgttttagttttagttttgcaaggtaaagatttcttaaaaaaaaaaaaaaaaaaagaaaatcaaacctgacatcatctatcaccaccatttcatataaaaagtacattttagtattgaaaggtagacacaatctcaggttaaaggacagtgttttctgttaaataaactcagttttatgtgtagtgttaaaagtgagggctctgcagtcagtttgcctggattcaaatcctggttcttccactaactagctggaaataataatagtaactacctcagaaagttactataattaagtataatgcacataaagcacttagcatactttatggtggatagtaagagctcgtaaatattggctattaattaatagcttatttctctcacctttctgcagatgagtgatgaaaatggaattagactcccaactggtgacaattagatcacaattaggttaccaaaaaacttccaaataaatgactattttacttacc

SEQ ID NO: 220521 - DNA, 416 bp, Homo sapiens
caggccccaatgagcctggactagtgagaaacaatccatgctatttattcagatgatagaaaagccagcagggaagggaatggaaagagctcctgctgctcagaggaattctctctcccagactcttcagtgagagacatgggtagcaaagggaatgataaggaagttccaaccagccagcatgttccaggccacacccacttttaagggatgtttaatgtatctctatgcatggggtaatatggaagtcctcatcccattcccagtctgtatcaagatgcctcttctccccagctactcaggaggctaaagtgggaggatagcttgagcccaggagttcaaccctgcagtgagctgtgatcataccactgccctccagcctgggtgatagagcgagaccctgtctctatttaaaa

SEQ ID NO: 220522 - DNA, 641 bp, Homo sapiens
cagtttggaagggttatggtctttttgcagtatgcaagtcagatgcccaggacacactgtgatttgtgaggtgcacttgttgactttttcctgtgagggtttgcttcctaaggcgttgagaacccttccattatcttgctaaccttgctacggattatcctgagggagtagcagacaaggtggtgagtggaacttggttaatggaatgcctataagctatgtttttgtttgtttgtttgttttttaaacatgaaaccttatttcttctggagaccaagttaaaaaaaatatggagatttgctcatgtcaacaaagttatgtgtatagcgtttaaaactatctaatgtgatttatgattggagtggtgggggcagacgtctttgtctaaaatgagaaacgaagctcgttctggatcttgtgtctggaaaggagaaatggagaaaggacaggcatttatttgggttatctggaattctacagatgttcttttggccatactgcatttaaaagaaaaaataaattaaaaattaagaatgcattaaaaatcagtcattttgcattcatgccatcaacaagtttctgggtgcctagagcatgccaggtgctgttctaggcactgggggagacaaggtagagccgag

SEQ ID NO: 220523 - DNA, 218 bp, Homo sapiens
tgtaggtaatagaagcacctgctcacagagttgtgaatattaaataaggtaatgtacttgaagttcttaacactatgtctgctacagagtaaaagctcaaatactactcactaaatactgtagttattactggtgacactactacatttacattaaattaaacctcagccagtgtaccttaaacgttgaaatggctataaaaaaatcgaaaattttac

SEQ ID NO: 220524 - DNA, 268 bp, Homo sapiens
cctctggggcccttcacgataactgtgtgtcccttcagagtaatgttgacattttctagaatgttagcagtctgattgctgagaacggtcttcattctcgcagcagacatggcaaagaaagcaattaccagacatttttaaaacaactgtgggctaggtgttatgattcacacctataatcccggcactttgggacgcagaggtgggaggatcgcttgggcccaggaacttgagatcaggcaaaatagcgagacccctgtctctacta

SEQ ID NO: 220525 - DNA, 452 bp, Homo sapiens
ttgaggcagtgcacacagaaaggaaaggctctgtggttcctaaaggctcagactcttaactacagcgcactgtcctcttgtcaaatccttggtggctcaattctccttccttacttggataatcttcctggaaataggtttagttcaccaggggagcattccggggtgtgtggctcagacctgggtccaagtcttctcaggctttcccgaacccatcccctaccatcactcaaggaagacgtggtagtgactgattagcctaagatgttggtcccagagcaggctgcagtttggactgtgggctggagagggaaggcatggtgatggctttgaaggtgacacctcgatagcgtctgcaacaacggaagacagaatgccacaggatactacactgggtagctggagagcagggatttatgtctttaaatcaataaattatatcttatatctct

SEQ ID NO: 220526 - DNA, 1847 bp, Homo sapiens
  misc_feature (1846)..(1846): n is a, c, g, or t
ctcctgccctccactgactccagagagggagatccccagtacttgactccatcacgcagatgggagcaggcaccagctatggagagggatacagctgcgtctccacatgacccatcctgcatgacaccaaagccaccgccagacagtgcctcggattctatgcaaaacctgggaagcggagacctaccccagccccgggaggaagctagctcttcaggggaccgtctgaggactggagtttgatccatgaacctggcttcgaggccttgcttttctctcttcttcattcatattcattcccaacaccttagaaggtgttgcttaatttatttctagaaaagcagcccagagtcagtcattgaagccttccccaccccctggccaaaaaaaaaaaaaaaaaaaaactggacacattttggatctgttgggagcttggagtccagtggttggcatagttgtcacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggtaatagccctagccattggtgcacaggatgggggcaatgggaggggatgctactgatgggaatgattaagggagctgctgtttaggtggtgctggtttatgttctaggaactcttcatgagcactttgtaaacaccctcttgcttaatcctcccaacggcccccaaaggtagaacttagctcccttttaaaaggagcacattaaaattctcagaggacttggcaagggccgcacagctggggcnt

SEQ ID NO: 220527 - DNA, 324 bp, Homo sapiens
aaaattagagactaacagtaaatttactttaatttttacgaataattctctatcaatgtaaaaatttttcatatacgcgtgtatgaaagaaaaacactactatttttccacattcgtgaaaactgcttaactgggacagtaaccgagcggccagtgaatatttaaaatactgtaaccgacgaatacgtatgcttctaggaccacgtggaatctttcccatggtaggtaagcaaaacaaatgtgcttcccagaaccctccaaactgctcgtgggtatattactacagattacataatgcagcagcgttccgggacgcaagcccag

SEQ ID NO: 220528 - DNA, 567 bp, Homo sapiens
acagttgcagttagcacattttactgaaactttactaaatacatagactgctttttggtaatctaagatctgaaccctcttcttaaattacatgaatttcttgataaatagctcttaatttgggtccttcctccaaagtaagtctaaaccccagatactttctcagcttcctctagttaaggaatcagcacttaatctatgctccgccaatgagatgcacctcctctgtatttggaactgagagtttgtgaagcaaagaagcagtgaccatggggtctttttgctggtgttagagaaggctgaggataaaagccaacacagaggagggaacagctgcattggtttccattgtccatagctgactgtggtgtaagctgaggtgtctgttcttcagaaaagctgcagcagggctcaccggactcatttttcacttgagttttgttctgtttctggatgtcagtttttcttcttcctgctagttttctaagcctagtcttacagatttctgttacctgccctaaatttgtttcattaatcccgcttcttgattaatccagaataggcttc

SEQ ID NO: 220529 - DNA, 522 bp, Homo sapiens
ctccgaatctggtgacagtgtgtttgcaccacctggcttccacccactctgacccttctaatttacttccctggaaaagcccaagtggtgtccaacatgaggctggggtcattcttccaacagcccgaccccaaggggcatgctggtcagacaacagcctcgctggtggggtggaggggacggtagggagcgagtgggcccggtgactcattgtgggtgcttctctgggattttggaggctttgttgtgttgctcagggcccttttaactctgtctgacctatgggaggggacagcaacgagggcttttatgactggaatgaactggaaacttggcctctgagagcccttaaaatgttttggaaacctctaggcatacttagggtacttccaccatgattatcatcggctgtgtggcttccgatcgctaattcgcaccgggcatctggcgaggccggcctggggaaattgggatggagggtcctgctggagggaatcctggcgctttgggcggaggagtgct

SEQ ID NO: 220530 - DNA, 335 bp, Homo sapiens
agattcagacaacgggttcaataagtaaaatcttccttgaacacccttccccctagaaattatcatgtcctatagatcatttcacagagttcctactctctctggggaaaaaaaaatcacagaaatatctcacaaaatgaagatattttcttcccataatcatagtcataagtaaaatatgtatttgaaatttgagatcaaaaaaaggtagaattgattttcatgaacactagacatgtgattcctgtcctcaacaatgtgacccgcaaaaccaggatcttatatatgcccttgttttggggaccagggacaagatgcaatattcttgattttaa

SEQ ID NO: 220531 - DNA, 426 bp, Homo sapiens
gaacgctataaatgaaagtaatggaaattttattatattctattatcgattgtgtgattagagttgttgagtggtaactcagtgtctcatgtgtgtgaaagagagagaaatgatgacagttgtaaaagcctaagatacacaagacagaatagtggttaggatcataagcttggaaattagaaccgatattttacttccagtgtctgccacatctcagtggtatgactttgggaaagtagtttaatttctctgagttacttcatctgtagtatgcagattacaatagccaccgcacagtgggtataaagatgagtaaggttatatttttgaacacgtagaagagtatctgacatacaataagtgtgtaccgttaaagtatacttaaacaaaatttaatattaataaaagctatatataggtatatgg

SEQ ID NO: 220532 - DNA, 320 bp, Homo sapiens
agggctgtaataagattagatgttgaacatctaaatggcagccccgccacgccaacacccagcatatttctctttatataaactactctgactcagagagggcctcaaagaaggattcaaagtatatatcatgaatttattttgattaagctatagaaaatacaggattgcattccaggtttttgtttaaaaactaataaaaatgactctttaaaaagtgcagagtagacatgtattctatttcattttcttttctggttttatctttgaatacaagtagttatagcccaggtattctttctcaagagaaaagttgaaag

SEQ ID NO: 220533 - DNA, 1988 bp, Homo sapiens
ttctgattagttggagtttaagttgtattcttctttaatataggcatttacaagaaattgctcaagttaagttttgcttatgtttgcaaatcaagctaggttcaggtcacatctgaggtcttgctggctatgtctgcttatagtttcttcaggcctggtctccattttaatttactttaccactgtgttggaatactgttgattaccccattgggctgcaaggtccacgaaagcaaggtcctcgcctctcctttggtcaccaaacatagtgcttggcactaaatagtggctcaatgattatttgtaaaataaataaatgaataaagagatttaaagttccctagaaagtgaaatgtctttctccttgactttacataccactcagaagattctggacctactagaattcttcattaagaattttgttttcctggtattttccagctatcccaacttctgttaacaaccgaaagttagcaggaatgggggaaaggccatatgatttaaatgcctccaatgagggctgctactgattaattttagatcccaagcatctgggtcaatgcctagtttcatggcaggtatgcaaatgattattttagtgtcattattaatgattttactaagagctgggagcacttgaaatgttcctccaaatgagatttgagatgtagaccagatggtcattttttaagagcatctatatattctattctacttttcaacacataagtttttatattaagattgattactaatgtacctaagcacccacatcagtattcagtaaaaaattagacgcattatgtattttttaagaataagaaatgctccattgagatgataataatctaaatgaaatataatcatccctgaagttgaatctagccattctgttttgctttaactaggttaaggcctctaagtcattttctttttctccttcccctggcaatatatcatgttctacagagcttaatattgtgtgggtacaacctcaggcataagaaaatggtctcatcagtcttagccccaaaatgctgtttggtcaggcaggatggcttaggtaagtttgatcacaaataaatatgtcaatatctactcattccctgaatcccaaaggtcagtgctcaggggaggatttgtcctaggagtatcagttttattcttcttggtcatgatggtgctgagaaagactaatatacactggactataatctttgagccagaggaaattgaatcaaaccaagtggaaagaatgtgctatttagtattagcagggtcagttaatggaaaaattgtgaaatgggtgaagttcatcattgatctaactcctgcagaacaaacctggtctccccagtcccaggggcatgcccgctggcctttgtttagaccttggcattttccgctggcttctctcagtttcttggggacttgattatgtgcactgaaacaaagccattctaggttttgaggtttctggttgggctctttccttccccaccctcaaatggatattagcttatttgatggatcaagctgtcctcatttgctaacagaaacggcttaaggaatttctgggtcctctcaggtaacatgtggatttcacagtgactttcttatgacaaaactcttccagtgtgtatgactcaaatgagtgagtttgctggtgtggatttcagtccaagtagtatggacagatagatccctgcctttgaattttatgaagcagtaatatataataaaaaagagagagaaactgacatagagttgcccgtttattttttctttttgccaagtaaaggcattatggaaaaagaacaagactcacctactaagacaatcattttataaaagaaataaacataggccgggcatggtggctcatggctgtaatcccagcactttgggaggccgaagcaggtggattgtttgaggtcaggagttcgagaccaacctggccaacatcgtgaaaccccatctctact

SEQ ID NO: 220534 - DNA, 464 bp, Homo sapiens
cctgacgtcaacccaatcaaccgctgatcagaaatgttttaaaaacaagaaaaacaatacaaattagtaaacagtacagtatagcaactctttacataacatttacattgtattaggtattctaagtaatctagagatgatgtagcgtgtacgggaggatgtgcataggttatatgcaaatactataccatcttatataaggaatttgagcatccttggattttggcatccttgtggggagtcctggaaccaatccctcagagacaccaaggaacaactgtataatattggctgtaaggttatggttgatgcttttaatcaacttgaagaagttctcctccattcctaattttatgagagttttctcatgaacatgtgttgaattttgtcagatgttttttatgaattagttaatatgatcatgtaatttttcttctttagcctgttgattgggttgacgtcag

SEQ ID NO: 220535 - DNA, 696 bp, Homo sapiens
cagctcgtaccgctaggatgtggctattcatccattttgcatcgctataaaggatacctgagggctgggtaatttacaaagtaaagaggtttatttggcttatggttctgcaggctgtacaagaagcagatacttatggtgccagtatctgcttctgataagtacctcaggaaactttcaatcatggcagaaggtgaaggaaaagcaggtatgtcacatggcaacagaggaagcaagggggggggggtaaagtcgagtatctggtgaagtggaaaggatggcccccaaacatcgcactactgatgacaagcaggcaactgcgttggagagggaggtcatcatggctgcaaggaagggaccggacccatataatatactacccctaaaggcagcttcaggcaccaaagaagaccctaatttagtcctctccatcaccaacaagagaagagtgggctgcatctgcgtagaggacaacagtaccatcacctgctttgggctgcacaaaggcgagacccagtgatgccccagctatggaacccattacaagctggtgccccgccagctgacgtactgagcacctgcaccaagttacccaaaatgtgctgcaaagtttcttctttccaataaagagtagccattgcattggctccttctcccattaaaaaaaaaagaagaaagggccgggcgcggtggctc

SEQ ID NO: 220536 - DNA, 406 bp, Homo sapiens
cccctaggaggaaaaactgagccacgtttttagggggtccttaggagcacgtagagcagagcccgcacatggccctggagccccttaaggacccactgtttttggagatgctgcaagtcccccctcagcagttgccctccacgtttgtcagatgggaagaccttggccctgggagttgaacatctgaccccgttgttatggccccagccaggcaatggggaggattggtgggcaggcctgtggggagtgtcccctccctgacagacagcagagggcgggcgaagcggatgccttcccttcccttagatgtcaccagtgtttccttttcttctgccacctgcttcacaccccagggaggagagagaccgagcatcggggtataggaagagaggtccgaaacccaagc

SEQ ID NO: 220537 - DNA, 621 bp, Homo sapiens
ccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaagggtaaagtcgagtatctggtgaagtggaaaggatggcccccaaagtacagcacgtgggagccagaagagcacatcttggacccccgcctcgtcatggcctacgaggagaagtacggtgtcctcggcaccgccgggtggggcttagggccggctcagaggcttcccaggagcctgctgctggcttggcaggggttgttggggcagggcaggggtgtccgatggggcaggccagcccagcctgcagctgggtgaaaatggtgggcactgagtcccagggcagctgaggaccctggggccctttcctgttgttgggtgatctcggtcacttcctttacccacccgggcctcagtctctctgctgtcaaatgggccaccctgaagagtacacccatttcccagggtgaaacctcagaggggccgtaagaggtttctgttccagtgaagaatgttaaaatgcttcaca

SEQ ID NO: 220538 - DNA, 600 bp, Homo sapiens
ctggtatcaggaaggagctattcatctttttatttgtttatttgtagagactgggtctatattgcccaggctggtcttgaactcctggcctcaaatgattctccctccttggcctcccaaagtgttgagattatagttttcaccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttca

SEQ ID NO: 220539 - DNA, 949 bp, Homo sapiens
aaactccgtgtctactaaaaatacaaaaattagccagggatcgtagcacgcacctgtaatcccagctactcggaaggctgagacagaatcacttgaacccaggagtcagaggttgccgtgagccgagattgtgccactgcactctgggtgacagagcaagactctgtctcaaaagaaagaaagagagagaatattttggattcttaataatttcttagaaatcatggttattaagaatccaaaatattcttttatttatttatttattttttgagatacagcctcactctgttgcccaggctggagtggaatggctcttcacaagcatggtgtcactgtttcttaccaatacatgaacctgtcaagcactgcacacctcaagctttggaatcagactagcaaccatcactctctctcttttccacattgattttcacacagtactatgacagatatcacatctccaaaggaagctagtgtggtctcaatgctgaggctgcatgctctccccatctagtcacttacagtgcccagctgatgttgagcatcactgttttcctcgaaagtttaaaatagccagtggctcccttgatcacttgctgtggcacctcagactgccttggcacacgatttgagagccatggggttagaccgatgttaggggacacaacctggggttgggactggcccagggatactgagtggctctcaggatctaaacagttgtggggttcttgccacagcctctttcacatcaggcaattagcagatgagttacagggggaggctcctaggccccagttggggaagattctggtgtctataaaatttaggaaaacttaaaaaaaaatttttttttttttggcttgggattacaagccaagccaccagcgtggccaagatggtgaaaccctgtctctactaaaaatataaaaattagctgggtgcg

SEQ ID NO: 220540 - DNA, 893 bp, Homo sapiens
aaactccgtgtctactaaaaatacaaaaattagccagggatcgtagcacgcacctgtaatcccagctactcggaaggctgagacagaatcacttgaacccaggagtcagaggttgccgtgagccgagattgtgccactgcactctgggtgacagagcaagactctgtctcaaaagaaagaaagagagagaatattttggattcttaataatttcttagaaatcatggttattaagaatccaaaatattcttttatttatttatttattttttgagatacagcctcactctgttgcccaggctggagtggaatggctcttcacaagcatggtgtcactgtttcttaccaatacatgaacctgtcaagcactgcacacctcaagctttggaatcagactagcaaccatcactctctctcttttccacattgattttcacacagtactatgacagatatcacatctccaaaggaagctagtgtggtctcaatgctgaggctgcatgctctccccatctagtcacttacagtgcccagctgatgttgagcatcactgttttcctcgcttggcacacgatttgagagccatggggttagaccgatgttaggggacacaacctggggttgggactggcccagggatactgagtggctctcaggatctaaacagttgtggggttcttgccacagcctctttcacatcaggcaattagcagatgagttacagggggaggctcctaggccccagttggggaagattctggtgtctataaaatttaggaaaacttaaaaaaaaatttttttttttttggcttgggattacaagccaagccaccagcgtggccaagatggtgaaaccctgtctctactaaaaatataaaaattagctgggtgcg

SEQ ID NO: 220541 - DNA, 372 bp, Homo sapiens
tgtaaggcttaaaagaattaaagtaggaattgccgcaattcccttcctagacttattcccaaatatacttactatggactacctgcatacagcagccccttcacatatttttactgcctgtcataaagtagtctgggttacatttaaagaagctgccagcacttaatgcatagaagtactaaaaatttgttactgatgtttgaaaaatatagaaaattagaagcggaatggctgagtgtagtggcttacacctgcagtccctacatgttaggaggccaaggcaggaagactgcttgaggccaggagtttgagacttgggcagcatagcaaggctttgtctctacgaaaaattgaataaatggataaataata

SEQ ID NO: 220542 - DNA, 592 bp, Homo sapiens
aagtgtcataatagcaggaaaggagttgctatttcaaacaatttaacataagtttaaagagctttattagatcaggattacatttgagctaccttgatgctcagttatacaacttgttgattaaataaggattttttaataatcgaaaacatcacttatataaaaagcagcccaaataattcaaaccaattcagtgagcatgatttacatcccagttcttcagtgtgtttcactgatgttgatgctggcattccctttggcatctgaatctctcaggactgagcagacatttcaaactcactgtacactgcagccccatagcctgattcatgtgaaaccaagtcaatcgccatcaccaatatccacacatatttttacaaagacaaccaacttcttttttttttttcttgagacaggatcttactctgtcatccaggctggagtgcagtggcacaatcttggctcactgcaacctctgcctcccgggctcaagcaatcctcccacctcagcctccccatgtagctgggactacaggcacacaccatcaagcctggctaattttttgtattttttggagaaacagggtctcac

SEQ ID NO: 220543 - DNA, 356 bp, Homo sapiens
caagacaaagaaaaacaaagcaaatatttgattggttcaagtggaaagtccctgattacaggttagtgggcagtttgtgattagttaagtttctctaagttgggttttggtttgctgatgtaggaacacagaatgctggggccgtttcaacctaatggtctcccaattaatttttttaacattactgatgactgttaggagtctaatgtgctactcctcccagggaaaatggcattcctaggattaaaggaactcagcacatggagtgtgcgtagaaatttagacactaactgcaggctggtgggagagagccctttagggcagaatgagaaggcgtccggccaagggcaggagtt

SEQ ID NO: 220544 - DNA, 289 bp, Homo sapiens
tgggctgagcacgattgcagaagtgaatgacttttcacgttacgcttaactcttttctctcgggtgctcagagcacaacttaaagcattctctctgagccaggggaatagcatcctggaatgtaagcccttgaagatggaggtctgtaaaagaaatattcagtgttaacttggaattcagtgaacttttttcatattaaaggaaatttgtcaagaaaaataattgcacagttaaattgtgctacagttgttttcattaagaaagtagaaagaagaccctaacagtttaa

SEQ ID NO: 220545 - DNA, 605 bp, Homo sapiens
gtgtactgcaaaggaaaacagagcaaagtggaagatgacagtggactaacataaaccaagaagtagctccaatagcagcgtgctgtgcgggatgtagcatcccttcgagtcagcacttgatatgaggctggagattgggttaatgaattcttttaaatccccttcagaaaagagaatcaagaacaggttgaattcacctgggtcagataacacagtgtacactcaaagttttgctccaggagcatataaaccctcctgctctgttacaaaactgtccaaagaagtccttgatcatcgtgacattctgtagaacatcatcctggtccaatactttgatgacaaaatgttaactggacctagtgaacaggaatgaactggcaaataatctgagtgttccttatgacacatgcaccagagagaaggaggtaattcctacaaagattcagaggtcagaggcccaacaatctagggaatactgggacatcctgccaagtcaagagccagttattgcattttgtaccttctactactaagagaggtagcactaggtagtattatctggattctgaagtcagcatgtccacacttaggaatatgctctgagc

SEQ ID NO: 220546 - DNA, 363 bp, Homo sapiens
tttatatggtatggggacaatgataattatagagactgtggattgggtgggcttttgttaataatattggaaactttgaaagagaaaattacaggcttacagcagccagttgccaatctgaggcattcaatgaaagccacagggcctctatggcttcatttatgcagcaccttgacatctatgagtatagagcacacagcagaaaattaggccatagatttaattgtactgtgacagaactacacagatgatgtttagaggcaagattgatgtaattacactagtgggtaacaagaagagaatggaaataaggatgtcttgatacataggtatctgtggtaatggcaaatagatcctagtgtt

SEQ ID NO: 220547 - DNA, 413 bp, Homo sapiens
acacacaaagaagtcgtgaagcaatcaagtcagggacttgttgaaagtcaccttgtaaacataatttccaaaagcccaagggagaaaatagtatttgtgtgtatgtgtgtgagtgtgtgcgcaggcttgtgtctctgtgtgtatgtatgtatatgtgtgtgcatgtgtatctctgtatatgcatatacatgcaggtttatgcatatatttatgcatgtgtgtgcatgtttgtgaggtagtttgggtctgcatgtatgtgtatgtttatatgcatgagtatgcatgtttgtggtagtatgtctgcatgtatgtgtgtgcatgtttgtgtgcatgcatgtttgtacgtgtgtgcatgtttttgtgaggtagtgtgtgtgcatgttagtgtgtgtgcatgtgtgtatatgcatgtg

SEQ ID NO: 220548 - DNA, 349 bp, Homo sapiens
atttttttgagtaaactagtcatatcacatgagatttttgaaagagtaaagcagctctggattttagaaacaaatgaaactatctcagctctgcctctcaccagccaagtgtcctgggtaagttacttacctgctctgtctgtcaaaacagaataaaaaacctatttttgtaggattgtcatgaggattgatgaaatataagtagggtgcctgatacacagcgaattctcatttgatgacagccattaatactctttcgttttattaggcatcactctgacttctgtgtagcgagatgattggggtcggggtcgacgcggccgcgaatttagtagtagtagtagtaggc

SEQ ID NO: 220549 - DNA, 616 bp, Homo sapiens
  misc_feature (53)..(53): n is a, c, g, or t
  misc_feature (121)..(121): n is a, c, g, or t
  misc_feature (125)..(125): n is a, c, g, or t
  misc_feature (137)..(137): n is a, c, g, or t
aggctgatcctagaggaccccgaacatgtcgaggctgtatgaaaatgaatgtntaacattaaaataaaaatgataatacagtagaaaaaaataaacaagcacttaagaaaactagtcttangaantatcaaattttnaattaatgacaactatcaaaactttgagcaggatatcttccaacaaaaatacactcaaaagactatatacacacagactaacttcacagtagggaaactggactcagaaaatggcccacctactgtactagacctaaaggaaaacaaaagcgctgccctatagagttgtttaaagaggagggaatttttgagtcatactcaactgtgattcatccccaaagctcactggttacatgtagtgaaaattcattataatgtttcaacaagcaatatttcctacctttaagaatcacagctaaaaattcaaagcaatgaatatttccccatatttttgaaatacaatcctatttaaaacattttagttctttgcatagttgttattagtatataactaacatacaacaatttagccttcgtgttgtcaccaaacctagaacatcttaatatgtctgtacttatcacacctctcttgaaagtta

SEQ ID NO: 220550 - DNA, 146 bp, Homo sapiens
ttccaggaaatggttggagtttctcttggtcatcttatcagaacttcttgatatagaaatgaattttctgatgagtagatgataaaataatggatacaataatagagtaagatgctaaaactggtggatattctgtaatataaaca

SEQ ID NO: 220551 - DNA, 575 bp, Homo sapiens
gggtggacggctgggaggggccagtgccctccagtgatactgagcaaaccctcccagtccgagtcagtgtgcacacaaggtgcagatgatcgggccgggttttgactttgtatttagcagccgaatgtgtttctgagtcccagggatccctgcacctcgtctgggcagacaggtgactttgagggacagtgggccaccttctcccgctgcctgagcacgtcccgtagccgagacaggcgctatgctgttacagtgtgtggagtgccccggggagaggctgtgagtggtctagacgttgggtgttgatatccaccggtttgcctgtcccaaacttgggcctgggagcccggcagagtggctcaagtggaaaatgttctatatggtatatttatacatatagcatgtgggattcctccagcgagcagttgggcccctggcaagataataaagagaattcaatgagtgtggaataagtacatttcttacaggcaattttctttttctttcaaaggcagggtctggttctttcacccaggaccgaggtgcagtggtgcattcatagctcactgcagcct

SEQ ID NO: 220552 - DNA, 192 bp, Homo sapiens
aatgagctaggaagaaacataaagcactaagtagacatgtggcacacgggacatgcacaggcacggtcatttaatatttgctaagtcccagtagttatgagtgaggaaaggcctttagagaccatgggagctgaggctctgagcctggagctaaaagtcagtttcccagtttccagctctagaatctgaaca

SEQ ID NO: 220553 - DNA, 219 bp, Homo sapiens
cccaaaacctttaagctccttatgtcctcttcattgtggaactagaggtctggaaagagtggctgctataaaaggaaacactatattgtattgtcagattgaaattaaatagaagaattttatctatgcataatagatcattttaagagctactgtgttgttctccaaatagtaatcagaaatctgtattccactcttgaaaaaatgagctttgctgat

SEQ ID NO: 220554 - DNA, 295 bp, Homo sapiens
ccataaatatttatgaagctcctattatgtgtcagcacaccgttgttatgaggttgctaaagcatatacatattcagcactaaattgtagtgcaaaagtgggcttccaaactcaacatagtaaaggcatcagttctccccaaattaattttataggtccaatgcaattcttaccaaaatcctagcaaggtattttgtaatcatagatgagtttattctgaaattaattttataaattttattgtatattcataatgtaatttacattatacaaataaaaatatcttctgaaactt

SEQ ID NO: 220555 - DNA, 387 bp, Homo sapiens
tgcaacaagtacacagtccgtcttcccctcaagtcatttttccagattttgaatccatagtatgtggcaggaagctgaaaagatcagctcagaagctttaactggctgaactttcaggactgaggagataaggacctggaagggtctcaataaagaatccaggaaggccactctcaagttcagggacaaactagaggtttctaaacagagaccttaggttgtaactcaaaaaactagaagaagaacagcaaaataatctaaagtaagttgaaggaaaaaaataagaatgtagaaatcaacaaaatttaaaacagacaaaaaattgagccaaaagctggttctttgaaaagatcaacagaatctatgagctcatagctagaatgatca

SEQ ID NO: 220556 - DNA, 396 bp, Homo sapiens
aaggctgctccaaagattacaatgtgtaactttaacttgtcctattctactttcaaataataatatgatacttaatggacaatataagaatcttatggcctggggcagtggctcatgcctgtaatcccagcagtttcggaggccgaggcaggtgaatcacttggggtcaggagttccagactagcctggtcaacatggcaaaaaccccatctctacaaccctgtctctactaaaaatacaaaaattagccaggcatggtggcacacacttctaatcccagctgctcgagaggctgaggcagaagaatcacttgaacccaggaggtggaggttgcagtgagccaaggtcgtgccactgcactccagcctgggcaacagagcgagactccatctcaaa

SEQ ID NO: 220557 - DNA, 303 bp, Homo sapiens
cgtttttaaccaaactcggctgttgttggtctaaaacctgccctgggttttgagggagcggtgcttttgtgagcccagcttgccttgagtgcatggatgggaacctgaaaccagccagtcttgcctcccaccctctcaacttttccagtaaaaaatgtgacgggcactttttttccagtaaaactgttcccccagcaggacagcctatatgcagctaggttcctggcaaatgagcagggaataatagctggctagaggtgggcgggactgaaatacagctgtccacctttccggaaaacatca

SEQ ID NO: 220558 - DNA, 672 bp, Homo sapiens
tgactacaaacgggatgcacagggggacatttagggtgcaggatctgcgctgtacattagggtggtgaatacatgacccgttgcatttgtctgaacccacagaatggcacagtacaaagagtgaacttcaacaaatgttaaccaaacaacaaccactaacatcaaccaaaacgtcagaggatcccaagatgaaatgtggattgcgacaaatgaaactaactgcattacaaatgtatgacataacttcactgaaggggcggtgaaaaaggagcttacctaacaaactttggaacacggtgttttgacttgaaattgtaaggctaatgacaaaagaaactgtacataaatactgtactcatggggtatggggtaataattctaaatttgcttttcatgtgtacataggttgaaaaaataagtggatggataatggggtggctggagccaggtttcttatggtcagacaaggaagtcacagattaaaaaggaggactagagtgaaccttgtggtaatggattataatcagagacatcaatatcaactcatgtttaacttaacatatatgccaactgatacatatagaaacaattagagatgtatgtgtatacatgggttagtattcacacagatattacctagctctgtcccctgagagggcctaaaagcaacga

SEQ ID NO: 220559 - DNA, 613 bp, Homo sapiens
acatatgtaatgaatagaatgagaccgactagttattagacaaaaggcatagcaggggctgtgccaaagtggataatgcatccctgtaccttaaggcattaaagtaaaagaattaaaacaacctgcctgccaaaccaaaatgtctgtaggcaatattcaactggttgaccatcattatgcatccattgacttgtgacttaaaatatataccaccatttaaagcagtttctcaatgaggagtcaagaaatatcttgggaagctttttcaaataacacgcagtccctttaccatctgcctaattgaggaccactggtatactatgttggtatctagagctaaataataatgatcaagttgatggcaccatgtggctttagttactggccattgctaacagttttctttttgccagcagagaatgttaattttgctatggattttagcaaaactacacttgtgcacaattgctttattagagaaatgacaagagataaccatatgcagctctcaaatgacccacattataatgtctagtacatgggcgaaaattctgttttcttatttattattcatttattcatccattcaataaatatttaaatgcatgcaaaa

SEQ ID NO: 220560 - DNA, 362 bp, Homo sapiens
tatgaatataatgctgctgaatgtctgaattttggtgtcttctttaaaaactattgaatagtgttctttcagacagttaatttacttgtacataagcttgatccttttgaggtttgtttttaagatgtcaaagcaggtctagggtaaatccactcttaaagtgaggccattttccactaaatgtcccagatgttcaagaaggtctaccgactctgattggtcaggacttgattatcttccaatcttgtgtgagttctggtagttgttcagctcactccttcctgatagttgttcttccttcacaaactgttctttgccccacctgatggagtatcgttgaatacatgcacagtgtagtattc

SEQ ID NO: 220561 - DNA, 626 bp, Homo sapiens
agacaataatccaacagaatttataataggcttctttcggagttgctatcacctcacctctatcctctttgcatttaaaagaaaatcctctactccaaggagacatggaagtgaagcaaaattaagaaatattaagaattaaagatgagctagtggtatggggggagagggggatatgagggaaatactaattgaagtggagaaaaatatcatcctggaaaaaagatctagtatttttagcattaatttggtgacttttttgtggttgttggttatgggaaaattttgatgtatcagagctcttccgttaaagaatgagataactttgcccatcaacaaatgatcactatacccatcatgactaggctttttggcttagttttcctattacataatccctatgaatctgtccaggtattttttcctaacaatttctaccataccctacaccacactttgcacatttgggaatatgagccatatgaaggaatgtgaattcaccattgatatcagccaaataagccagaagcaaaaccatttttgactctaaaatactaaacgcaacaaattgccaggaaatagcaaaatgaggcccaaaagactagcatattctccacattttctga

SEQ ID NO: 220562 - DNA, 505 bp, Homo sapiens
aaggaaaatggagtggagatagaaaccaatattgatgggaaataaattcaatcatgaaaatatttgctacattaaaattaaaatactgaagtttgaaaagaaagtaggaagatttttgcttaacatatgcctccatatgctcaatatacagttcattaactaaatttagaaactgtgtctaaacgtttgcctttctaatatgcaaaaaactcacacctcaattcagaggttctcaagtctttcagtaaagacactgacaaaagcaccagacactcttttccaaaagacaatttaaaaatgtgtgcatacacatatacacagacacaaatttcacagtccatgggcctaaagttaggaactcccaatcttaaaaatataaagtaacattttaaactgttgtccgtgttagctgtctttgtgaatattcaggatatactctaatgcaagacttgctagatctttatgaaatgaaatgtttcaccaagataaggcagaatattagggg

SEQ ID NO: 220563 - DNA, 201 bp, Homo sapiens
acaggggcacaggcagcaatccagggattttgtacaaccttcagggaccaaacaaccttttggtcctcagtcccacacccacaggttcagaacccacctgttaacccttcatgttttcctctcactagccctatggggctttttccctcaaattttttttattgtggtaaaatacacacaccataaaatgtactatcttaa

SEQ ID NO: 220564 - DNA, 652 bp, Homo sapiens
caccatctcaatgaccagggttgtccagatggctcctaaaggctcccaacagggcatatcatgtgaggactgcatttcatctgtttgtaggacagttgtatgtacctttttcatacctcagaccctgtctaaatctgaagtggtggtatttgcttcctctcccagcctttcacctcctgtgcgttcactaaattcaccagtcactaaggcatgaaactgacagattttactctgaacgtccttttccttctgggagatgccaggtcctagacagctgtctccatttttctgttctttgcattctcactgctcttccctggcccctccttctgtactttaagtattagcttgactattgcagcagtcttctctttgatattcctgattgccatctccttctgtcatcgttcagtctacccattctcttgagactaatcttcctaaagcatggatctaaatatatcatttaggccgggcgcagtggctcacacctgtaatcccagcactgtgggaggtggaggcaggtggattacctgaggtcaggagttcgagaccaccctggccaacccgtctctactaaatatagaaaaattagccaggcgtggtggtgcacgcctgtaatcccagctactccagaggctgaggcaggaga

SEQ ID NO: 220565 - DNA, 481 bp, Homo sapiens
ttagtgtacttcgtacaagtatggagtttcctccgtaatgagagctcagagccttcacaggcaaaacaagggggcatgcactgtgatttgagggattttagaaggccagttggcaccaaatctctctcccatgcccactgtcaccaccacaagtccatttctttgggcaaagtattgccttctccatcttccttttttttttttttttttttttttaaattgagacagggtcttagtcacccaggctggagctgcagtgagctatgatcacactactgcattctagcttgggtgacagggtgaaactctgtctctaaaattaaaaaaaaattcataattctggatgtcttacaactttttcctcaaaatatggacatggaaaagtgtgcaaatcacgtaagtgaacagtttgatgaatttgtacggactgaaaaccctgttgtctgtctgaaataatgaagcctaaaatgatcctggatcc

SEQ ID NO: 220566 - DNA, 1185 bp, Homo sapiens
catagtcttttttactgaaaattagtgaaagcctaattagagtgaaagagtacatctgggttttgtttttttttttcttgtagaggaaaaaatgaacattacttgtgtaactgatggtagttgcaactgcatatttgccaatgtcacaaaatctaaaggaaaatgttatagtcacccgtggtttccttcttgcctggacactccattgtcccgggctgaaaagggtagcagtacagtgcatataatgtcaagttgtgggaggagtgtggcagattgtcattggtgcatttttttggtgatgtgtgtggttgttttgaggagtgggagctgttaagaacaccacaaatagaataaaataatatcgtgaagttatttggccgtttctaattctagacatttttctaaaaacagttgcaaaggaaagattacattgttttaaaaaaatttgaagtatgtttttaaataactaaattaatgttctttgaaattccaccaaaatgatgaagtcaccagatagcagctgataaatgtgtctgagcccagtgcgcccagctctacaaaaggcagaagaggaattttcaaatttgccagtgcccagtaagaggacatgaattttctagtaccagaggaaattctctttttacaaattttgtcagaggtatccttgggaaagtatttcatttgcttttaccctccaaattattttaatctatatttttaagagtttccattctcagttgagtttttcttgttcttctccttctgtcagttttgaaagtcttgcacaaaaacaatccaggtgttgttacagcagtgtgattaaaaccaggtcaggcctacactgaaatcccagttccaccactcattagctgtacgaccttgagcaagttacttatcctctctgatacccaatttttggatttttttttttttttttaaagagatgatcataacgcttaggacttgactctttgggagaattaagtgagttaagacataaaatgtgcagcatgtatttgtcatgttattagcgcttcagaaatataaatgtaaacattttggtacttcgtttatggagattcttatactagttaattttattaaaagcatgatggggaacaaaagatccttttcggataacctgtgtgagtaaattaataaaacactaacactttttaagattca

SEQ ID NO: 220567 - DNA, 163 bp, Homo sapiens
tttagcttaggtggaataaactgcatgaaaacattaaaccttttttgtgcgcccagtttaccatgaagcagccattgtactaaagttcatgaactttttctttttcccctcataagataataaacaaggggccgcaacatggagggaaacctagaaaggtaga

SEQ ID NO: 220568 - DNA, 266 bp, Homo sapiens
agagatgtgtggtgagggtcatcttggtaacaggcacatcacctgctatctttagtcagcctctagacaactccaggtattactgtcctctattttcagataggaagcaggcctggtcacaccccttggccttagggagtaggctgcagagccaagattctaaaccagccctgacctgactcctaggctgtgctttctcctgtaccgcactgccttccgtgggagagaccagcccggccacctgagtaatctgcacagccacccat

SEQ ID NO: 220569 - DNA, 439 bp, Homo sapiens
aagacaaagcatgaggctgagcagaggagtgagatcagcactgcccaaagactcaggagtcctgaacctctgcacatgtcccttaataacaaaatgggaaggggaaaacctacctggctctgggtaaaaccagagcagtcaatcaggaaaaaagagttctaataattaaaaggaagagaagccaggcatgttggctcacgcctgtaatcccagcactttgggaggctgaggcgggtggatcacttgaggtcgggagttcgcgaccagcctgaccaacatggagaaaccccgtctctactaaaaatacaaaattagccgggcgtggtgacacatgcctgtaatcccagctacttgggagctgaggcaggagaatcacttgaacccgggaggcagaggttgtggtgagtcgagattgcgccattgcactccagcctgggca

SEQ ID NO: 220570 - DNA, 525 bp, Homo sapiens
  misc_feature (36)..(36): n is a, c, g, or t
  misc_feature (52)..(52): n is a, c, g, or t
  misc_feature (67)..(67): n is a, c, g, or t
  misc_feature (160)..(160): n is a, c, g, or t
  misc_feature (162)..(162): n is a, c, g, or t
agcgtgacgctagtagctgcgtgggaatgttatctntcatcggctggaaagngatatctgtacttcntttgactttaagagcagtcatcatttttaccatctgatagagcttcagaatttttagagtaatccaaaatacagtgagtaaacgttctaggtntnctagtatagtgatagtttgaaatactctaggtgtgtgtctgtgtgtgtgctgaataaatgttataggttttctagtatagtgacaaattgaaatacggtgggtagttgggtgtgtgtgcgtgcttgtgtgggtgtttgccactaatttccgtaatgtcaagtcttgaactactgccattaacactagggaaaattctatatgactgtatgtttcctttttaaaatatgtaatagtatgaaacgcttaatctaaattccttgtggaatagataagacaccaaagcatagagaaatttaagttatttacttaaaagacccatagctgtttagtctcacatatgagtatagaactttggcctccta

SEQ ID NO: 220571 - DNA, 449 bp, Homo sapiens
accagaggtcactttcatagccattttggtttcgttgggttttagctggcttctttactgcaacccgttttatcagcaaagtctttatgacctcctatctcatcctgtgactaagaatgccttgaccttctgggaatacagcccagtaggtctcaaccttattttacttagcccctattcaaaatagagtttctctggttcaaatgcctctgacagaatcaggttctggtatgattaggggagggtactattggcctggagtataagagcccagtagaggaggtgtgagtgtgtatgtgtaggtgctctgtattagttagtttgaatataaaaggtgtgctccttaggtgagttctttgttaggactaggaattagctgaccctggacagagtagtccctccccagttagcaaggcctcagatgccagagcatcaaacatacaagaaat

SEQ ID NO: 220572 - DNA, 113 bp, Homo sapiens
agctggagttacagatgtgagccactgtactcggccactgtcttctatttctagtatttcctttttgtttttgtttattattaaagaataggcagtttctagtttattatagt

SEQ ID NO: 220573 - DNA, 377 bp, Homo sapiens
ccaaagcgggcagatcacctgaggtcaggagtttgagaccagcctggccaacatggtgaaaccccatctctactaaaaatacagaaattagccaggtgtggtggtgcgcacctataatcccagctactcgggaggctgaggcaggagaattgcttgaacctgggaggcgggggttgtggtgggctgagatcatgccactgcactgcagcctgggtgatagagtgcgactctgtctcaaaaaaaacaaacacaaaaacaaaataccaccaaaaaattaccaacacaaagaagtccaggaccagacagattcacagcagaattctaccagacagtcaaagaagaattggtgccaatcctgttgacactatttgacaaga

SEQ ID NO: 220574 - DNA, 645 bp, Homo sapiens
ccacttcacccagtaatatatacaaccgagtggttcttaaatatgaaaacagaaattgaatacagatgtaccattttttatcttttataccatattgtattttttctatgtttaagtatgtttagatacacaattaccatcatgttagagttgcctacagtattcagtaacatatctgctgtacaggtttgtagcctaggcaacatagtgagacctcatctctacaaaaaataaaaaaacaaaacaaaattagttgggtgtggtggcttgcacctgtagtaccagctatttgggaggctgaggcagaatcactggagcctgggaggcagaggttgtagtgagccaaaatcgtgccagtgcgcaccagcctgggtgacagagtgagaccctgactccggcaaaaaaaattttttaaaaaaagatgatatttgaggcagactggaaggaatttgccatgtggatttttatgtaaacagcatttcaagaagagagaaaggccagtacacatgccctcaggcaggagtgtgcttagtctgtttgaggaacaacaaggaggccagtgtgcttggaggagaatgagcgtaggacaaggaagagtggaagatgaggtcagaggggtaacaggccagatcttagagggcctca

SEQ ID NO: 220575 - DNA, 497 bp, Homo sapiens
gatatggttgggagaaggaaaaaaaatatacatacaaattgggaattaaggtcctggaaagcagaagatggaagatgtatctatctatgagatttatagaacttatgaactttctggcctttgattcttcatgcataaattaatgagtttaagatgatggctgaggtcatacttcatgactgtaacttaagttttattttctgttttttaaggtgtctactacaatagacccaaaagaaacgttaaaaagtcttttgttcaagaattagcttcactgtatatatttagtttacccatgaaaactcaaatttgggaaagagaatctgggaatgattcattctatacactggctctaatttatagacatcaaatttgcaaagttcaagtagctgtcgaaaaacatagtaaaatacctcaaaattgagtgacacatctaccatggctcccttttacaaacacaaaactaaataaggagggaagcttgtttgctgcataga

SEQ ID NO: 220576 - DNA, 267 bp, Homo sapiens
tatacaaccagatctcatgagatctcactaacaggagatcagcttcaagaagattaactaatggtgaaggatccacccacaccacatccactgttttcaggcagaagcctcttgcagaggcagaacctcttggagaacctctagtaggggagtgcctttttgggatgcttttgcctggacacccaggcatttgcatacatcttccaaaatctatagagaggatcccaagcctctagtctcatgctccatccaccagtgacttaacac

SEQ ID NO: 220577 - DNA, 288 bp, Homo sapiens
atgataccctgttgagctggtaggtaggaagaaccagcgaagcgcacagttaccggagaggttatttgcccaatgttgagaaacatatgtgtgtattagaaaaaatcacatcgactcccaggaatcctgcaacatactgcaactgtgatgctgaccagaatgagtggagatttcctcatgatttctctgtgtgagatgcaggttaaaaaaattattacttaatatatgaataggcagatattgaataagctattgcaatgaaaaaataaaagtatgccctagtgagta

SEQ ID NO: 220578 - DNA, 353 bp, Homo sapiens
ccttgagccttgaagaactttataaccagaacacccatcacatttcagaagtatctatttcccttgtggactgtgatagcgattttaaagttttaattatctttgtatctccaaagctaaggcaaaagtcaagtgcctagtaagcactcattcaaatgccactgaactgaatttctttaggaaaaagttattaatggtccctgttcaaatctatcctgaaagtgtaaaaagtcaatatatataatccagcaactaaaattctgaaatgtttaatactgcttttacatattaaggggggaaaccccagaactccccaatctcacagtataaaaataacacaataaaacagtaaa

SEQ ID NO: 220579 - DNA, 186 bp, Homo sapiens
ccaaattcccctttctcataaggacgtcagtcatgttggattagggccctccctcctgaccttgttttagcttaatctctgcaacttaacccttaacctcagtaaagatcctatttccaaatgtgttcacattctgaggtcctgaggattaggactttgaaaggattaaaacaggctcttctggca

SEQ ID NO: 220580 - DNA, 327 bp, Homo sapiens
ccaaatcaacttaaagagcaaaatggttctgtaattaagacaatgggagtgagagcactatggtttcaaccacagatggtgtaggataaggttttcaggtatgactgaaatggatgatgagtgaggacctggagcatggctgtcaaataagcactgtgatctgctacctctccccactccacgtccatgaaatttctaattgattatgtcactgtttcctgccaaatccagggcttcctcacagtccttctcaacacagcattccacacagccactaccaatctatcagagttagcacaaaactggctatcggtactttaatcagga

SEQ ID NO: 220581 - DNA, 464 bp, Homo sapiens
tatgcacatagtttgttttctcttgtgttgaatgttggcttaaaagtgtcctggactctggtgtcagctctggactggcagcttgcattgcccgcccacctgaatccccaggctgctggtcatggaaaagcttctgggtctctcatgtcagactctcggctgaccacaaatgatctgcacattgtcccctacctggaagacatgtctgagagagaagatcaaaaccccacctctacttctgaaagaaaccagccagcgttcacctggcaggaagtgggatcagggatctgcatgggcttccccctgcagcagacggaggctgcccttgcctgcccgttgcccactaagctattttggccctggaagggggcccattcctcctccatcagatactctcttggcagagctgacagtcaaggtggttcgagtttctacagtcaaggggcaggcatctgatccaaggt

SEQ ID NO: 220582 - DNA, 549 bp, Homo sapiens
actgataatattttatttaattctcatgatagtataataaggaagattctatagcctctaattacagaggaagaaactaaggctcagtcattgagtgttttgctcaagatcacacaactagtaagtggtcaagctggaatttgaatccaagttggtctgattataaccaatgctgatttttttttcctgttaccctaccacctctattttcacatcccaaacttaatcctttaggaaatccttgcagcatacccactatttgactacttctcatgacctccactactaccactctatctgagccaccatcatagcttgtcctggacattttgcagtatcttactatctggccttcctacacccatcgtggtttaacagcccctatagcctactcatagcagccagaatgatctctttaaaataaaatccagctgggcacagtgactcacacatgtaatcccaacactttgggaggctgagatgtatggattgcttgggctcattgagttcaagaccagtctgggcaacatggtgaaaccctgtctctac

SEQ ID NO: 220583 - DNA, 508 bp, Homo sapiens
gcacgagaaaacacagtgattaatatcctcagagagactatgagaagaaattagagtacaggacatgaacagaatgatactttctatgaaaggaacattcaggaaaccaaaaagctctttgagtaatcaaaactacaatagcagaaataaaaaaacaatgtttagaagataaagctgtgtaaccctcccagaaagaaaccccctcccccaaaaaaagatgaaacaataggaaatagagacaagatacgaaaattggagaaacagatcaaaaaaattttaatataactggaaaatgaaatatggtacaggccacataggtaattttaaaatttagccacaatggaaaaatttaaaaataggtaaaattaattttgttgtatatctgttttgtatttgcactgagaaaacatctcaaatttgattagccacatttcagatgctcaaaaggccacatgcggctagtagctataccattactgggctatgtagatctcaataacagttctta

SEQ ID NO: 220584 - DNA, 613 bp, Homo sapiens
tggtcaggctaatgtacactgtaagcttgaaatgcaaatttctaatttcagagtctaaatatttgtttctcagatttcattttgatgatggaatgtatactagatgcagagtttgcatcaatttttgtaatatattcatttatttacttaactaattttaatttgccataatagcaggagctttttgtttatgtttattgttgtatccccagtgcctagaatagtgcttagaacatagtagcacagagaaacatttgttaaatgaatgaatgaatgatagaataatggatgaaacatggaatatgaattttagtggaggtgacaggtaataagtataaaaatcaataaataatgtaatttcagatggccttaaagacagcaaaccagatttaggtgatagagaataactggagagaatgttgggatggtttttaaaatcttcataataaccctatgaagtaggtattttttatctcccttttttagaagaggaatttcagacttgcctagggtcacaaagtagtggaaccacgctaatctgatttcattaatttattccttattaaacattccttgagtgccgttcatcctgagccagaatcaaaaaaaaaaa

SEQ ID NO: 220585 - DNA, 361 bp, Homo sapiens
gatggggtaaagggaagtctgtttaatatttacttaaaagttaatatggacaactgagcagacactgcttgcatccctggaagggactgtgttgggacttatctagaccaggtctttatgcagaataaacagatgtaaagtggggcctttgattccacagggctccccaagggtgcttcatggcaaggtagatagagatttaaatttagtttgctgagttggctctactgctcatctctaccaaaacaatagggaccctgttgcatttatgtttgtgtatctttaagccctagaggcctctagcacaagactaggtattgaaatattagttgagataaagggaataaaagcagccaacaca

SEQ ID NO: 220586 - DNA, 448 bp, Homo sapiens
gagaaagtcaaggtgatgtggtggaatggagctgggaggcaggctggcctctgggatgttgggtcaggaccgtggggcagacttctgggcacacccatggaggagcagacactgctgcagccaaccaagggtctaattagatcctcacttccagagtgacctgtcccctcttgtatctgaagctccagggttggggagggtggggtcagggagtgtaagtggagggagtagctgcagataattagaaacatgctctacctggacaattccagccaaactgggggaggcgctggtggagcctgggagcagcaactcggtgggattggcttcctaggcccttacacagtctctaaagtgcaaacaacatatttttgccatgctatagtatttaattacacataaaaacagagccattaagctgaaattaaacccttgttggagtcactta

SEQ ID NO: 220587 - DNA, 289 bp, Homo sapiens
gagaaagtcaaggtgatgtggtggaatggagctgggaggcaggctggcctctgggatgttgggtcaggaccgtggggcagacttctgggcacacccatggaggagcagacactgctgcagccaaccaagggtctaattagatcctcacttccagagtgacctgtcccctcttgtatctgaagctccagggttggggagggtggggtcagggagtgtaagtggagggagtagctgcagataattagaaacatgctctaccgagtgagcaggcgccaccaggaccacccca

SEQ ID NO: 220588 - DNA, 517 bp, Homo sapiens
caggcaaaatgaagggaagccctgggttcttgtcctgcatccgcagccagctcccactttcctcaccctccaggacctgtaaactgtgaggctggaccagttatgtcaaatctgtcctcccccagagctcagtccctctgcccttgggtgtccttggcacaaggcaggctaggctgcaccagcttcctccatctccgtcctgcctcccccatccccaggtgccattcccacaccatctgaatcactgatttcctcgcaatcagacgctatcttccagttaatcacttcgcttgtatttaacataagaaagaaaaaccctttcattatcacatacagctggaaatcggcttcttgcaggaggcgtatccaaaggaattggagaagagataaactggtaattggtgaaagaattactttaattttttttcctacttgctgtcatgatgatgtccttagaattgtgagcccgtggacacttctgtacaataaatctgctattattacttctagaactaca

SEQ ID NO: 220589 - DNA, 469 bp, Homo sapiens
aaagcaaccaatatctcccaccttggcgttggaacctgagctgaaactctttgcaattcctgctccaagcagatggagataaaaatgcgcagctctgagcgttgagtgatttgcccaatgtcacacgggaactcaggcagagaaccctcctgactcagccagccccctttcccgtgggatcctgcctgatgtgagccttgaaagaaggtctgtccctcagtggagatttccactccaggcagcggctgcacacacacatggaaaagaaatagactcgaggtcagagcaaagccaacagtgcgactgctgacccagctctcaggagtggcgcacagcatggagagcagacaggcgggagggctcacagcctagcagccacgctgtttgtccaccacagagatctcactgggcttcacggtgtcctaccttaaatattaggttggtgcaaaagtaattgcagtttttgtcc

SEQ ID NO: 220590 - DNA, 298 bp, Homo sapiens
gaactcctaacctcaagtgatccgcccgtctcagcttcccaaagtgctgggattacaggcatgagccaccgtgcccggcccttgtctgttgttttatactttgtaacaactgtgagcaatctcttagctgataagaggagtggaaaaataccttgcctatcagttccatttccatcaccagttaatcagctgtgtgatcttggagccctagagagcacagtaaacatagaccatgaaaggtaaaagaatcacccactccagcttcttcattttatggttgaggtaaggagatccaggg

SEQ ID NO: 220591 - DNA, 452 bp, Homo sapiens
aaggagttattatttattgtcacaaaagcaactaaacaagtttcatgtgagagcattatttgtcttaaaataaggtgctaggaatcactccactctgaaggattcccttgtcttcatggcccagtttctctgacaccgtgtttattcttatgatgaccatggtgacatgaaaatccatggctcatatctcctgctcagggaacataatcaaccaggtgtcccagctgctgttcttctgggtccgccactgtgttcatgttaaggccacatttcccacaggctactcaagcagcaactgagcataacaggacaactaatgcaggtccatttctggaacacatggaactccacaaccaggggtcagaccttcatgacaggctgaagagttccttctcctcttctcccttttactttacaaacatttctccaataaatttcttacacatctaatt

SEQ ID NO: 220592 - DNA, 505 bp, Homo sapiens
agcagcaactaattactgaataccaaaagaaaaaaaaagaaaatgtgtgtgtttcataaattaaaatataaatgtacaattataaacacactttttttggtttatttttcagagctgtaaatgatcaagttttgttagatgctgtaagtatagtactctcaatttgaaattacactttgtccttgagttcttaacagattctagaaattgtcaggatacataatcctatataaagatccaatccttacttagtttatttaagagatttgtatgcatatgtgaactttctggaaagccttgtctattttgttcattttactctcattatcactcagaaactcttcacttctgaaatactaaactataatatcctacagtcatctgaatagttccagtccttgacacgtgtagatcttttatgcctttcagctccaattattgtgtcactctacagactgatatcaatgtttcattcttttcatgagttaatgaagactttcttacc

SEQ ID NO: 220593 - DNA, 652 bp, Homo sapiens
gactaaatgtggccggaagaggaagaattctacccaagaaagctgccgctgatctgctcaacgtctcggagcagtctttttttaagcagaagtcagtaacaagcaaacacaatgtcaatggatttattaatctgttaaactcttcattctgttacctgctgggtctcaatctttttgacctcaggacccctttacactgttttaaaaaagtatttgagaatcttaaagaacttttttttggttatatctattgatattttactatgttaaaaattgaaactgagaaattttaaaagttcactcaaaaataacaaacaataataaacctgttacatactaataaaaaggccatttataatgaagaataaccttactaaaacaaaaaaaaagtatgagatgaatgtttcacattgttttatttatctctttagtgattttttaaagtgaaaaccaaaaaaaaatttagtgagaagagcgacattgttttccatttttgtgaatctgtttcataaccagctttgatagaaaatagctgtgttctcatgtctgcttctgtaatcagtctgtcggggtaggttgttttgggggtcatgtatgcagaaaatctagtttcacacagttacatcattgggaaaggccagagaattgaaat

SEQ ID NO: 220594 - DNA, 592 bp, Homo sapiens
agaagcaggcccatccctttgagccgtaaattgcatttcaaagcctgtttcactagtggattttaattagcttaaaaggcccagcttttatgcagcaattgtttctcctgcaggtaaaggtgaaggcacttattggggagccagtccccagttttctcaaacgtagcttttttcttttttcttttttttttttttttgagacactgtgctctctcccagctcctcagtgtcctgggggcctgtctcttaccagccccaaatgaaaaatggaatataaggaccctagacttagcgtcagaagacccatggggtaatcttgtctctgctactcactagctgtagcatcctggccaagtttttactgtgggtaaaacttctcttctgttcttccgagtaagagcatttataagctccatgtgcacacaggtctctgctcatctgacattgcagaagtctctaggaataaatttgcttctctcctttcccccagccaccaagaacaatccttctacccacctctcctcagctcattgctaaacctaggacccctgggggctgcagacaccttgctctcaattacacagctaatctg

SEQ ID NO: 220595 - DNA, 280 bp, Homo sapiens
catgaaaagatcaccaagaaactagagcagtaaaagcaggtgcagaacagctgatgggcgatcccactgtgtgaactgaaaagcaaacaggctgagcctgcagggtggggaggaccgagtgttcatgcacatctctggatctaagtgtctgcaggagcaggctcagggaactgtggccaattttactttgttcaataggcttttctatatttataaaagaataaccttaatgcttttgaaaaagtaacacatgacataaaagctgaggaaataccagttc

SEQ ID NO: 220596 - DNA, 598 bp, Homo sapiens
ccaaaagtgagaaaaggagagcaacttggggacagtgaaatgatgatatataaaagagattatacaaagaaatgtgtaaacaaataggagaggctggtttaggggaattaagttgagcacaaatcagagtggagcaaaggagcatttacttgattcaaaattacagttaacacctattttgtgcaggttgctgagaaatggggcgtcccacatgatctaatatgcctatatcccttctgtccttcacttacttgttcattcagcactttgaacggtaactgttctggggacagtagtctaaatgcaaagctgatctctcccaatgccaagtcttaaattgacagtgatgaatgaaaaatctttatttgcatgcttgtggttttcttaaacagactacacgagtaaaatttagctgtttattggtcatattttttacccatttgaacataaattttgttactgggctaaaatggagaaatgctctccaggatattgagaaatgtatatactctgccattagccaaaaaagcaccacattctctttttaatgtacatgtgtgagctctctatctcttctacagaatgtgatgcatgggct

SEQ ID NO: 220597 - DNA, 446 bp, Homo sapiens
ctttattttctttctcttgctagttcaatgtaaaatttggcacaatacagaaatatagatatagaaagtaaggggcaagttttgggactatgatacaaatacatctgtcatgtagcagaaaccacctatccccacttagacaatttattttaatcaaaaagatgtcaggtttcagcatccatggagtgtgatgtatttttctcgttagatctactaataaaatgaattatatagatttttatatccaattataaacaattcttttaatgtgttactaggttcagttcactaattttttatttaggatttctttatcaatattaacaacaaaatttggtctctagtcttgcttttgttttttattgaaatttttgtcaggcattgatgttaatgtcttattgttacattaaaagagagctggatgggtttcttaattttctatgctt

SEQ ID NO: 220598 - DNA, 535 bp, Homo sapiens
agtcaacatgattagtcccttgatgcttgaatcctgatattattgggatgtttggatgttttaaaggcccagtcaatatgatgagtcccctgatgcttgaatcctggtattattgggatgtttggatgttttaaaggcccagtcaatatgatgagtcccctgatgcttgaatcctggtatcatttggatatcatgttgaaatataatccccagtgctggaggtagggcctggtgggtggcatttggattacagaggtagattccttggtgccatcctcatggtaatgaaccagttctcactttgttagttcacaccagatctggttgtttaaaatgagcctgacacttccttcctgtcttgcttccactgtctcactttttctctcaccatgtaacaagctgccttgtttctgtccaccttctgccatgactgtcaacttcctgaggccctcaccagaagcagatacaggcaatatgcttactgtacagcctgcagaactgtaagccaaataaacctcttttctttataatttac

SEQ ID NO: 220599 - DNA, 708 bp, Homo sapiens
gggaagtggaggaaccactgtccgcctgcggaggggcctcagtgttggccgtgctcatggcgccctcctcctggggctccctctcctctggtcctgcctctcctgcacgcccttcctgcctccttggtgccaggggagccagcccaggacagtctctgtgcctaggccctgccagcctggctgccctgcctccagccatggggggcaggcggggagggagtcgaccagtgcttgtctttgcagaactgctggtggactgaatgtggttctgggggtggccaggcctgagggtaactcattttggaaggtttgggatgtcacttcacttaaggagccttcagcaacatggagtttaagtggccctcttcactgtggccttgtggcttcatgaatggagctgctgtggtcagcatggctggccctctggagaggagggtgggccatgaggagaagatgctgtgtctggaggccttaaccctttcctcccttctctccctccctccctcctgtctctttctctctctgtctctttctctctaggtgcataaaaaaaattgctttcagataaagttgacatgcaataaactgcatattctccctttgcttttaaaatgatgatctgtttcagccatgcaaagcagggtataaaataatatttcagtgtaaccactcagcggaagaaataaaccattccagttgcaatacctg

SEQ ID NO: 220600 - DNA, 779 bp, Homo sapiens
gggaagtggaggaaccactgtccgcctgcggaggggcctcagtgttggccgtgctcatggcgccctcctcctggggctccctctcctctggtcctgcctctcctgcacgcccttcctgcctccttggtgccaggggagccagcccaggacagtctctgtgcctaggccctgccagcctggctgccctgcctccagccatggggggcaggcggggagggagtcgaccagtgcttgtctttgcagaactgctggtggactgaatgtggttctgggggtggccaggcctgagggtaactcattttggaaggtttgggatgtcacttcacttaaggagccttcagcaacatggagtttaagtggccctcttcactgtggccttgtggcttcatgaatggagctgctgtggtcagcatggctggccctctggagaggagggtgggccatgaggagaagatgctgtgtctggaggccttaaccctttcctcccttctctccctccctccctcctgtctctttctctctctgtctctttctctctaggtgcataaaaaaaattgctttcagataaagttgacatgcaataaactgcatattctccctttgcttttaaaatgatgatctgtttcagccatgcaaagcagggtataaaataatatttcagtgtaaccactcagcggaagaaataaaccattccagttgcaatacctgatgtaccgttctctgatttcaaacccttccttttctctgccccgactttgatgtttattcttgtgcatatt

SEQ ID NO: 220601 - DNA, 432 bp, Homo sapiens
caattcagttcaattctgatactcgtctacttggagttgacagcagaccccacaagtaaagggctcagttgcacaacactgcttccacttacttcagatgccaattgcaagtctgggcatctagtacttttgaccaaccagctataaatcaggggttccatgactcccttcttgggtttaataatttgctggaatgcctcacagaattaaaggaaacactttacttatgtttaccagtttatcataaaggatacaactcaggaatggccagatggaagagctgcataaggcaaggtatggcgggggtgggaggcaagggggtgcctgcagaccttctaggcttcctctgggcgtgccactctcccagcactaggttcgggaacctagaagctcatcagatcccaagagagtttatagagtttgattttcaga

SEQ ID NO: 220602 - DNA, 435 bp, Homo sapiens
aatcaaaataaagatgcattatcaaaaagtaaatgaaatccatgtcagaaaattaaattatttataattataccctgtgtgaaaagcagcatgtacattaaaggggaaaaaaaggaaaagtctgttactatacttcttgtaattctgatggggctctgggttactctgatgggactgtcaatcattggctctgcctctctgaccacagactaaatatatgaccagtctaacctgttaagcataacaatatggacactgggagagaagcctcttgaaatcctttgctgaacggatcatgtacaagctgccaagagttcatctctgtggaaagggtgtccctaaaagcaaagctaacacaaatgaaagcaaaagcaagaaacggagatagagagagaccaattactgcttgagcaactggaatcagtcatgtctgag

SEQ ID NO: 220603 - DNA, 327 bp, Homo sapiens
atgtccagccctctctttctatcttaggcatctctgagctcatattttctatctccttgtttctccggatatattctggatcatttcttcagttttatcttacaatcgactttttctttttttttttttttgctatttaacctacccacctctactaaaaatacagaaaattagccgggcgtggtggcggacgcctgtagtcccagctactcaggaggctgagacaggaaaatggcatgaacccgggaagtggaggttgcagtgagccgagattgcgccactgcactccagcctaggcaacaaagcaagactccgtttcaaaaaaaa

SEQ ID NO: 220604 - DNA, 402 bp, Homo sapiens
agagaaaaaaaaatgatgatggagattattatcagtatcatcaggctgagacttgcagccttgtgcccttttaggtttgagcccttgtacagggaaaaactgtgccagattctttatagatcctttttgtaccatcaagtagacattatccttaaactctgcagccttccctggcatcatcacaacaaccacaccgccaccaggaaagcctgtcctattctagtcaagcacctagggataggcatgcaaattgataacaaaaacaaaagattacaaaactgggaggaactgggcatggtggcacactcctgtaatccctgcttctcaggaggctgaggtgggagggtcacttgagcccaggagctggagaccagcctgagcaacatagtgagaccctggctc

SEQ ID NO: 220605 - DNA, 696 bp, Homo sapiens
gctattttaaaataaccttttggcaggtaggcaagactgactggcaagggtgcactcaagacattgtgtcttgtggagtggtccccaaagaattcctgacagaggcacctgacagcacaaattagctcttcagtgtataagcacaaagcaccaaaaaggctgagatttcttcctagctacatgctctctcccgctattgtttattacactccacccgctccatggtgaagctgacaaaggagatactattaatttcctttcccactgaataatcccctctgtaatttctacaacaaaaggtaaataggacaatcatcttcgaaaatgaattaggccagattggtagtacccaaaaggagaattaatgaccattgtcataaactctgaaaagctgttggcgctactgataatctagataattaagcaaaaatttgaaaattatttctaagattgtctaatgaagttcactaagtgtttttgttaggttatcactattgggcaccatggggaaagcaaaataattgtatagctaggtcattgccccaaaggaaaacaggaaagatgtcacatgaagtgtttaagaatcaaaatgtaattagctgagtgtggtggtgcctgcctgtagtccccgctgaggtgggaggatctcatgagcccaggactttgaggctgcagtgagccatgattgcaccactg

SEQ ID NO: 220606 - DNA, 449 bp, Homo sapiens
gcatgggaattttagcttattatgtttgcttaactggtgtttttttcacttatgactgtcagtttatgtcttaatgtattctcacagaagaatgcataccatttttgttccaacaagaacaatctgttagttgataagcactggtaataaatatcactgaacccacccaccccctgatatttcttcctcaagttttctatcatgcaaatcacaaaatgaaaattggtgcttttacaaatatttgaaagctctcaatgcaaaataataaaaatgagattctccctggctttctataatatattaggatatgtgactgaaggaaatttaatctgaatttagagtgttttaggttttggttggtttgaataatttgatttgcattttggtattaaaatgtgctctgatttctgcgggcatttgttctgaccagtcattacctcttcccaaca

SEQ ID NO: 220607 - DNA, 592 bp, Homo sapiens
taacttcagaattttagtgtatgtacaaaagtccacgctggaaaaaagatggaagttgtgtgcctttgaaggaattaaaactacctaactgcgaagagcaaagcatctctggaaatgaaaccatgtgaacctggccagggcggtgcgacggggaagcaggaggtgtggggttggtcccgcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagtaaaaaaaaaaaaaaaaaaaagagaaagaagaaaaagaaaaaaagaaaaaagaaaaagttttacagtgagggaaaagcatacc

SEQ ID NO: 220608 - DNA, 840 bp, Homo sapiens
  misc_feature (236)..(237): n is a, c, g, or t
  misc_feature (239)..(240): n is a, c, g, or t
  misc_feature (502)..(502): n is a, c, g, or t
  misc_feature (507)..(507): n is a, c, g, or t
  misc_feature (531)..(531): n is a, c, g, or t
  misc_feature (565)..(565): n is a, c, g, or t
  misc_feature (573)..(573): n is a, c, g, or t
  misc_feature (583)..(583): n is a, c, g, or t
  misc_feature (587)..(588): n is a, c, g, or t
  misc_feature (591)..(591): n is a, c, g, or t
  misc_feature (597)..(597): n is a, c, g, or t
  misc_feature (604)..(604): n is a, c, g, or t
  misc_feature (606)..(606): n is a, c, g, or t
  misc_feature (618)..(618): n is a, c, g, or t
  misc_feature (627)..(627): n is a, c, g, or t
  misc_feature (630)..(630): n is a, c, g, or t
  misc_feature (639)..(639): n is a, c, g, or t
  misc_feature (642)..(642): n is a, c, g, or t
  misc_feature (670)..(670): n is a, c, g, or t
  misc_feature (673)..(673): n is a, c, g, or t
  misc_feature (678)..(678): n is a, c, g, or t
  misc_feature (681)..(681): n is a, c, g, or t
  misc_feature (686)..(686): n is a, c, g, or t
  misc_feature (698)..(698): n is a, c, g, or t
  misc_feature (700)..(700): n is a, c, g, or t
  misc_feature (707)..(707): n is a, c, g, or t
  misc_feature (711)..(711): n is a, c, g, or t
  misc_feature (720)..(720): n is a, c, g, or t
  misc_feature (725)..(725): n is a, c, g, or t
  misc_feature (727)..(727): n is a, c, g, or t
  misc_feature (730)..(730): n is a, c, g, or t
  misc_feature (732)..(733): n is a, c, g, or t
  misc_feature (735)..(735): n is a, c, g, or t
  misc_feature (740)..(740): n is a, c, g, or t
  misc_feature (744)..(744): n is a, c, g, or t
  misc_feature (764)..(765): n is a, c, g, or t
  misc_feature (767)..(767): n is a, c, g, or t
  misc_feature (772)..(772): n is a, c, g, or t
  misc_feature (776)..(776): n is a, c, g, or t
  misc_feature (780)..(780): n is a, c, g, or t
  misc_feature (782)..(783): n is a, c, g, or t
gctagctgaacgactctcttaatctaccaccgctacactaactaatattagcaacaataatgactaatggcctgaagactgaagacatgaggaaatgttagaaataattgaaaacaacttgaagaaggaggataaagtgaaggtcctttgctgccagcatgatgtcgtatttataatatgtggaggagagagagctcaccatgctcaggtagattttcaaaggattctgtgaggcnntnntaacttgagaacctcttggattcatctctccactctggtttctacccccagaatctatcaagtggcctcactcctggattacctccagcacaagagaaagtaaggataaaatgaaagcaacataaatgggcagcataaaatagaaaaagcagctattgcatctccctcatttcagattatttgtcagatatgcccttccccacacatgtgtgtttgcttgttccattacatcacagttctgtccatctgcccgtcccactanaccangaatccttggcaatcaagaccatnactctcatagtacccaacacaataactgccctgnaatcattnccaataagtntttnntgnatttanttgagcnanttatagaagacnacattttgngcntagttcctntantatatacaactgaggccagaactgaacnatnccctnggnttggnttactgcaactnanactccangcanagtgcaatngaatngnacncnngnccctntctnacttcgccttttgtttcaanntnaaatntaanaaananncaaattaattccagcggccgtttctttaggagggttatcataaccttctactgcccc

SEQ ID NO: 220609 - DNA, 437 bp, Homo sapiens
gggaagattctacaaactctgacatgaggaaatgttagaaataattgaaaacaacttgaagaaggaggataaagtgaaggtcctttgctgccagcatgatgtcgtatttataatatgtggaggagagagagctcaccatgctcaggtagtttgagaagttgcagtatatctgtacacacaccctctattctacattgaggctcacaaggtaatccttttacttcatgtgtatatgtttctttgtagtaaagggcaggagcttcagcttttgaagtaaaaccaacaaaaacccttctggggactgtgtattaatggcaataagctttaattgaggggagagtgttttaattgtatttctatcttaaatgatagggattcctagttactgctgtcttattcttggaatactcttttcacaccagtgttgaaagtagggt

SEQ ID NO: 220610 - DNA, 2866 bp, Homo sapiens
gctagctgaacgactctcttaatctaccaccgctacactaactaatattagcaacaataatgactaatggcctgaagactgaagacatgaggaaatgttagaaataattgaaaacaacttgaagaaggaggataaagtgaaggtcctttgctgccagcatgatgtcgtatttataatatgtggaggagagagagctcaccatgctcaggtagaagcctctggtatgtcagaaccatgctgtcttccatgagacttcctttgtgaagagcatccatttaaaagacttttatgaatacatggtttcaatcaagtccccagagaacacatttgtcttctgagctgctggcagttttgagaatctgatgacctccgaggggaccctgcactcagccatcaaagtgttcctgcccctctggacactcataattcaatggtagatgcaggtggagttgagaacatcacccagcttccccaggagcttcctcagatgatggctgcagcagccgatggtttggggagtatagcgatagacacgacccagctcaacatgtccgtgacagatcccacagcctgggctacagccatgaataacctgggcatggttcccgtagggttgcctggacagcagctcgtgtctgactcaatctgtgtcccaggctttgatccaagcctcaacatgatgactggaatcacccccattaacccaatgataccaggccttggactggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaattaaaaggtaccaaggaattggtcgagaccaatggccacagccatgaggattcaaatgaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagttgtgtgcctttgaaggaattaaaactacctaactgcgaagagcaaagcatctctggaaatgaaaccatgtgaacctggccagggcggtgcgacggggaagcaggaggtgtggggttggtcccgcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagtaaaaaaaaaaaaaaaaaaaagagaaagaagaaaaagaaaaaaagaaaaaagaaaaagttttacagtgagggaaaagcatacc

SEQ ID NO: 220611 - DNA, 2739 bp, Homo sapiens
aggaagtagactggttaaggacatgagacccagaggaataacctggtgatggacagaagatggaaaaatttcttacatgaatgaaaagcctctggtatgtcagaaccatgctgtcttccatgagacttcctttgtgaagagcatccatttaaaagacttttatgaatacatggtttcaatcaagtccccagagaacacatttgtcttctgagctgctggcagttttgagaatctgatgacctccgaggggaccctgcactcagccatcaaagtgttcctgcccctctggacactcataattcaatggtagatgcaggtggagttgagaacatcacccagcttccccaggagcttcctcagatgatggctgcagcagccgatggtttggggagtatagcgatagacacgacccagctcaacatgtccgtgacagatcccacagcctgggctacagccatgaataacctgggcatggttcccgtagggttgcctggacagcagctcgtgtctgactcaatctgtgtcccaggctttgatccaagcctcaacatgatgactggaatcacccccattaacccaatgataccaggccttggactggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaattaaaaggtaccaaggaattggtcgagaccaatggccacagccatgaggattcaaatgaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagttgtgtgcctttgaaggaattaaaactacctaactgcgaagagcaaagcatctctggaaatgaaaccatgtgaacctggccagggcggtgcgacggggaagcaggaggtgtggggttggtcccgcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagtaaaaaaaaaaaaaaaaaaaagagaaagaagaaaaagaaaaaaagaaaaaagaaaaagttttacagtgagggaaaagcatacc

SEQ ID NO: 220612 - DNA, 3019 bp, Homo sapiens
ctcagcagatccccgctctcccgggcgccgctactcacacaggcttccagccgccacggggcgtcctctgtctgctgcagcggcggcggcagcagagggaacggcgactgcagcccggccgcgtctcccagctccgtgcccgggacagagtccgggagaagcaaaggaggaggaggacgccgaggctaggaggagccgcgccgcgcccggcgccccactccgcgcagcgggttgcctccgctccccatacggcggccccaggtcctttgctgccagcatgatgtcgtatttataatatgtggaggagagagagctcaccatgctcaggtagaagggatggtatgtgcaccacaaataacaagcagaagcctctggtatgtcagaaccatgctgtcttccatgagacttcctttgtgaagagcatccatttaaaagacttttatgaatacatggtttcaatcaagtccccagagaacacatttgtcttctgagctgctggcagttttgagaatctgatgacctccgaggggaccctgcactcagccatcaaagtgttcctgcccctctggacactcataattcaatggtagatgcaggtggagttgagaacatcacccagcttccccaggagcttcctcagatgatggctgcagcagccgatggtttggggagtatagcgatagacacgacccagctcaacatgtccgtgacagatcccacagcctgggctacagccatgaataacctgggcatggttcccgtagggttgcctggacagcagctcgtgtctgactcaatctgtgtcccaggctttgatccaagcctcaacatgatgactggaatcacccccattaacccaatgataccaggccttggactggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaattaaaaggtaccaaggaattggtcgagaccaatggccacagccatgaggattcaaatgaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagttgtgtgcctttgaaggaattaaaactacctaactgcgaagagcaaagcatctctggaaatgaaaccatgtgaacctggccagggcggtgcgacggggaagcaggaggtgtggggttggtcccgcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagtaaaaaaaaaaaaaaaaaaaagagaaagaagaaaaagaaaaaaagaaaaaagaaaaagttttacagtgagggaaaagcatacc

SEQ ID NO: 220613 - DNA, 1425 bp, Homo sapiens
actcctagtgtctttgctttgcttccctatagtgatcacaacataaattacttgtcttgtttgacttccttgttcaccaaagttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaagaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagttgtgtgcctttgaaggaattaaaactacctaactgcgaagagcaaagcatctctggaaatgaaaccatgtgaacctggccagggcggtgcgacggggaagcaggaggtgtggggttggtcccgcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagtaaaaaaaaaaaaaaaaaaaagagaaagaagaaaaagaaaaaaagaaaaaagaaaaagttttacagtgagggaaaagcatacc

SEQ ID NO: 220614 - DNA, 1482 bp, Homo sapiens
actcctagtgtctttgctttgcttccctatagtgatcacaacataaattacttgtcttgtttgacttccttgttcaccaaagttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaattaaaaggtaccaaggaattggtcgagaccaatggccacagccatgaggattcaaatgaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagttgtgtgcctttgaaggaattaaaactacctaactgcgaagagcaaagcatctctggaaatgaaaccatgtgaacctggccagggcggtgcgacggggaagcaggaggtgtggggttggtcccgcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagtaaaaaaaaaaaaaaaaaaaagagaaagaagaaaaagaaaaaaagaaaaaagaaaaagttttacagtgagggaaaagcatacc

SEQ ID NO: 220615 - DNA, 1008 bp, Homo sapiens
aggaagtagactggttaaggacatgagacccagaggaataacctggtgatggacagaagatggaaaaatttcttacatgaatgaaaagcctctggtatgtcagaaccatgctgtcttccatgagacttcctttgtgaagagcatccatttaaaagacttttatgaatacatggtttcaatcaagtccccagagaacacatttgtcttctgagctgctggcagttttgagaatctgatgacctccgaggggaccctgcactcagccatcaaagtgttcctgcccctctggacactcataattcaatggtagatgcaggtggagttgagaacatcacccagcttccccaggagcttcctcagatgatggctgcagcagccgatggtttggggagtatagcgatagacacgacccagctcaacatgtccgtgacagatcccacagcctgggctacagccatgaataacctgggcatggttcccgtagggttgcctggacagcagctcgtgtctgactcaatctgtgtcccaggctttgatccaagcctcaacatgatgactggaatcacccccattaacccaatgataccaggccttggactggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggtactttgcattacataaggagttttctaggcattttgttatgttttgtgatgttaatatgagcttattccctttggccttcatgcaaaataaagtcttcatagtttggggctgga

SEQ ID NO: 220616 - DNA, 1806 bp, Homo sapiens
attatgtagaaccattccaatcctgagtgacaggatttgcaaagacagctgttgggctccacaaacatttggaggaggggaaaatgtgaggttggttgctacattctcctacttctttttactgaaaggaacagctgcgatcttcacatgtaagatgaagtaaacaaaagctgacaatgcccagcaccattcagcagtaagcattcaaatggatttttcctcaccgcgtttgcaggcccggcacagtctcagttccccacagcacagagaggaagcaaggtctttgcatgccctgttcacttggccaaacattgccctagatgtgcaattcaacccatataaagcaagcgtaattcaagagccctgactctttcaccatttcatgatggcttattactcgcacacggcattgtcaggttccagcaactctgtgtgcagcaggcagaaatgcagtgtttatctctgacaggcaaacattcttaggctcatcggcatgagtatccacgctgaactggctatcggggaagtagatccctgcatgggaaagtcaagtatccccactgtgtagagctggtccacaatggagaggaggaaaagttttgcattggaccaaatcactgccttagaaggaaagagattgcaatcccattcatttttaagatctgcaatgggttgggatgatacccatttaaaaaagaaaaaaaaagaggttacctctttggcctctttggcaaaggatatgaactagtaataaagcctcagcatcaaggcttgggagtctggctcaaagtggctaagactagaagcatcttctaacataaatatggcagcattaggaaaatagcttggcctttagagagacccagattatcttcaccttaaaaactaccaagaccctggtccagcaagaccaccatcacagcagtaaatacatagccaccaacttcacagaaggttttccactgagacattgtgaaaaccacaatccattaccggtggatgagtcccagctctcttactacctggagcttccaagcaagacttacctgtcctttgttccagattggttcctgggatcctggaccaacacaaagagaagaggaaagcctcaagggaaataaaagtgaaggtttcagtgatagtttaaatatatatttttaaatgttagcttttttttaaatacttcacggtgatggatggagtatttcaaccacaatggcaaagaatgaattaccggcagtgtcagagtttcttgttgctgtgggaagacagctgccatgttgagaggtgccttgtggagaggctcatgtggcgaggaactgagactggcttctatccaacaaccagtgaggaactaaggccctaaagtcctatagtccacaaggaactaaatcctaccaacaactacatgagtgagcctggaatctgattttccccagtggggacttaaggtacctacaacctggctgttatgggctaaactgcatcctgcccaaatttatatgtttgagtcttaactcccagcacttcagaacatggttttgtttggagacatagtcattaaagaggtaatgaagttaaaatgaggtcattaggatgagtcctaatccaataggactggtgttcttatatgaagaggaaatttgaacacagacacatatacaggaaagaccatgcgaagaagacacagagaggaaacggccatctacaatccaaggagagaggcctcagaacaagccaaccctgcagataccttgatctaggcatccagaattgtatgaaaatacatttttgttatttaagcta

SEQ ID NO: 220617 - DNA, 2492 bp, Homo sapiens
attatgtagaaccattccaatcctgagtgacaggatttgcaaagacagctgttgggctccacaaacatttggaggaggggaaaatgtgaggttggttgctacattctcctacttctttttactgaaaggaacagctgcgatcttcacatgtaagatgaagtaaacaaaagctgacaatgcccagcaccattcagcagtaagcattcaaatggatttttcctcaccgcgtttgcaggcccggcacagtctcagttccccacagcacagagaggaagcaaggtctttgcatgccctgttcacttggccaaacattgccctagatgtgcaattcaacccatataaagcaagcgtaattcaagagccctgactctttcaccatttcatgatggcttattactcgcacacggcattgtcaggttccagcaactctgtgtgcagcaggcagaaatgcagtgtttatctctgacaggcaaacattcttaggctcatcggcatgagtatccacgctgaactggctatcggggaagtagatccctgcatgggaaagtcaagtatccccactgtgtagagctggtccacaatggagaggaggaaaagttttgcattggaccaaatcactgccttagaaggaaagagattgcaatcccattcatttttaagatctgcaatgggttgggatgatacccatttaaaaaagaaaaaaaaagaggttacctctttggcctctttggcaaaggatatgaactagtaataaagcctcagcatcaaggcttgggagtctggctcaaagtggctaagactagaagcatcttctaacataaatatggcagcattaggaaaatagcttggcctttagagagacccagattatcttcaccttaaaaactaccaagaccctggtccagcaagaccaccatcacagcagtaaatacatagccaccaacttcacagaaggttttccactgagacattgtgaaaaccacaatccattaccggtggatgagtcccagctctcttactacctggagcttccaagcaagacttacctgtcctttgttccagattggttcctgggatcctggaccaacacaaagagaagaggaaagcctcaagggaaataaaagtgaaggtttcagtgatagtttaaatatatatttttaaatgttagcttttttttaaatacttcacggtgatggatggagtatttcaaccacaatggcaaagaatgaattaccggcagtgtcagagtttcttgttgctgtgggaagacagctgccatgttgagaggtgccttgtggagaggctcatgtggcgaggaactgagactggcttctatccaacaaccagtgaggaactaaggccctaaagtcctatagtccacaaggaactaaatcctaccaacaactacatgagtgagcctggaatctgattttccccagtggggacttaaggtacctacaacctggctgttatgggctaaactgcatcctgcccaaatttatatgtttgagtcttaactcccagcacttcagaacatggttttgtttggagacatagtcattaaagaggtaatgaagttaaaatgaggtcattaggatgagtcctaatccaataggactggtgttcttatatgaagaggaaatttgaacacagacacatatacaggaaagaccatgcgaagaagacacagagaggaaacggccatctacaatccaaggagagaggcctcagaacaagccaaccctgcagataccttgatctaggcatccagaattgtatgaaaatacatttttgttatttaagctaaacagtctgtggtgctttgttatggcaatcccagaaaactaattaactaattgactgcagccttgcaagggaccctgaaccagaggacccagttaagccatgtgcagattcctgactcacagaactaggagataacaaatgtttgttgttctaaggtgctaaatgttgggaaaatatgttatgtggctatgttgttttgcacatgtgccacataatgatgttttggtcaacaacagaccacacatatgatggtgggcccataagattgtaatactgtgtttctattatgcattctctatttatagatacacaaatacttgccactgtgttacaattgcctactgtcttcagtactgtaacatgctgtacaggtttgtagcccagaagcaatagactataccatacagtctgggtgtgtagtaggctataccatctatgtttgtgaagtacactctatgatgttcacataattatgaagttgcctagtgatgcatttctcagaatgcatgcccgacattaagtgacacttggctttatgtctatcatgcatttaagatattgcaatatagttaacttatgttttaatacacctcttaattctgttttgatcccacaccaaccaagatgcaaaactaattttttcgcccatttccataaaaaacacaattacaatgggcctaatgtgg

SEQ ID NO: 220618 - DNA, 560 bp, Homo sapiens
ggttgccaggggctggggagggaggtatggggagtgactgttcatgggtacaaggtttccttttttgatgacgaaaatgttctaaaattagattatggtgagggttgcacaactctgtaaatatactaaaaaccaatgaattatacgctttacacaagcgaattttatggtttgtaaattatatctcaataaagctttgagagcaagaacggatcagaagtgctcataaaagccttgacccagcactccccttctaggaactgagcagaagaaaatcatcagaagtgggcaccaagactgacataaggtgttcatcccagggtcatctataccagcaaaaaagttaaaaatgggctgggcgcggtggctgtaatcccagcactttgggaggctgaggcaggcagctcacctgaggtcaggagttctagaccagcctggccaacacggtgaaaccccgtctctactaaaaatacaaaaattagccgggcgtggtggcacatgcctgtaatcctggctactcgggacctgaagcacgagaatcgcttgaacctaggaggtgg

SEQ ID NO: 220619 - DNA, 586 bp, Homo sapiens
tcaaggccctactcaaacagctgccctcctcccacccctcacagtcctcactccctcctttaaaataagaacaccctttgcatataacacgagtgcttagaatgagctgggtggctattacatgcatatgactttgcagcttagaaaaagtgttatattatctttatagatagatatcatagatcagttatatattatcttttatagtgattcttccttttcactctcacaacattatgtacctttattgagattatagaggtcccatatactgaggtcctaccacgtgccaaatgctttattcttataccaatcccatgacacaggcatcataagtgtcagagaggggaggcaacttactcagtgttacacggcaggggtctcatttgaattcaggcttgtgtaatgtcaaagcctctataaatgtgcacatgatgtgtgcatgtatgtatgcttaatccgtgcgagtatacactgtgtatatacacacagcctccccttctgcactgtgtttgttctcttctctagcagtgtctagcatatggtaaatgctcaataaatgttagatgaatgaataaatcctgca

SEQ ID NO: 220620 - DNA, 520 bp, Homo sapiens
ccctcttccctctcagagtttgctgactgctgggaaaactttgtggaccacgagaaaccgctttccttcaacccctataagatgttagaggagctagataaaaacagtcgagccataaagcgacggcttgagaggataaagcagtcctgaagtgtggatgttttagagaatgacttaagaagtttgcagcttggacccgtatcccactcattatcaagaagcaactcaagatgactttccctggggcatgtcagttgcctcatagcctgctggtcctgtaagcaagcactaagctccacagtgccagttccttgccccaacctggccccatccaagtacagaagaccttcctttcctcctttttccatattgctttctgttctaagtgggtgaataattttataattgaaaaaataaagataaagtctgtaaatccagccgggtacggtggctcacgcctgtaatcctagcactttgggaggctgagatgctcggccaataaatttctattgtttatgaa

SEQ ID NO: 220621 - DNA, 418 bp, Homo sapiens
ttgggtttggtgctattcgtattcagggtcttggaatgcaactcccacagataagggggtgctgctggagtgaaatactgtgatataacctttttttcaggaaatgaagggagaagatgtgtacgtgtgtgggagaggtataagagacctaggttgccatattctatcacagaaaatgcataataactaaatctggaaaatgatgaatagctgtacaaccatattatttagcaataggaggtaaatacaggtagaagcagaagaaagaatgggcaggggttacctctatggagaagctggggtgggaggatagggtggggacttattttacgaactgtgtaattgcctaacttgtgaatatgtatttctgaagtaaaataaaaattaagttaaaattaaattttaaaattcaaactaa

SEQ ID NO: 220622 - DNA, 351 bp, Homo sapiens
aggcaccgctgacctccccaggccctgtgccatggtcgtccccgacttcgaactgatatgtgagatcatgctcatggccgagggctttctggaagcccgccttctggccaggaagttcatcaccctgtacaccttgtgcaaggagctgctctcgaagcaggatcattacgactggggcctgagagccatcaagtctgtgctggtggtggccggctccctgaagaggggcgaccccagccgggcagaggaccaggtgctcatgcgggcgctgagagacttcaacatccccaagattgtgacagacgacctgcccgtattcatgggactgatcggggacctcttcccggctct

SEQ ID NO: 220623 - DNA, 565 bp, Homo sapiens
gtcagtttcaatatcacctccagagagcggcttccctgacctccaacccattgctgatattctgtcttacaaccctatttgtttcttttatagctgttaccagaatttttaaaataataatttaaaaaaattatttgagttctgtctctagaagaggaaaggtcatgcttactttggtgacttttatttatattgtagatatgtatatgtgtaaatttatgtgtatgtctacatactgagtacatgcatgcatttatatgcatgtgttatacattaatgtttcatacatgtctacatacgtgtacatgatgtgttgtgtgtctgttgtgtgtgtgcatgcatacatgtgcatgtgtatattacgtgtgcatgcatgcatgtgtgtctcagtacctgggccctggtgaataaatgatcacctagggttagggttctccaagatcttcttgaatatacttaagaaagtgtaactgccccaaacgctctgggtcccgacatgagagtggccccgggaggcagatctgccaggcgtaaccctatgattactcctgaaaaactaacatgc

SEQ ID NO: 220624 - DNA, 598 bp, Homo sapiens
tgaaaaaaaggttttttaaatccaaatttggttttatcattctttttaaattcacaggcaacagcacctgggcagaccatgccatttcccctcctgaactcgggtgctttgaaagaagtatagggggccggtcgcggtggctcccgcctgtaatcccagcactttgggaggccgagatggccggatcacctgaggctagaagttcaagaccagcctggccaacatggtgaaaccccgtctctactaaaaatacaaaaattatctgggcatggtggcacgcacctgtagtcccaccattgcacttcagcctgggtgaccctgtctcaacaaataaataaacaataagtaaataaatggtatccagattgagaaggaagaaataaaactgtcatatgcagatgacataattgtttatatagaaaatctgaaagaataaacaacaacaaaaaccccctggaactaataagcaattataggccaacagtaggatacaaggtatataaaaatcaattgctttcctatataccagcaatggacaagtggaatttgcaattaaaaacataacaccatttacattactatccccccatatgaaatt

SEQ ID NO: 220625 - DNA, 473 bp, Homo sapiens
gagacaggtgagtcatgaagattactaaggaaagactctctccacaaccgggcttatcttttcccagagggagatttgttaagaggagctcaaatacaaacacgggaaggtatatagtttggaagaaagcatttcaggtgattctggtatctctatttcctaccaactgctttcatgttgaaaaaaaaaatgatccggactagaatgaaaaaagatttacaggttacgtccagtttatatatgacggcttctcatttaatccaggcaactactgtaaaactcatcagtgaggcgctctaagtttgcattacacttatttatccatcatttattatttttttcatatgcccgagaacaccaaggaagagaagacaaataatctagaaaggaaacacatgaaaaaagaaaatcaagccaggtgcagtggctcatgcctataataccagcactttgggaagacaaggcgggtggat

SEQ ID NO: 220626 - DNA, 420 bp, Homo sapiens
cttttctttgttccaatggatgtgggccatttcaactgtggttggacgctggaactttctgatgagccaagcttctaccacacagcaagcatccgaaataccaaaatagatcatggttgacagacagtttcccaaaagaaaatgagaacatcatcaagagaatcacggggagtggattttgggtagatttaaaatatagatttaggtttctactagggaaccaagaaaaacaactcttttgtttatatgttttttgtggacaagttttcttagatatctaagacaaaatacctactcactgattacattgtattgcttcattagcatgatttcaactccaagttcttctctgtgtaggccaaacaccccccttctgataataatttcaatccctgatttatcaaataacatagctctacc

SEQ ID NO: 220627 - DNA, 336 bp, Homo sapiens
aaataaagcttgagaactacctctagatgactcacacacaaaatacttcatggttatttttaccagtaagctttttgtgcacttgatgtagtttttcctgaactaagtttggctctaacataagttatgtgtaaccttggtgcctcatcactttttccccggatatgttttttcatatgttactcatgtagttcagtaacgagatttcagtgaaaaatggtaagagagaacaaattaataaatggtttttaaataaagctcaaaacaaatgataaatcaacctttatatgagaaatatgttcctgaaaatttgtaaataaatcaactccatacttt

SEQ ID NO: 220628 - DNA, 573 bp, Homo sapiens
ctggctggagaccaatcaactcaaactgataaaagaacaaccctgctctaaagaagaaaacaactaattccactgcctaaagaagaaaacaactaattccactgcctgcaatatcctggttaaccagaagtactgagtctgttcacatgacaacttcactgctagcataaccagcatttgagaaagccagtgcactaaatgaagctacaaccaaggactcccactttactcccctgccacctccactggagcaggtgctggtatccatggctaggagacctgaacgtggatcacatcacaggactcttggcagacagtccccagcatcagcctgcaggccagtagctccgctgggtggctagactcacaagggcaataacaatcactgcagtctggctctcagaaatccccgtccctaggggaagggggagagcatctcatcaagggaataccccatgggacaaaacaatctaaacagtaacccttgagttccaaatctttccactgaaacagtctacccaaatgagaaggaaccagttaaagtaattctggtaatatgacaaaacaaggttc

SEQ ID NO: 220629 - DNA, 318 bp, Homo sapiens
gcacgagataaaatctcccaactaactaggaatagaagaaaactccctcaacaatataaaggacatttactaagaacctacagctaccatcatgcttgatagtgaaagactaaacacttttcctcaaagatcaagaacagaggaaggatgtatactgtcaccactcttattcagtatcactttggaagacttaaccagtgaaatgtggcaataaaaataaataaaacgcatacagtttggaaaggaagaaataaggctatccttattcacaggtgacattatcatccatgttgaagatgcataagcatatctccccca

SEQ ID NO: 220630 - DNA, 475 bp, Homo sapiens
caataaaacatgcccattttaagcctacatttcagagttttgacaaatgtatcacttatgtaattacaaccaccacaatcaagacaaagaacatttttatcatccccagacattccctcatgctcccttgcagtcaatcttcaccaaccctggcaccagaataccactgatttgctttctgtcagtataaattagttgtcaatatagattgctttctgtcaagatagaattctgtcaagaatttcataaagatagaatcaaacaatatgtattattttgcttctggcctctttcactcaagataatgttttgaaatcattcagtttgttgtgtgtatctacagttgattctttttattgctgaatattactatgtgttatggatatactacaatgagtttattcatttgtttgttgataattgttacagctgtttccagttttacattatgaataaaacttctatgaacatgagt

SEQ ID NO: 220631 - DNA, 620 bp, Homo sapiens
ctagtatcaagtgctagtatcagccagagtccagtcataaaaatagagtgtatttaatattaggaacttgtaataaagatataagaagactgaaagagcaaaaaagtggatgccaaatattagaactacagacagcagctacctttctactacctattgctacaggcatgacacattcaggaactagaaacaggaaataattccccctcccaccttccagtccccaaggccttcccatttactgaacttaacaggaagctagctggcaagggaggctggcaaatgaagtttgtcaaaattccagccctggcacatcagagcagaggagaggaggatggacttagagttgagaacaggaggtacataaccaactcactcctcaatcaaaatctatctggatgaagtggagacatatccattaagagataaaaaataaagagactataaattccaattagattgtagcacaaggaattgtcttaaactctgtggcatctgaccctgtaacaagggcccaatgtatatttgttgattggttttatgagaaaaataaaaattgggcatctgctttgaccatgagcataggacaaaataaacttatttatttatttatttattta

SEQ ID NO: 220632 - DNA, 414 bp, Homo sapiens
aaaagtgctgggattataggcatgagccaccatgcccggcctcactgcttcttttcttttagtattaggtgccaactaaaagtgttcaccacgtctgttcaacattgcactagatgttctagccagtgcagtaaggcaaggaaaaacaataaaaggcttccagatcttaagagggaaatgtaaaaatttctttattcaaagataacataactgtctgtgtagaaaatcctacggtatctacaaagaaaactgttttgttaggactaataagtgaattttacatggttacaagataccaaggaaatacagaaaaatccattatatttctgtattctagtaatgaacaatcagaaattgaaattctaaaacagtatcataatctgtcaaaaatatgaaatacttagagataaattt

SEQ ID NO: 220633 - DNA, 553 bp, Homo sapiens
gaccacacagacagctttagcatcagaagagatggccacacccagagctgggcccccagtatccacaaaggaaagttcagcttaggaagaagaaatggggagagaacatttttcttccttagcacctgaatgaatgctttgcccagcagggctacctcccgccagtctctacctttgttgtaatgccaattcttatttaatgtctgccaaacacaaaaggtccatcaggatcacgtggaaagaaagtgaaatgctggcggtgccccctgggtgtaggcctgaaataagatgaacaggaaataaaacataactgcagggaaggcgggccctagacaaagaatggcagtgggcttgcttgttcctcctctttgctcccttcctttcaagcctcttgctttgagagggagaggcttgtgtgtgttttgtatgggttggtagtgtgagaaggaagtcaagatgtttgggaaggatgaattttgagggaggatgttaaacagaagaacagccaagtatggggaaggattgggaataatggccctaaatgtggcagagt

SEQ ID NO: 220634 - DNA, 565 bp, Homo sapiens
tcatggttacaggcacctgtaatcccagctacttgggaggctgaggcaggagaatcgcttgaacccaggaggtggaggttgcagtgagcggagatcacgccactgcactccagcctgagggatagagcaagactctgtctccaaaaaataaataaaaataaataaaagttgtcaatagattaccaaagaactcaccaaaaagattgagctgagctcattaattccttgctgtagtgtgggttctgtggtgattttattattataatgtaacaccaagccacattgtcagttagtaacttctcaaaatgttgagtcagtggacaccgggtagggtaaaaagtctttgtgcctggtgcggtggctcatacctgtaatcccagcactttgggaggccaaggcaggcagatctgttgagcttaggagtttgagaccagcctgggcagcatagggagaccccatctctacaaaaaaaaatgagtaggctatggtggctggtgcctgtagtccccactaaggaggctgaggtgagaggatcccttgagcccaggaggcggaggttgcagta

SEQ ID NO: 220635 - DNA, 382 bp, Homo sapiens
caatggtaatgactgttccgccgatttttcatttgaggggaaaatctgaatacttacttttattattcatttataactggattgtttacttctccaagatactgctacttttgggggaaaacaacactaagtcaaatgacagaaaaaaatatgaacataaatgattctgctgctcttcagtttgctgctgtaaaatgtgaacatcctggaggggtgcctggtgcagcagcttaggcacttgcctacagacctaatgtgatcctgcctgtgttctaaggttacctattacaaaccgtaaaatgaggactaagagtcatgaacaagtcccaggttatctacattacactaaataaatcagataatgttttctggcttggtgaat

SEQ ID NO: 220636 - DNA, 384 bp, Homo sapiens
tgagatggagtcttgccctgttgccaggctggagtgcggtggcgtgatctcaactcaatgcaaccgctgattccctggttcaagtgattctcctgcctcagcctcccaagtagctgggattacaggcacgtgcccccatgcctggctaatttttgtatttttagtagagacagggtttcaccattttggctaagatggtcttgatctcctgaccttgtgatctgcccgccttagcctcccaaagtgctggattacaggcgtgagccactgctcctggccacacttgattttctgttccatgcatcagtgtttctttgtgaaggaatgaaaagcagccttaaatgtgtagcttgataattgggttgttttacagccaattcttgg

SEQ ID NO: 220637 - DNA, 824 bp, Homo sapiens
caagagtggctacatctggaaaggaaaatgggttgcagataggtggagatttgcatgttttagtctttataaagttctatcatttgtctttatggtaaacatagtatttttaaaaacatgtaaatattttaaaaaactaaatcaaatgaaaataaaactgcgcaattcaatagtatgtactgaaagcattttaaaatattcatacactttgactcttctatttctgggaatctgtcctaaggaaataatcagaaatgtgtgcaaatgtatattatgaagtagtaagtgctctaacatagccaaaatatattcgcaagctactgttaaatcccattatcactctagaaattgtaagtgcccctttcccaccagaaagtttttcatagcaggtatggggcccctctctgaataaggccataaggactactcactcctatctgcctaaagtaggtgggcagctgtcccatatgttgaacccatctgagtttcctctccatggaaacaaggttatcaaaaccagaactaagtcactaaatataactgtttttccttatctaaacacatgtaattaaattatgactctcaaaatacataaattgggaaaatcgaacaatttatattatctgtgctactttcttccagtgatgcatataattcagagccaaattctggaaattgtggatttttttccttttatttaatgttattattatttttagagacagggtcttgctctgtcacccaggctgcagtacagtggcatgatgatagcttactgcagccttgaactcctggattccagagattctcctgccttagcgtgc

SEQ ID NO: 220638 - DNA, 397 bp, Homo sapiens
taccagtgtcaggcaatctggactttccagatgccactgagatggcacctgtcaaaagagcagtggttccatttctagattgtgaatcttcagataaattctgccattttcatttcacttcctgaaagtcaaggttggtttgtgaaaagttaacagcatgctgaatgtgaaatatcaaccctcactctaaactttccctgttcagagcatcagatgaagacttcattgggttttatactggctttctttttggtagtccactgaagaatccagggagtttgaaagttgttgtatactgttaatgattgtctgcccatgtcctgcctgaaataccatgactgtttatggaaagtatctttaataaagctggatacagtttggcttggaaaaaaaaagt

SEQ ID NO: 220639 - DNA, 544 bp, Homo sapiens
aatttcagatttgactttattttttactggagttttttgaaattatacttttaaatttccaggtagtttattttgttgttgttttttagcatttcttacaaacttctagttttattgccttgtcaaagagagtatggcctgtacaatttgtgtgcattttggagatcatggatgttttcttgagacctgatttttagttttaatacatatctccaggaaactgaagaagaaagcatattctctgaagggaacaaaattcaatcagatgtattcatttgaccttacaaagtataatattatggacctttaattttaatttacttgattcattaaggctaagaaagatatgttcgtctcctattattgtatttctgtctgtttcttttgtttctaacagtttttgctttgtttctttttgatgttatttggcaaatgatctttttatatttaagggaaaaaatattttcctttaaaggcttgtatacctttgtgaattttacctgattttgttgtaatagtttctgtagaaatacatagttcagta

SEQ ID NO: 220640 - DNA, 524 bp, Homo sapiens
ttgctcgattttgtaatctcccaaaggaaggaatacattggaaatagcaatacagaagaccagcaaaggctatcattaggatggtgttgaagaaacaaccagcaggcctggacagcagcctgtccaggttggagcagaggtcaccaagaaagaaatgcaaagcatagaatatctgatatttgaacacagtgagacaagattgatacttctggcatacaatttgctaataaattaatggtctttatcttgaaaaaagaaaaaaaaagagaaacaattttaactccagggaaaacatgattctctaagaaaggaaatgaaatcatagtatactctgaggctaacagggcataatacttacatagtcttaaagatgtaaattctgacatttaatcgaatcaaattacataacagaactagttaagaaggctggccacggttgctcacactacccagcgcttcagaaagatcacttgagcccaggaagacctgcctggttgacagagtgagaccctgtctctaaaatt

SEQ ID NO: 220641 - DNA, 594 bp, Homo sapiens
  misc_feature (12)..(12): n is a, c, g, or t
  misc_feature (42)..(42): n is a, c, g, or t
  misc_feature (451)..(451): n is a, c, g, or t
atgtggctcccnaccctcaaggagtttccggtctactggggncgtgtaactagacaaggccaagcacaacactgtaagttcatgccataatgcggttggcacagggccctgggtggcggagtgctgtgagaacacagtgggggacatgcagtgcaccgggcaggctctgcgaggaaagtcaggatgaaccaacacatgggacaatgagtggggctaagctaagagacagatgggagttggtctgtgaatgaatgaaagtgggaaaaggaaaagaaagtttgtttctccttccatctcttcctggaactatagtcctcggctggatacagtatcactaagccatgcttttatttatttattttttttgttttttttttgagacagggtctcactctgtggcccaggctggagtgcagtggtgtgatcatggctcactggcagccttgacttncctgggctcaggtgatcctccctacctcagcctgcccaagtagctgggactacaggtgcacaccactatgcctggctcatttttgtattttctggtagagacagggtcttgctatgttgcccaggctggctaaaaggtcctat

SEQ ID NO: 220642 - DNA, 485 bp, Homo sapiens
actggcctcctgcaggtcttcgaacttgccaacgtgcacccaccgcagggccttcgagagtgccgctccctcccctgggaggtctccccagctatccggggttctccccgacacttcctccccatccccattcagttatcaaagcctatgccaaaaaggcctcccgtctcccgagtccctgcacacctttcgcagtgtgtgttgaatgccttgccctctgtctcctgaacctgggcctaagatcccggagagcagggcagctccctgtgccccgtcatcgtccatacggacctggcccgcagtgggctctgtcactaaatggataaccagtgctggggagaagacccagatgatgtgctggtgaagagtgaggcgttcattcagcttgcagaaggaggcttaggaaggctttatagaagaaaggaaatgtgagcaaagatgtcgttgaaagtaactttttttgaattaaaaatattgtattaaca

SEQ ID NO: 220643 - DNA, 825 bp, Homo sapiens
tgtggctgacaaggtaccttttggatcatgccctgagtactacaacacagtagtttgctcagtcactctgaatttaattattacaagaggtccaagtttttgttggggcaattttaaccaggttttcttgaactgatgacatatatctgtttcaaatggatgctgatttcttccaaaatgtataaataaatgagtaaataagagatgagtatttaaggtcctagtgacctctatttaaatgaagagaatgtcctacacataaatttataagtatacagttgatctgcattatccatggggacaagttcctggactcccccagatacaaaaatctgaggatgctcaagtcccttatgtaaaatggtctagtatttgcattaacctatgcatagcctcctgtatactttaaatcatgtctatattacttatacctaatacaatgtaaatgctatgtaaacagttgttatattatttaaggaataatgacctgaaaaaaaagtctctacatagtctgtatagattcttcctcccttccctggagtatttttgatccaaggttggttgaatccacagatgtggaacccacagatatggagggccaactgtattttgatcttcccaagtattaaccaaggagcaattcagactactatctactatcatggtataccatatttaacaatttcaaatgccttaagtctttttgttgcctcaaggaaatttgactatgcacttaatatatgtaataacctgcagtatcaacttgtagtcatctcttcagcatcagagctaaggatttactaaaagcattcttccaaaaataaa

SEQ ID NO: 220644 - DNA, 402 bp, Homo sapiens
gactttctgagaaaatttatgttcgactgctatttcttttgcagcacaaatagtatgtttctaacaatttggtggcctgtacaaggaccccattctcctcccagagggttttccatcctctcctgtgaggacacatgccccactgcctcattgcagtagcctcaggggtaaggaatggagacccccctagtgtgatgaataaacccggactctcagcaacatgggaagaaaagacctacaaataccgtggtgaccagataactctgtccacagaccaagattgataaaagcaaaggagctttgtcatggtgagctacttctcataggagtcaggatctgcatctgaagactatacaaagataaataacatggattaaaagcacaatcatcattgaaattaaa

SEQ ID NO: 220645 - DNA, 474 bp, Homo sapiens
ttttttggtgttccctgtcctgcttccccagaggaagccagaagaagaccccagttgccatgaactccgccgtcactagccgtgagcactccacttactcgcagaggagtgatgtcgtgctcagctcccaacctatggccaaggcaggaggacagataggcagcccgggagtcccgcagcagctgcctggcctatgacatcttggacatcctgccatgttatctctgtatcttcttggggattcagcacttcctcacagccctggggggcctcatggcggtgccattcatcctggccaaggacctgtgcctgcagcaggaccccctgacacagagctacctcatcagcaccattttctttgctccagcatctgcatgctcctgcaagtgtttttaggggtcagtactggaggctggaagtctgagatctggatgccagcatggtcagcttctgaggggtgctcctttcctggct

SEQ ID NO: 220646 - DNA, 350 bp, Homo sapiens
ttttttggtgttccctgtcctgcttccccagaggaagccagaagaagaccccagttgccatgaactccgccgtcactagccgtgagcactccacttactcggtaaggcccggtgggagacagagggagagaaagatggggagcaggaagaagggctgcggggaggtcctactgccctgactccttcttagtgctaaggcctagcctcatgctttagatcagggttcagatgatgagacccatgcagcactccctccccacctccagcgttagtgccccttagtgtcacctgtggtcaccatcacaacagacacagaatccgccccgaataaacggtaaattacaaaggag

SEQ ID NO: 220647 - DNA, 398 bp, Homo sapiens
ttctggctgtttgtcaattgaaatacacactgtgcttctacgggtcaacaatgtgctaggttctgccaacactgcagggaataagacacatgtggctgctgtcttcagagatgacaatatggctgtgtgtgtttgtgtggggaggtttcttaagtttatataaaataccaacaaaatgattttttttgttgttttgtttttttttagacagggtcttactccgtcacccaggctggagggcagtggtgtgatctctgctcactgcaacctttgcctccgggttcatgcaattctcctgtctcagcctccagggtagatgattacaggcacacacctccatgcccagctagtttttgtatttttagtagagatggggtttcactatgttggctaggctg

SEQ ID NO: 220648 - DNA, 379 bp, Homo sapiens
tgaaacatagcaagtaaattgtttattgttattgtcatttttgagacagttttgctcttgttgtccagactggaagtgaaactccgtctcaaaagaaaaaaaaaaaagttgggaaaaacatggttctccagggccgtggcaagccaggcttctgcactactgccaagaggagtgaacttgagctgcttttcgtttcctccacacaacatggtgaggagccaaaggaagacagtgatctaagtcattccccaccttcaggcggcaccatccctgttttcaaatccctaactgcctcactcccctaaagcattttttccccgctggaaacagactggaacacaattaagcaatgttgatcactgcttcagtcaaaagtggt

SEQ ID NO: 220649 - DNA, 548 bp, Homo sapiens
aaaggggtttggaagtgggagtgattgggattcagggaaagaaaactggtggtgaggagaagaaaggaaatgagaaataagcccataactggtgttttctaatgagatctatgttttatgtcttcgagatctttatatccttcatgaaattgctctgagattcctcctttagggaaagtttggcctatgtaataaattcatacacagaagttttacaatggggaattgtatttgcattgaaaataagggtttttatatatttttgacctaggattaaaagccagtctaattttgatgtaattcataattctctcttttagaaaaaatggctatatttataatcatcagaaaatggctccatcttactttcacagagattctctttgtgcttagagtttgaggaaatctatgatatcactacattatttagaatggaatctggaggaaaacaaaaccctgttttacacacgaatgtatctgaatatgtgtcacaaatgctactatcatgtatttatggttattcttcatttcttatatgctgaatgact

SEQ ID NO: 220650 - DNA, 580 bp, Homo sapiens
cctcagtatattccttttaaaaatataataggagctgggcacagtggctcacacttgtaatttcaatcctttgggagactgaggcaggaggatcatttgagtccagaagttcaagaccaacctgggcaacaaagcaagacctcgtctctacaaaaaataaataaataaataaataaatacattcaaaaaataaaaaatctgggtatggtggtgtgtgcctatagttctagctactcaggaggctgaggtgggaggatcacttgagcatgggaggtcaaggctacattgagccatgattgtgccattgcactctagcttaagtgacagagcaagactccatttcagaaaaaaataaacaaatacagtcagacatttagcatcctgacttacacgttaaatatgtcaccattcctgggccccttccttatttatacagagtcctttataaacaggctggaacttggaaagtatcattatatacctaataaacttactatttttaaaaatgatcatgtttagtgctgaaaaagttgtggtgacagtgttatgttattagacttctggtagcactataggttgg

SEQ ID NO: 220651 - DNA, 424 bp, Homo sapiens
gtgtatcgttccagtattaggatatgtgctgctgaagcaggcactactgtatcttaggtgggtttatctaattgccactggctgtttcttcctgagtatccatttgagctctcttccctccaaaatctgtttctcttagcccaataaataataccagcaacccattactcatactagaagcaacctgggggccatcctagatactttacctcctctaatcattaaccaaatttctactcatagtaccttctaaatactttcttttccatcctccctgtctttgtctcaccaagtctctctctaatccattctccaggctaccagttgagagctttctaaatgcagctttcatcactcatgaacctttgtgattgcttcagattcttcaatggcatctcttgctaaaaagatatgcctaagcata

SEQ ID NO: 220652 - DNA, 431 bp, Homo sapiens
aaaatgggtctctctctctctctttctctctctcacacacacacacatacacacacacaaagtagggttccatcactggtaaacaaaatcatcctgactgaaaggctgggctttttgttttggctatttggtgctatctggtggagtaggtgattggtaagtattcgttagatgggtggaggtgtggatagacgttgacatgaggcagttttcttccttcatcctgcttttcaacttttgaagcctaagtacagtcttattgtacaatatggtgactatagttaataacattgtatcatatacttgcaaattactaagagaggccaggcatggtgcccggcccctggtgatatcttttaagttcctggatccatttgtacttgaagttcatctctagactttttagttatatgactcattagccagagtct

SEQ ID NO: 220653 - DNA, 445 bp, Homo sapiens
ctcagggaagggcgcggtggctcacacctgtcatcccagcactttgggaggctgaggctggaggatcgcttgaggccaagagtgggagatcagcttgggcaacatagtgagaccccatctctgcaaaaaaatttctttaattagccaggcgtggtggtacacacctgtagctccagctactccggaggctgaggcaggaggatcacttgaatccaggaggttgaggcagcagcaagctgtgattgcaccactgcactccagcctgggtgacagagcgagaacctgtctaaaaaacagagctggcacccagcaccggcagatgtgagccctggggagaagcaggggaagaaggggtagggtgtgtggccagctgggtggcccttcgcaaactgctgtctcttatgaaaaataactaagtgtagttttctattttgtattaatgatt

SEQ ID NO: 220654 - DNA, 446 bp, Homo sapiens
cagatcattaaaaaatgtccattctgaacaggaagcaattgaaaaacagtaacaaaaacatgaatagagtcagggacaaattccaaagggtctaatattctgtcatctgagcccagaggagaggagagtgtgacacagaggaaaaatagctgaagaaataagggctgaaaacacccaaaatttggtgaaagacaaacatagatgtaagaagttcagtgaatcccaaacatatcacatcacaatcaaactggtaagaatcaaagtcaaataaaaaatgtcgaaagcagttaagaggaaaaggatccaaattactatgggtttctcaccagaaacgagggaggtcagaaggaagtggcacatttttcagatgctgcaagaaaagaacgtttgacccagaattctatattcaggaaaaaaaaaaaaattcctttaggaatcaaggcaaa

SEQ ID NO: 220655 - DNA, 457 bp, Homo sapiens
acgcatccctgcctgtctccctttttcctggtgaagcaaatactgatctgtctctgtagattacttttcatttctagaattttatataaatggaatcatataatatcaactccttttttatggcatctttcattcagcataattatttttaggttaattagtgctgtttcatgcattagtgttaattactttttattgatgagtattattcaattgtttgaatatttcacaatttgtttatctgtttaccagccagtggacatttgagttgtttccaggtattggttatttgaataaagttactttaaacattcaatcaaagtttttgtgaacatggttttcatttttcttgggtatattcctgagagtgagattgctgggtcatagggtaaatgtatgtttaactgctaaaaaaaaaaaagtcgacgcggccgcgaatttagtagtagtagtaggc

SEQ ID NO: 220656 - DNA, 500 bp, Homo sapiens
ttctaggctatgtggtttgtttgtacatttttcaaattgttgcaaatctctaaaaaaaaaatccaatatattattgaaaaaaacctggctgggtatggtgactgaaatgaaatgaaggccgggactaatcagggaggaggatggtgagtgagatgaaggagaatatatgccagaggaaggcggtctaatcaggaacaggatggaggtgaggaaggggacacgtacccctcccgggataatccctaagaaaattgacaatagacgctggagggccagcaagtccatagattcagaaactaccagcaaccgcggggtggcataaacatgccagctatgggtttccacccagaaaccaagtactgctctttgcgcttttaggagacagactgtgtaactacgaaacatgtttttaggagactatttactgtcaagaagaaatgttcacggcaaacggcgaagtgggaaaggctacacaaaatggatgcatgtacaacataatt

SEQ ID NO: 220657 - DNA, 498 bp, Homo sapiens
caagctgggcagcttcagcaagacgctgggcatcaagctgaagaaaaacatgggcggcctcggcggcctggtgcacggcaagatgggccgcgccaactccgccaatggcaagaacggggactcggccgagcggggcaaggagaagaaggccaagtcgcgcaagggcagcaaggaggagtctggtgcgtcggccagcacgtcgccgtcggaaaagaccacgccgtcgcccacagacaaggcagcgggcgcgtcgccggcggagaagggcggtgggccgcggggcgacgcctggaagtacagcacggatgtgaagctgagcctcaacatcctgcgcgccgccatgcagggggagcgcaagttcatcttcgccggcctgctgctcaccagccaccggcaccagttccacgaggagatgatcggctactacctgacgagcgcgcaggagcgcttcagcgccgagcaggagcagcggcgccgcgacgccgctactgcggccgc

SEQ ID NO: 220658 - DNA, 281 bp, Homo sapiens
tgagccactgcgcccggcctgtgctttgatttttaaaaagtgcttatccctctagccttgtgcttacttttccgtatagtagcctcataatttcctatcattctttcttactttacatgtaacagtcccttacagttcctttactcattgaaatcttagtggctctttattttcaccctcactgtgattacaatcctagattctatctcactgtcttgttttccctgccttcaacttcttaaatctttagtccctgagtttcagaatggcaaacacataaa

SEQ ID NO: 220659 - DNA, 553 bp, Homo sapiens
ttctctgttatatgaattatatcttaataaagctatttttaaaacccaaaagaatgcagcaccaaagcaggcaaaaatttcatctacataaagcaatctaacaggattaggaataccaagggatccattttatattataaatccaaagataacacagcctttaactcagatggatcattattggtcactagctgaacagtcaacaatgtgaaactgcaatgcttgatcagacataaaatgctttgtgcaatcagaaatcctacaacagacctttctgaggaaaagtacaagttgttgctttcctcagcacatgtaaatattgggtttacagcagaaacagagccagagcaagggttaatgatgcaaagttgggagttgagggaacaggagttggatgatgtaaaaggtctgcctcctctctttccactgctgcaccccatgtgtaaagtctgcgaattgacaccagggtcatatgggtctatctgtccccctttggtacacctctatcatgtagcaatgaaaaatgtaaataaaggaccttccaactgtgaaa

SEQ ID NO: 220660 - DNA, 417 bp, Homo sapiens
ttttattaaatcccgttttctgaagttttttaatatagaaaagtggacactggaaccaaaggccaaataatagtattttacataattttgtatcaatgcagttgtagtataatttcatttaaaatattttgcctgattatggctctacttaccttaaaggtttgagtatgtttggtgtgttggaaaatacattacttaagaagcagccagcatagtggataagagcattggcttggcaaccagactacctggattcaaatcccagtagtactactttgtactactttttagacaagttattaaacctttcagtgactcatttttcctcatctgttaaatgtcaataataatgctccctaacttacagggttattgtgaggattaaatcacttaaaatgaatgaatgcttagaatagc

SEQ ID NO: 220661 - DNA, 503 bp, Homo sapiens
attgttttcaagataccttgttacaatataaaagaagcgactaagttccaaggtcatgtaaattttaattttatccatgagcaaaaggagggctgctccaagtaaaataggactgatttttgttttgggtcgacccaatttctcctacaaataggtgccaacttctctgaaaattgagactccgagctcggctttactttgggcaaaacacaattattttggggctctgagatagagaagtgagactttaatccaaaccttccagggaaagacatcagatttcatttttagccctccgttcctcccacactcagaatttttcttgcctgacagttatggaagtcttttgaaaaagtcctcattttggcattatcttgacaaccgatgatacctcatgcaaatctagatagagggggaaagaatattataacatggattttctttttttttcctgttcactaagttttttaactgttaaaaaattaaataattctcatttctta

SEQ ID NO: 220662 - DNA, 907 bp, Homo sapiens
gtccttatatggtgctttttttgcaatcccagcttgtggcgtactgtaataaatcaaatcctgcctaaaaaaaaatacatttatggttgaattgctaggtgtgataaaatgcaatcattgaacaacataagccttctttgctcctcatcacaattcaaatattaaatgttttgctattactattcagtaaaaattcagataaaatgtagcactcacgtttattctagattgcattgagattttgagtggcatgtacattaatgttataaaaagaggccgggcatggtggtgggcgcccgtagtcccagctacttaggaggccgaggcgtgggaatcgcttgaacccggggagcaggggctgcagtaagccgaaatcatgccactgcgttccagcctgagcgacaaagggagactctgtctttaaaaaaaaaaaaaaaaaaaatctaagaaatagagtgtcttgcagaatctgaattttttttcaatgtaatgcactagaatgcaagccagactgaaaatactgtatagagcagtgttttttctaatactctaacatattaaactaaaaatgtacttattcatattctttcattgtatgtaaactttgttcatataaatctatatggccaatgataagaaatgagaaaagttaaatttgttcttaaaaaataaaaatttttataaattaagttctatttcttccaaagttatcgatataaatagcaaagaaggaaataattgctcttgaactattcattttctgatctgtctttccagcctgggaaacaagagcaaaactccatctcaaagaaaaaaaaaaatgatcgcctttattatggagattttcaaaactatattttaatcaatccatatatatccatcatccaactctaatcattaaattcgt

SEQ ID NO: 220663 - DNA, 451 bp, Homo sapiens
aataggaggaataaattctagtgttctagaacaccatacattgactaaaattaacaatttattgtatattttcaaagggctagatgagcagattttgaatgttccaacacaaagaactgataaacgtttgaggtaatggataagctaattatcctgatttgatcattacacattgtacacaggtactgaaacatcacactgtactccataagtatgtacattatgtgtcaattaaaaataataaaagtaaaaatatacacataagtgtacagatatagtaatgcataggcattacaagcttaacaattatgccattgaagctttctataatttgattttcacttaaatttcaattgatccccctgcaaattaaatgctcttaaatgaaaaagttcctatatgaataatataataaactctgacttactttaagttaaaagacattaattta

SEQ ID NO: 220664 - DNA, 134 bp, Homo sapiens
ctatttcaacttcctttttggcagatgaggaatttgaggccccaagtgatgaggaactcacattaagtcacatagcaaatgacacagagagcaaacctgtaatacacgagacctgcatctgcactcatcatctt

SEQ ID NO: 220665 - DNA, 225 bp, Homo sapiens
aaaatttcactggcccagtccagggctgcttgagtgttactgttttgtgccacaatatgatgtggccagactacttttctagtttcgagattattttggagctttatattgggtatgttcttatccaactatcattaggggcattgatctctgatgcccttttctttcttatcttccaaatggcaggcagtaaatggcttattaagcaagtataagattcaagat

SEQ ID NO: 220666 - DNA, 105 bp, Homo sapiens
acagccacaccttctgactctctttctgtagtacttgtgacaaggcctttgcccgtgatgtccccttttcacagactcttctttctacctgccttctcctacctc

SEQ ID NO: 220667 - DNA, 525 bp, Homo sapiens
atccaatcaagtttcagtattttgcatggcattctcactgcctcactttgccaggcatcgtggagttgaaaaacaagtcccaacagaatttgctcaaatatatctcatcgtgtgaaaggaatcacagagaactggatgatgtaatattgactgcctgttagtaaagagaataagcatgtccgccaaagaattaagcccaagagccagagatgcagaggaaatgatgagagggttgaaatggtaaatgaagatgtcaagtcatatgatgtgtggacccaggcgctgcggcagcacctggaacctttataagcacctcttccagaatggtacagattttctctcacaaaatgtacgactatatatcacactcttctgtttgatcatctttattttcgtatgtctacatgctaccatcaagcaacatcgtttgagccagaacaaaggctgctgccttccttcagttaacagcaggttttatttctctgccctgaatcctatgtagtcaaataaatacttttgtcacag

SEQ ID NO: 220668 - DNA, 395 bp, Homo sapiens
tgcacagaggggcaactgggtcagattcagggtctccagaaaaagttggggcccagggatagattcaggaggaacccacacagttttccagaggataagactctcagcggggcacggtggctgacgcctgtaatcccagcactttgggaggccgatgagggcagatcacctgaggtggggagtttgagaccagcctgactaatatggagaaaccccatctctactaaaaatacaaaattagccaggtgtggtggtgcatgcctgtaatcccagctactcgggaggctgaggcaggagaattgcttgaacctgggaggcagaggttatgatgagccaagatcatgccattgcactccagcctgggcaacaagagctaaactcggtctcaaaaaaaa

SEQ ID NO: 220669 - DNA, 422 bp, Homo sapiens
tatgtgcctgtaatccagcactttgggaagctgagtgggcagatcacctgaggtcgggagttcaagaccagcccggccaatacagtgaaacctcgtctttaccaaaagtgcagaaattggccgggtgtggtggcacaagcctcctgagtagctgggtttggttttccccagggccatatgtcagcttatttaccctcctcacttggtgtctcccagcctgccagcccatgctgttcatccagtatctgctgaatggtgattacctattaagtggaactaacacaaaattgcttatctaaaagcaattattggtgattatttccttgcagtggcccactagagggcgccattgttaagtgtaattccagtaggtgttttgtgttttttttttttaatggaataaactgaaatctttacatggt

SEQ ID NO: 220670 - DNA, 320 bp, Homo sapiens
atttctagaattctgcagtcaagacatatgaactgccttcatctttatcaccaagtattacaaccagtcgtaaacaacggtcaggacagctcttttgcaaggaggtcaaagtcctgccaacatcgaatcctgcagaatactcttataagtaaaacctcagtacgtaaatacaatccatatttaaccaaaacaaaagctgaggctcagagaagttaaatgaagtgccaagggtcggggagggctttggggtgattcaagcacattacatttacggtgtactttatttctattattacactgtcatatatcatgaaataatt

SEQ ID NO: 220671 - DNA, 614 bp, Homo sapiens
gcgatgagagggtattgtctacagtggctagagatgcatgaaggggtcacggtcacataggaagctcctcagagctgggccagggacaggaagtgacacatttcaccagcccccactgctaccacccgctccaaaagagaaggcagagccagcactaggagcctggatgggaggccaagagcctggattccaggccaggatcccagatgggagtccaggagccctgatgggaggccaggagcccagatgtgaggccaggggcccagattcaaggccaggagcctggatgggaggccaggagcccagatgtgaggccaggagcctggctgggagcccaggagcccaggtgggaggccaggagcccagatgtgaggccaggagccctcatgggaggccaggagcccagatgtgaggccaggagccctcatgggaggccaggagcccagatggaagcccaggagcccggctgggagctcaggagcccgggtgggaggccaggagcccgggtgggaggccaggagcccagatgcgaggccaggagctcggatttgaggtcaggagattgagaccatcctggctaacatggtgaaaccctgtctctactaaaagtacca

SEQ ID NO: 220672 - DNA, 532 bp, Homo sapiens
cttccactcagggttcatccgtcacgctcctttcgccttgaggggcactgagggccctgtgggtgtgtggggcccgcgtaggggaggctgaactggacacacacttggctcggtctgctgggagacgtttcggggttcccagtcatgtcgtctctacctgtaggagcagcagggagtctcaggacaggatggccagggccagaggtcacctggtgaggcggacatgtactcccaacctgggaggtgtggggactgcaagagaaacagagctggcagtgggaggctggacgtggtaggcaatgccggtcctggagccgggcccatgaccgttctcacggcggcgagctgtgatggggaggctgccttccaggtgccaaggttagaaaacaaatccggggcagccctgccgggagaaagctggtattctacaaaggcgcgtgaagaggtgaacacgggtgaacacgcagtggggaaaatggcgcgggttaattgtttattaatcacaggcagctcaccaataaaaccgtcacca

SEQ ID NO: 220673 - DNA, 506 bp, Homo sapiens
acttcctggttcaagatggcatctgtgtcctcgcctgctggaaagggccaggagcctttctctagcctcctttatgagagcagtcatcccatcccaaagtcctcacctcctcataccatcaccttcggggttaggatttcaacagataacaaacattcaggccatagatagcgccgtgtcttacagcaacagtctttctcatgctccttcaggcttcccagtgctggagtattgtaaacaaaaagaaaaagagcaggaagatagtctgtctgttcacatctctctttgattggccctataccttaatctctaacagtcagaaaatcctttatgctaaaattaccttaggattatttatgtgagaattttctccttcatagtcatacaaacatttttgtgccaatttcccctattttattggtatgccactcttgtgtatttcatgtgcagctttttcaatttagaaaaatattttctctaaaattaaagaaatgtgttttaaaatc

SEQ ID NO: 220674 - DNA, 373 bp, Homo sapiens
aataacttttcatcagtcatcagttcagcaagtgcactactgtaatgagctgttaagcatctttttgaaattaaagacagcttacaccctgatccctatctctgtaatgtctgcatgccttgaggattagattaagagtgtatttcaggcaatgttacagtaatttatttcttgggacgtctgtatatatataatattttattcagtaatggattgagtgtttaaatatagagacagaagaggtggaattggagatctttcttggtgtttaaccatcatttaacccatctaacccaggttttctgttgttttgaagaataaaatgtatacatttattcacttttaagtaagtgaaatctcaggaagtcccgtt

SEQ ID NO: 220675 - DNA, 433 bp, Homo sapiens
aaatggtccaattgcgcaggcttctcactctgtttcaagaagtttagacttcagccaaagaaaggcagggactactgttactgaaggcttttaaaatccaagggtggcttgatccctctgattgcagcacagtgaggaggtcataggaggtgagagatgagagggggtgaaagaaggcagtggagaaagagaaaaaagaatggattagggggatgttgagaaagtagaattgacatgattttgtgactcattgaatgtggggaatgaaatcaagtatgctgcctgaatttctggcttggacatctggtggacagtggatcattcattaagaaggaatgcataggagagaataagatgaaattgcctggggacaatgttatgtttaggaacttgagaaaacccaagtggaaatttccagaagggagttgaatat

SEQ ID NO: 220676 - DNA, 1295 bp, Homo sapiens
ctagtatatattattactggcattgtgtacttctggatatggtgtatgagaaaggacacaacattacttctgaggtattcttgccaaaatatatattattactggtgaaattaacattgatctctgggttaaagtggtgtcttccaggtttctccactaaattaccatttttccctcagtgactaacagatatcttggggaaatactttaaaactacgcaaatattgccaggcgtggtggcgtatgcctgtaatcctagcactgtgggaggccaaggtgggcggatcacttgaggtcaggagttcgagaccagcctggccaacatggtgaaaccttgtctctaccaaaaagtggtggtgtgcgcctataatcccagctacttgggaggctgaggcaggagaatagcttgaacccaggaggaggaggttgcagtgagccgagatcctgccattgcactctagcctgggggataagagcaaaactctgtctcaaaacaaaaacaaaaacaaaactatgcaaatatcctgtttcttgtaccttcacccactagttttagcatctatggatgattcttgcctgccacaattattactatggcatttgcctattagtgattttctgtttccttcatttcttctctattaataggaattcttctctaagagagagttattctcctccctcatttatttttttatatcaatatgggctgatgaatatttattttattttatgggttataatcgaacactgtcattatttattttgttgctccagtggttccagctctgggcattaggagcttaaacaggttggctcctgtatcctttcaacatgcctcattatttttagtgctttcttgctttttgatgcttactttttaatctaggctcatcttgtactttctttgccccaaccatggaattgatcttttctccaaagaactctgattccttttattggaaaatggacttaggaaccaagatcttggcattgagtagtctcattgctactggggtttcattgcttctgcgtcctctcagtggacagagtttggaaatatatgcaggtatgctaacacacatacatatgtttatatttgtaaattataaaattgtataattttaaatttctgtattataaaattatacatatgttataaatctatgtttatttcaacatatatctgtataactattaaggaccacaatgaatacattcaaaggtaaatgtgtgaatatctctaaggcatacttctacttatctcctaataataaagagagtaggtccattac

SEQ ID NO: 220677 - DNA, 530 bp, Homo sapiens
ggctgggagtgcagtggtgtcacctcgccttgtatgtcatcgccggttgtgtgcctaacatacatacaaaaaggataactcgaatttagccatcacgcattttcaaaaatactgcttagaaattgaatgtttggagaaaagatataatctggggtttctacacggtctgaattgggttcatttccgtttagcaaacatttattgagctcccagcgtgggtcacagaattcagtaaacctgatcccgtgttcaaggtgctatattccgatgcagggcagggcgatgcagtgaaagaatggtgaccacagcagtagcatgctaatagcctggtgggcaggtacaggttttgcatttctttggcgagatcacttttgagtgtctccactgggtggcagaattaagacccgtgaacgtttaatatctcctgtatatttagtatattatgaatatatactgattaatgaatattaagtgcgtgttgtatatcttgtgcctcatgaatattaaatatgacctggtcttgccagcct

SEQ ID NO: 220678 - DNA, 394 bp, Homo sapiens
tggaaaaaatgcatttcagaaacagctcagctgacttctggtgccgaagtcaaggcttcttgcctgtggctaaatttccttctagccgggcacagtggctcatgcctgtaatgccatcactctggtaggccaaggttggaggactgtttgagctcaggagttccagatcagcctgggcaacaaagtgagatcctgtccctacaaaaaaattagctgggtagggcagtgcgcacctgtagtggatgtggtggttgcacaccggtagtcccaagtactcgggaggctgaggcaggagcatcacttgagctcaggaggtccaggcttcattgagccaagatctcgccactgcactccagcctgggtgacagaacaagaccctgtctccaaaaaaaaa

SEQ ID NO: 220679 - DNA, 363 bp, Homo sapiens
gtttacaccacaaaaaatttaattatcagtcatgtactatctgggtcaactaaaattcttcttcatctgtcttcactctaggatccaacgtgaaggaacagctcctctcacgaacactgttggtctcctggatggagaaggaatgtggtgaaccctgagctgactctcagggcctttgttcagaacattttacttctgctcatatgtcataggacaaagcaaattacatggctgagctggatgcaaatggggaggggaagaggactcttcccacagggaggggcataagtcacacagccaaggctgatgtcaacagggcagggatgtataatcctcccacagggaggagtagctaatattttt

SEQ ID NO: 220680 - DNA, 601 bp, Homo sapiens
acagattcaaaaaatgctatactgaaaaatctagaaattacaatgatacactctgggaaaattgtgttgaatgatttattgaaagtgagaatgcatcagaagagtgtgataaactgatttaaagaaatgcatagtattcattataaaaaagttatcccagtagtttcctattatattattttatatataattttgaatatggagtaaaaataatatgaagtattgatacataggtatttgactatttgacataaatttctaaaagcattgatttgggctaataatttattttttaattttcaagtttcctccttgggaaaatggaaggctgtatttgaatatacaaggcagtgggtgttgggtgtcaattgcttgcaagtcctgtctaatgtgtcaggagccagtggatgggttatctctacaggaatataatcaataaggtgtgtattcaggtcgagctaactgcttgtcactttttctctctcatgaagtgcagctaaagaaaatagtcattctcttcttaaagtattaagatccaggccaaaggaaatggaatagctagcggctgtttaaaatgtgggaaacatagcactgctaacca

SEQ ID NO: 220681 - DNA, 425 bp, Homo sapiens
tcatctgtgctccctaccctcagtccactgtcctgagtcccatgcaggatgggtgccccgtacacttggcattgattacctgtccttgtctgcccacatggtctacaccgtgggtctgcatcagtataagagtcctgatcccggccaggcgcggtgcctcacgcctgtaatcccagcactttgggaggcagaggcgggtggaacactgaggtcaggagtttcagaccagcctggcccacatgatgaaaccccgtctctactaaaaaatacacaaaaattagccgggcgtagtggtcggtgcctgtaatcccagctactcgggaggctgaggcagaattgcttgagcgcaggaggcggaggttgcagtgagccgagatcgcgcaagtacgctccagtctgggcaacaagagcgaaactcgatatca

SEQ ID NO: 220682 - DNA, 523 bp, Homo sapiens
cttggcctcccaaagtgctgggattacaggtgtgagtcaccgagcctggccctttgttttaagatgtagaattttaaacactcagtttagtaagactacatttatctagaaattagtcttttatcaatctctgagtacaatccagactcaaaataaacaagatgtattttaatgtattccctaaattatttatttttcttgagacagattctaggtctgtcaccctggctagagtgtagtggtgtgatcataactcactgtaaccttgaactctcgggctcaagcagtcttacccattagcctcctgagtagctaggactacagatgcatgccaccacacccagctagatttttttgttttttgtagaggcagagttttgcagtgttgcccaagttggtctcgaactcctggcctcaagcgatcctcttgcctcctaaagtgctggaattacaggtgtgagccactgagcctggccctaaaaactgtgtggtgcctactatgaaggactctgatctgacaata

SEQ ID NO: 220683 - DNA, 384 bp, Homo sapiens
ataaaatagaccattcctcctctttgcctttttgaaaagggcaaatattttacctgtataagactgaaaattcattttcacatctgtttctattgccatcttgtattatttgcagaatttactttttgggttcctttggataaagcaagcactggccttgttataaaatgagggttatctcaggtgaattacagttcttcagataaccagtttcaagtacaaatgaggacaagaatggctgaaaactggtgcaccacacaactgggtttgccttttgtttgagagtgaaaagagctaaagaaatagggatggtaggtgccatgctacgtggtttatattaggtgtcagtaaaaaaagaactgagttgtatatatgggaaacttc

SEQ ID NO: 220684 - DNA, 489 bp, Homo sapiens
taaaagaaccccatctgaaaatgtttagatttcctgtgactgtcccgtgaagagggagataatctgtgttcacggaactaagaggagagggagagacttggttcaggtccaggaggccaagagtggagagaaaaaggaggacaacatgagagctattcagagaaagctgtgacatttttatggatgaaatagaaacaaataggagtttgtttctttgcacttcagtgatgtcttcttgtttgtatttttggacaacactcaagccatgtggaggctctggcctcgttctagtagcagtggtttgtggtctttggaggctctttggcctgggaccgggcgcctttggttctcatctcccttgagttggcttctaccaggatgtgtgatcctttggaactctctcttcctccctcggagcttccatagcttatctcaaggtggaaataaaacctcctgctgggcctgcctcacagagaaataatgggtatg

SEQ ID NO: 220685 - DNA, 641 bp, Homo sapiens
ctggaattttccatttaatatttttggaccacagctgatggacagtaactaaaactagagaaaatgaaactacagataaggggggcggggggactactgtattctaattatcttttttgcctacctaggggttccatattttgatgcagtttagttggatatcaggcaactacacatgggtagacaaagaaatgaacacctttgcacctgaacagcaacagctaaggggacacacacagagggaaccactgaattctaaccttggctgaaacttaattgggtgtggattggggagaagatttctgggtgtattgtgtgtgctgggagtaatctatcaagtattgattgggttcaagtgtaggtgctgaggagttaccctcagcttctccattcccctaaaaattctctaggctgaaatagcctttctaggcattcactcaagtaaggtggagaaactgacccatgtaaccgggaaatgactacaaccaggaggagacactgaggctaatgtgttgcctataaagtctcatcctcaagttgatgctatccaagaacaaataacagaacccgtgcgggacagggaggcttcctgaccagaggaccagcagcagtggaaaaaggcagccggggaaatgtacccc

SEQ ID NO: 220686 - DNA, 433 bp, Homo sapiens
tgcggtggctcatgcctgtaatcccagcactttgggaagccgaggtgggcagatcacctgaggtcaggagttcgagaccagcctgaccaagatggagaaaccctgtctctattaaaaatacaaaattagccgagcatggcggcgcatgcctgtaatcccagctactcaggaggctgaggcaggagaatcgcttgaacctgcgaggcggaggttgcggtgagccgagatagcgccaatgcactccagcctaggcaacaagagtgaaactccatctcaaaaacaaataaataaataaataaacaaataaatgaaaagaaaagagatttattactccatccaaaacagttaaagttcaaaaggctgacataagcttcaggttcatgagccatttatttctggattttcgtaacctttctttaaaagtcttatacta

SEQ ID NO: 220687 - DNA, 498 bp, Homo sapiens
gtggaacctgtgttgaaatgatgcatgtggttattgatgaagttgtagatgtgagagctggttctgctcatgtctgactaacacagaggcttgtgataattgtcccttctttctcccaggccactgaaatttgtcatctatgaatgaacagactaaaacagatgtcttaatgattttcagatctaatgttctgtaatgctgtgaaatcaataatgtgagatgcaacataacatagtggatgggagcacgtgctcctgatccagatgctttaccacatactgtctgtatgaccttaggcagggaacttagccttttcgtgtcttagtttcctcactgtaaactgaagataatagtacctacctcatgttgtaaagaggaatacgcgagttaaatatttgtaaatgatttgagtacttgtgtctggcacatagtaatcattataagtgctttaaatgagtaagtacaattaaaatacagattgctcccaatttaaaatga

SEQ ID NO: 220688 - DNA, 470 bp, Homo sapiens
actctggtttaggagggtgtcccaatggggcatggattggacaatgctctccagcacttccatccaaaggatctagggcttcactcaggcagcgcggtgggaaggggagactaggatcagcgtgaaagatgctcattaaagaagacaagtgctgtggagagtcagaggaaatgtgatgattttgtctaaaacgcatctgggctttcctggagcctctccctgccggctgctgggtagggagatttccttttactcaacaacacacaggacccctatgctgtcctgggaagccaagttttagggcctcctgcctcctggctactctgcagaggaccaagctcactgtggcagagccccctcagagcccctgcccacggggaagttgggtgggacccctcccgcccttctcactcctgtccttcagctggagcctgcagggcacacacatggcgccattcattctggtatct

SEQ ID NO: 220689 - DNA, 356 bp, Homo sapiens
catgccatggggagagtatttggaaggaataagtagtagggacaaacatggctgggatactcaggggattttgttggttttgactttatgtttccttaaatccaaagttaaaatagtttaattgcaatcatcactgactaatccattaaggattttaaagaaaataataccacgtgactcctaaagacccttttgtttgccatttctagttttgaaaggttttaaccatgatttctttttcaagaaacatttcaattgtattttttagtatttaaccaaagaacatagagtgattcttcctcaagaggaaattattatagaagacctatttatatatatatatatcatattcaact

SEQ ID NO: 220690 - DNA, 429 bp, Homo sapiens
gatgatgtagatttcatgaagttttgggggtagactgaggaaagactcctatccactcaaatcagcaaaacttttccctaaaccctctttcactaggatgtcctgattatttttttacgcaaacctaaacagttttgagagtaaaagaagaaactgttaataacgacatcaggactttgggagaccgaggcaggcagaccacctgaggtcaggagttcaagaccagcctggccaacatggcaaaaccttgtttctactaaaaatacaaaaattagccgagcatggtggcacgagcctgtagtcccagctactcaggaggctgaggcaggaaaatcgcgtgaacccaggaggtggaggttgcagtgagccaagatcgcaccactgcactccagcctgggcaacagagtaagactccgtctccaaaaaaaa

SEQ ID NO: 220691 - DNA, 523 bp, Homo sapiens
gctgtcttcctggctccattcctctcattccttgcagagccagggaggctggaaattatagtagctggttcactaggactctgtgaagtcaagccatgggccctaactctgcccagaggcattgccctggcctctgaagcatctggcagtctgcttgatctgctacccattttccttctagggcctggagcctcccatacctttggaagttgtagctccaccccttagctgtgaaaccctaggcatctaacatctgtttctcagtttccctgtttgtgaaataataatagtgcatgtttctcagggtgctgtgatgattaaataaggtgctgtaaaaagcacttagcacgtagcctggcccatagtacgtgctagtaaacgggagccatggtgatgccaaggactgttacccatctccaggccaccccatcctagcaatagcctgttagctttggtgggatttggagcctgtggccagcaagtgtgagccttgtctttggccttcctgctactgttgtctggc

SEQ ID NO: 220692 - DNA, 414 bp, Homo sapiens
aggtagctataaactgttgaaggtgggagaggtcaacaaaatgaaggtttgagccttcttctactctggggccccccacctctgagtcccagcacttccccccagctccaagccaggttgagggggggcaggggggcaagggggcccaaggcagctgcaggggctgtgttagtaaacactttcctgggttcccattttctttacaccccccacccttctctactccctgatgccccgttatacactcccacccccagcatccccttttctgtggcctgcacaatgagctcattgtcccgggtgtgatttgaataagggatcggtgggcctgttcccagcattgtccaaggggctgggaaaaaccccagcgcaggcaggaggaccagaccagacagagacagatgcctaaattag

SEQ ID NO: 220693 - DNA, 202 bp, Homo sapiens
ctgggcagaagcacccatgcatgacgaagctcttgggttagggtccagtctgcctggagctgaggatgcttgtaggagaacagtaggcactgaggccagagatcagaaaggacttcctatgttgcgataaggccagctcctgcctctcctaagaagtactgggtatggctgggcgtggtggctcatgcctgtaatcccagca

SEQ ID NO: 220694 - DNA, 1066 bp, Homo sapiens
tggcagccaagcgcggtggctcacacgtgtaatctcagcactttgggaggccgaggtgggcaaatcctttgcttgaggtcaggagttcgagaccagcccggccaacatggtgaaaccccgtctctactaaaaaatacaaaaattagctaggcgtggtggcgggcacccgtaatcccagctactcgggaggctgaggtaggagaatcgcttgattctcgcttgattatcgcttccgccaggaggtggaagttgcagtgagccaagattgtgccactgcactctagcctgggcgacggtgcaaaaactccgtctcaaaaagaaagaaagaaagaaagaaatccccactggctccccagggctctaagaactcaagccaaagtcctctccgccgcccaaagacctggggctggggatctgactcttccccacctctctgatctcccctactccacctcctttccggcaacattggacccttgctgctcttctaacttgccagcaagcctccactcactcggagcctctgtctggatccttcttgcactcaggcatcagctgggtcattcccatctccaagaggcctccccggcatcttccctctcccaggcactttgaaggacatggaacttgctctgggacatttccttgttcaggagctgatcagtcactgcgagcctcgggttcagtggagcatcagctccaccaggacaaagatagttttctgtcttgttcacagctgtcttctcagagcgaaaaacagggccttggcctggcgcggtggctcatgcctgtaatcccagcactttgggaggctgaggcaggaggatggtttaagcccaggaggtcaaggctgcagtgagctatggtcccatcactgcactccagacgaggcaacagagcgagaccctgttttgctttgttttgttttgagacagtttcgctcttgttgcccaggctggagtgcagtggtgcaatcttggcttatggcaatccccacctcctgggttcaaacgattctcctgcctcagcctcccaagtagctggaattacaggaatgtgccaccac

SEQ ID NO: 220695 - DNA, 366 bp, Homo sapiens
tggcagccaagcgcggtggctcacacgtgtaatctcagcactttgggaggccgaggtgggcaaatcctttgcttgaggtcaggagttcgagaccagcccggccaacatggtgaaaccccgtctctactaaaaaatacaaaaattagctaggcgtggtggcgggcacccgtaatcccagctactcgggaggctgaggtaggagaatcgcttgattctcgcttgattatcgcttccgccaggaggtggaagttgcagtgagccaagattgtgccactgcactctagcctgggcgacggtgcaaaaactccgtctcaaaaagaaagaaagaaaagtcaacacgcccgcgaatttagtagtagtaggcgg

SEQ ID NO: 220696 - DNA, 531 bp, Homo sapiens
ccatgctgaggaaggccatgcaacatggaacagccatgcaaaagcactgcaatcaacaatcctacctgaactaagccttcatgtcatttcagggcagctaccaaacttgtgagtgaaaagcctccagataagttaccaatgaaaagtccatttttcacatggaataggaagcaagaccatgtgctaggaataaggaaattggaattggatagaggacctgataaaagtgggaacgatttagaagagcatctgtggtaaatgacaagaagactgcagatagttaaggaatcatcaagccatatagagagcctggagcaaactggaaacaacaatctcccaaacagtctctaggctatacattaactaagataaaggtaggcctagtggtgcatacctgtaatcccagcactttgtgaggctaaaggaggaagacgacttaagcccaagagtttcagaccagcctgggcaacatagtgagatcctgtctctgccaaaaataaaaaattagtcaagcatggtggcacataccta

SEQ ID NO: 220697 - DNA, 289 bp, Homo sapiens
tacatatcgaatcgagctcgtacccaggtcttttcccctcaaattagaagaaaaagataatagagaattgttctattttcttacccctagtgttcataatgtgcagattacatacagtagaactgtattcagtttacctgagaagatagaattcatcaacccaattccatgattagggtatgtgtatggggttctggctgtctttaggtgggtgctagaactggtaactaagttgaagctaaattgctttttagttcattgatttagatagtacattcagctgcgttca

SEQ ID NO: 220698 - DNA, 508 bp, Homo sapiens
cagaaaaaaaaaaaaaagaaaaaaaaatcacgaggcaaagaacagtatactttcattttagtcaacagtgccaacttttcgtagttatttgagaactggtcacatacgtatattgtgtcaacaaaatagtattgccttaactttctggaaagacaagtcttaggataattgaaactcgaggggaaaattggcgttgttttcaaaggttaaaaaatcagattagaaattgtggccctggaccaactttaaatttcccctcaaattagaagaaaaagataatagagaattgttctattttcttacccctagtgttcataatgtgcagattacatacagtagaactgtattcagtttacctgagaagatagaattcatcaacccaattccatgattagggtatgtgtatggggttctggctgtctttaggtgggtgctagaactggtaactaagttgaagctaaattgctttttagttcattgatttagatagtacattcagctgcgttca

SEQ ID NO: 220699 - DNA, 437 bp, Homo sapiens
tatttttaattattatggatacataatagctgtataaatgtatgggatacatgtgatgttttgatacaggcacatagtgtgtaataattgtatccaggtaattggtgtattcaccacctcgagcatttattatttctgttagaaacattccaattcaattttcagttatttttaattatacaagaaaaatttgggaggctgaggtggcaggatcacttgaggccaggtgttcaaaaccagcctgggcaacatagcaagaccccgtctttacaaaaaaaattttaaaaatgagctgggtgaggtggtgcacacctgtagtcctagctactcaggagactgaggcaggaagatcacctgagctcagaatttgaggctgcagtgagctatgattgtgccactgcactctggcatgagcaacagagtaagacactatctct

SEQ ID NO: 220700 - DNA, 495 bp, Homo sapiens
tctactcactatttggaatagtgtttctttggggatattttaatattactaattaatattacttatttgttattatttattactttaatattactttaatattacttatttagtagtgttattacttaaacactatttggaatagtgtttctttggggatattttaatattacttattaacctattagactttatgtttttgttttgaaaaatttttgcttctcttaatgattgaattcccacttaaatttagaatttggacaggttctctgtattataattccagcctatccctttagtctcatattcaaccacttccctgtacttctgccttattagactgcttggtattttcagactatggtccatactttcctttattgactcctttcctcttgttggaatctcacttatgttgaaggccattataaatgcttcctcctctatgtctttcgtgagctctctacccaaattggtcgttttgcacttctcttg

SEQ ID NO: 220701 - DNA, 430 bp, Homo sapiens
gcacgagatttgacttacatttcttactacgaacatacaacaaaactacaataagtatatcaaagataaatacatcggtgaaacattaaagaaacaaactcaagtaatatgtagatacatagttatatgttaaaatcatgggtaaaagcccaggcacagtggctcatgcctgtaatcctagcactttaggaggccaaggcaggcagatcacttgaggtcaagagtttgagaccagcctggccaacatggtgaaactccctctttactaaagacacaaaaattagccgggggtggtggtgcgagcctgtaatcccagctacttgggaggctgaggcaggagaatcgcttgaactcaggaggcggaggttgcagtgagctgagatcgcaccactacactccagcctgggcgacagagtgagaacctgtctta

SEQ ID NO: 220702 - DNA, 357 bp, Homo sapiens
aattgccaaatggctctaaaataactatgtattctgacctcttcatcaattctctcctgggcaatatttccataagaaaacgggaagaatggtgctcatgcctaggagacctttttatttctccaagttatttgctctcactgtaccttgcaaaggcaaggccctgttttactgacttcaccttcctgtcttcaattttcacatcagatctaagggatacctggttcacacatgttaaaatcccagctcatttttcacgtcagtttattgacatcagtttctgtcagtattgttgggagcaggcaagagttaaatatttaatacctttctctctctactcttacactcacaagctaa

SEQ ID NO: 220703 - DNA, 480 bp, Homo sapiens
gaaggggctgggatgtctactgacatgtgtgtttttcttggtcatcaggatgcaatatcagcttaggcccaggagtgctgagagcagcctctttgggaactgggttgagcacagccagtgctctcagcagccaggcaacaaattggaaagcctcagtctgtgcctgataaatgcccgtgggtgggtttcccctcccctcccggcatcaggctgataactggcgctctgcccctccggcttcccgagacactgctgtttacgtgatgcatgattcacactcatttattgccagagagtacgatgctttgccttggtactttattgagagcacaataaaaataaagatgagctactaataaaatgtcaaaagaaaatgtcaattagtattaccaaaaagaaaaaaaaaagagaggctgatgttattgtacatcctctcagtgaattccctctaattagtcaaataaatatgcagtcctccca

SEQ ID NO: 220704 - DNA, 508 bp, Homo sapiens
ggggaaatgctccatggctctcaacaagggtgagataatactcttagctttatttctgatactgctctttgacatctgttggctatttttcaaacttcagcacaccacatcagtatcttcaagggaaacactcatggtgacgtaacaaaccccttccttcactgttgcatcttcaccaatggctcagagcctaggtaatgtttttctcaatgcattatccagcttcaacactgctatgggactttgggcaaatcatctaagctctgttatgtctcggttttctcatctctaaagtgaagataacagaactttatacttcatagggttgagtgtttagcccaccaagtgatcaataaaggttggctgtctttaggttaatgtcccataattatcccaattttggtaaggaagaattctcctaagaaatcttttcaaaggcatatttaagatgtaataaatcatgttactgacttgcaaacatatttatcctttcaaagaaggcttccct

SEQ ID NO: 220705 - DNA, 427 bp, Homo sapiens
cctctgatgtattgattaatgtattaatacctctgatgtattgatgcattgattgcttaagttgtttctcaggaacttagggtcagctcttgtccggcttgaaccagttgagaccacttggcctgtgcaaatgcccaagtggtggccttttgatgtcatagagccaaaaactcctccctcagatcatgctaacaccaccattttctgaatatgtgtcttatgaagagccatgaaccctgactgtttggcagatcacagaccacctcatttttcccactgttgttcacctttccctatgtcttaggccaatccacttctttaccccatatatatccttcaaccctatctttggagaggtggatttgagagctattctctcatctccatactggattgccctgtgaatcaatatattctatactgcaaa

SEQ ID NO: 220706 - DNA, 480 bp, Homo sapiens
gttcactgttgcgtgccagtcacggagaacaatgcctagcattgaggcactcggccagtatttttttagatgcatgagcttaattttgcaaggcttgctgggacctctgccctagtttaactgtgcacatttgaaagcatcgggtgagcttggcttcttgttgtaaaaccagggatttatgttgatgaagagttcgatcagggtagactcatactctaaagcatgttttcttgtgaatagagatgtttacaaagcacaaagcagtgaatttgctaatagttctttttactggcatcagctagggttctgaatttagctgaagcttatacttaccatgccatggtggaggttttcatttcctaatatgtacatgcatttgtctaaaagtaattagtttgtcttcagttatgagccacaagaggtcaggaccaccactatggcacctctccagaaaggggcgtgcctgataagcacaaaaaa

SEQ ID NO: 220707 - DNA, 353 bp, Homo sapiens
agaaagtactttgtaagccacgtacccccctttttaaaaaaaataatgccagagacagaaagcaaagtggacccacttactgagccccgtggccatgccctgtggcaggcttttgtgtgtgtccttgagaaggaagtgggattacccccctcttacaacaaagggaggcccagagaggagggcgcgggtccctcctgggtcttcccatgcgctgctgtgccctctctgggctgagtgccccaaacagtggcgcggatagtccgtatcccttggtttccctccaggcatccctcctaggtcctgtccccagtgggattgacctgcatttcctgttccgagtctttgtcatacta

SEQ ID NO: 220708 - DNA, 500 bp, Homo sapiens
tttttctttaattggtgacacatgctgtttttggtaacaaaatcatgtaaccactcccttaataagtgcactctccataatttgactttattttaaagagcaggtttttagttccagaaaggtacaaatagtagtttaatagtcttctatttaggttatgtacttttttttcagactgagtttcgctcttgttgcccaggctggagtgcagtggcatgatcttagctcactgcaacctccgccttccggtttcaagcgattctcatgcctcagcctcccgagtagttgggattacaggcgcccgtcaccacacccggctaatttttgtatttttagtagagacggggtttcaccatgttggctaggctgatctcgaactcctgaccttgtgatccacccgcctcagccttgcaaagtgctgggattacaggtgtgagccactgtgcccggcctgggttatgtattttaacagtgaagtctgcttgctcgcttgggctatg

SEQ ID NO: 220709 - DNA, 451 bp, Homo sapiens
gtgacataaaactactcttaacaaactcaaatttattaattaaaaaaagactaatggcttgataagatgttcacagtgttaagtaaataaaaaaagacgctagaattctatttcttgctaaaatatatatatacatgtatatataatacatacacaaatatgatatgtggatatagcattgtattaatgaatataaaactaaaacaaagctctccagcactgtatatacagaagtgatctgtagatgacaggatcgaatccctgcgtgatttgtattctttgtgctcgtctctatttttcactgttccacaaagaacatgtattatctctgtaacaagaaaaagaagaaaagaaaactgcattatatcattcaaaaagttgtctagtggtcacaaagacactattgaagatgcatgttgaaagtttgaataaagttggtttttaaaatgca

SEQ ID NO: 220710 - DNA, 506 bp, Homo sapiens
  misc_feature (25)..(25): n is a, c, g, or t
gaacgaaactcagagggtagggtgnaggatgtcaacagagaagttgacagagcagccacagaagctgaaatctcagaagtgaatagtgctaagtgggagaacgggaggaggagaaaataagctgcctgacaccagcaagtaagtgcaggtcgccatccttaatttctattttctagattatagaatgtggaatatgtcaactgatgatctagctcttcacagtgttacgtgtctcaaggaaaaaatgcaggtaagcatgttttataaactgtaaaggggggtataatgtcagctgtaaggctgtaatgtcaggctactttacaaccctgtgataattttgacttttgggggaaagaacaattttagggtcagcaaatatgctgatttacctagaagcatgtatttttaataacataccaatgtagtttttagatttagcaaaaagtaattatacttttaattgctattaaaaaattatattattgaccgggcatcacggctcacgc

SEQ ID NO: 220711 - DNA, 532 bp, Homo sapiens
tttctatataagagctgactagagagaaatgatccaacatcccttgtttgactgtaggtcatgagactgtcattccagagagggccctgccccacgtccagagaagaaaatgctcagagacgaagacaaatctagacagaccttgctgggttcccactcagtctattcacattagatcaagccctttgtgtccaatcctttttttagaggactgttcatacgttattaaacctaaacataaaaatggacaatttcccccatcgttgggtcttcgttctaaaggttcttatatgtacacatcacataaatttgcataccgtttctcctattaatccatctgtctcatgtcagtgacttctcagcaaacctttaggggccaaggggccccacactctccagcggcaggcacaatgggcctggggtgcagttgtggacactcggaccctccttggagctggtttagctgtgctgtgtgcttgtgggaatggattgccatgatttctgggctctaataaattgtgcttcaatcgac

SEQ ID NO: 220712 - DNA, 559 bp, Homo sapiens
cagaagagcatcttcgctgatcactggtggatgtttggtgtgattgttagaaccgggatggggggtgggtggagttcgaatttggaagtgttaatgcagtgtttttaaaaactgcaaaaaatcctggagtcagtacgaagtaacttgttttacgattgcacaaatgggatcatgctgtgaaatctttgaagactttttctcatattaacatgtacaaacatagcaaattactttggaagttaggtaacattccatatggctgtgttatttatttaatcaggtcatggcaatgaactggattatttccagcgccttttggttgtttctgttttttggcttttgctttgtcgatgagaacaaggactttgttcacaccatattttccagctaaatttagaaaagtgcttgacacatagcggtgctcctttattgcatcagtgttggcagcagacgcgttcatacttttacttgtgtactagggataaattcttcgaggtaggattgctgggtcgacacaaatgtgcttaaaatggacagttactgccaaattgctctaaag

SEQ ID NO: 220713 - DNA, 571 bp, Homo sapiens
tcagcagactaactgaggaatttgcctttttacagaagctttagaacagcccaagttggagcttccagttcagagacagagtcttctggtatatgtcagttgaaatgtggcaatcatgttttggttttacagatgtaataggtatggtagttccagagatggtttatttatttatggccctgtttactccagagagttcccaaattaggcaagagtattcatatggcttacatagatatatcattgccttcggaagttttaagtcattcttctatgactcagaattttcatctatcttttcttgttctgacagggaaaaaaaaaaactgcagtgctgaaaatgcaaccaattcaacattgaagtctgtaactactctcattctacggactcaaatttggaagctgggtaggggggtcagagaaaggaggggtggaaacagacacgaacacaattagttctaattcatgataacaaccatagtcaaatattttagtaacacagcaaagggagagagcttccctttgctgagcagccggggaagagcttcatgaagagagtgacatctgcact

SEQ ID NO: 220714 - DNA, 541 bp, Homo sapiens
ggcctctcaaagtgctgggattacaggcgtgagccaccgcacccagcctgaaatggtaatatttaagatgagcagttaagactccagttttacagcattggccaagtgtctaattataagcttcctggtccaggtttgagtctatgatagttcaaatagatatatggaagtagaatgaaaatattatgcttactataattaagatagtagtaatatcaaggaagaatccacatgttcagaactctttcaacaaactttttaacacattgagatattcttagttatttagtcatctttggtctacaccggaggtcctcaaccctcaggctacagaccagtacctgtgtgtggcctgttaggaaccaggccacacagcaggaggtgagcagccagtgagggagcaaagcttcatctgtatttatagccactccccgtcactcacattaccgcctgagctctgtctctgtcagatcagtggtggccttagattctcataggactgcgaaccctattgtgaactccacatgtgaaggatgtagat

SEQ ID NO: 220715 - DNA, 553 bp, Homo sapiens
tccctaggtccataagaggattgcctaggttgtctttcaggagtttttatagttttgggttttacatctaagtctaatccatcttgagttgatttttatatatggtgtaagaaagtggtccagtttcgatcttctgcatatggctagccagttattccagcaacaaaggttattttaattgagaaaaggaaaatatttagatcaaaccttattaaagtgactgactctggataactgagagactttatatgaggctttttggctgtatttgtttgtaaacatatttcagctgaacatgtgtgctgtgattttgaaaacactgactactctatagtacatttgatttagcagagattattagctttcttcctagactgccctgcaaaatgaaggaactcaatttattaggccagctctggggtttcttcctactcccaaatcccaggtctacactttctaggtttacccagagaaactgctgagtggggattccctgcatttcttctatttactagctcccaagtgatgatcatgtattattaaggactcattg

SEQ ID NO: 220716 - DNA, 389 bp, Homo sapiens
agtttgtctcaaaaaaaaaaggaaggcgggcggctgtctcaggacacctttttttgtggtcagggctctggcaggctgaatgtgtgggtggggtggcctcccaggtgtaatctgagatgcacccagaaggctgccctgcctggaaatagccaggctgaaacctgaagtttagagggccattcttgtggtctaaaaactttcgggaaagattccacattccccaggaaggggggcgtcatagccaatcattcatttctctacctgccttagtttcgtcagataagaagcttgactgcaaacttcagaaatgcaaagactgtgtctgtcttcactgtgtagacatggggcctggtgccaagtaggttgaaataaacatctgttgaataaaa

SEQ ID NO: 220717 - DNA, 315 bp, Homo sapiens
ggagggagacctggtgccctgtctgtctagaatctgcagctccctgctcttctgttgaattctccttggtcaccccttttggatacattctgtttgctgctgagaccctgactgctactgagaatgtctcaacaatgaagggggaggctggatgcggtggcttatgcctgtaattccagcacttggggtgggcaagtttcgtcagataagaagcttgactgcaaacttcagaaatgcaaagactgtgtctgtcttcactgtgtagacatggggcctggtgccaagtaggttgaaataaacatctgttgaataaaa

SEQ ID NO: 220718 - DNA, 357 bp, Homo sapiens
gcacgaggatggagctaaaagccacagcacaagaacttcatgatgcacacacaagcttcaatagctgattcaatggccaggcatggtggcacacgcctgtaatcccagcactttgtgaggccaaggcgggcggatcacctgaggtcgagagttcgagaccagcctgaccaacatggagaaaccccatctctactaaaaatacaaaattagccgggcgtgttggcacatgcctgtaatcccagctactagggaggctgaggcaggagaattgcttgaacccaggaggcggaggttgcagggagccaagatcacaccattgcactccagcctgggcaacaagagcgaaactccatctta

SEQ ID NO: 220719 - DNA, 485 bp, Homo sapiens
aaagaatcacccagaaagtcacctgctggttccctttgacttcttgtgattactgaaacatcatccagtatgtggagtactgtggtaatttccatgacaactgatcctgattttccagataaagagaggaagctagtaagtgttaggaactcaaaaagcgtagtaagctaagttcttgtgatgctaagtagaatttttagctgaaaggacctttcagcagcaactgcctgattaaacctcttcctcttataggtctggagaggttaagcaacttgcctaagggattgctgtgtttgtggaataaactctggatcctcagcttagtatctctctgtgcctcctattctgcatgacttttttcattatatctcggctgaactgtgagctctatgaaggcggaaaccatgtctgtcttgttgatgagtgttttcccagagcctggcataggatctaagtattttttgagtgaatgaataaactgggtg

SEQ ID NO: 220720 - DNA, 270 bp, Homo sapiens
tatcctaattttccccactcaattcgatttttgagatgaactggcagctgcctattaccttttactttttcctctctaagtgatacttttagtaagcaatttacagctacctccaaggtgaatttgtgtgtaacttaattacattcacttataccctcattataattacagtagcttaaaatccccatctgtggaacaaaagatgtttccatttatcatgtttctattgtgtataagctgtccttaatattaaacaccacaatactctca

SEQ ID NO: 220721 - DNA, 229 bp, Homo sapiens
aacgccccgacagtgttctgaactgggttgaacacacaaaggatgctacaattttccacttgtatacaggtccctccaagacttcgcttctcaccatgattctgacattgatatgaaaacacacaagatttcacttctcaccatgattctgacactgatatgatcactgaatgaccgttttcagcaattcgggcctataaaagtgtgaaatagattttttttgaaagtc

SEQ ID NO: 220722 - DNA, 474 bp, Homo sapiens
aatcttaaaattcatatggaatcacaagttaccccaaacagtcaaagcaatcttaagtaaaaataatgaaacttggttgcatcacactgcctgatctcaaaatacattacaaagttgtagtgatcaaaacagcttggtactggcataaaaatcagcacacaaatggaacagaaccaaaagcccagaaataaatccatgcacttatggtcaataaatctttgacaaaagtaccaagaacacaaaatgggaaacgaacagtctcttcagtaaatgatgttggaaaaacttggtatccacatgcagaagaatgaaattggacccttatctcacactatatacaaaaatcaactcaaaatggattaacaacttacagaacacctaaaactgtaaaagtactagaagaaaatataggggaaaactctatgacattgatctgggcaatgattttttgaatctgaccccaaaatcacagac

SEQ ID NO: 220723 - DNA, 421 bp, Homo sapiens
tgtgttctcattgttcaactcccacttatgagtgagaacatgcggtgtttggttttctgttcttgtgttagtttgttgagcaagagggacatttttaaagagaaaagtaaaccatgagtttatattggtatttccaactcaaatttaagataacaagatttttacttaaactcctttattttagagtgtatctcctctcatatgcttaatattagcaaaattattcattagcttcttcctacaatatacttacagaattttacaatgtcaataacaatactatcaccaataaaactgctgaatatagttttatatttcttttgcagttacttttgcccttagaatatgggtcccattggaaatatacaaatgttttaaagtcactataagtaactgctttgttttccaattgtgtgtttat

SEQ ID NO: 220724 - DNA, 512 bp, Homo sapiens
  misc_feature (27)..(27): n is a, c, g, or t
  misc_feature (109)..(109): n is a, c, g, or t
  misc_feature (120)..(120): n is a, c, g, or t
  misc_feature (132)..(132): n is a, c, g, or t
  misc_feature (151)..(151): n is a, c, g, or t
  misc_feature (156)..(156): n is a, c, g, or t
  misc_feature (161)..(161): n is a, c, g, or t
  misc_feature (168)..(168): n is a, c, g, or t
tacaatgtcaagtgttcagatcctgtngccattgtgtatttttaaagtgcgctgaatttcgttcttttattgaccgaactacgaactgcagaaaaacaacttttctgtnggaactttacntaagattttctnaaagttccacactccggcntaagnatgcntgccttnagcattttgggcatagttctgttgatacagtgaactgtgttattgtttatcttctccagtttcctctgagctttgcagattagagtccttgcctgattatttttgtatagtttctggcacgtaatagtcgctcaaaaagtgttggagcatcgaagtacagatatttatcagcaggtttctcaagaaaaacaaagagtgtgttttggagcagaggtcgaaaggtgaggccgggagcagtgactcacacctgtaatcccagcgctttgggaggctgcggctggaggatccctggagcccaggagttcgcgaccagcctgggcaacatactgaggccctgtctctac

SEQ ID NO: 220725 - DNA, 445 bp, Homo sapiens
agatacagcctggtaattataaatatgagggaaatgaatgcagtgtggtggcaggcacctgtaatcccagctattcgggaagctgaggcaggtgaattgcttgaacccaggaggtggaggttgcagtgagccaagatcatgccagtacactccagcctgggtgacagaatgagactccatctaaaaaaataaataaaaagtttttaagggaatttaaagcatagaaccaggagactgaagtgagagtttatttaagaacaccaaataaaacaaagtacagatgatccctgatttacaatggtgctacctttgattttttggcgtcacaatagatttattgggatgtaatcccttcacaagtcaaggaatatttatatacattatagagggaaaataacataagtctgctatgttaacagttgcatcccattataaaaaatatatt

SEQ ID NO: 220726 - DNA, 353 bp, Homo sapiens
caaagtatttatctttttttttcattgctgtatccccatatccccagtgcctagaacagtgcctggtatataataagcactcaaatattcattgaataagtaaatatggaaagaaataaaggaggaaagaaagaaatacccagtaatacccagcctggccaatgtagcaagactccatgtctacaaaaaatacaaaataaaaaaactagccaggcatcatggtggtgcatgcctacagtcctagctactaaggaggctgaagtgggaggattacctgagcctagaaagtcgaggctgcagtgagcacggtcgcattgctgaactccagcctggatgagagagcaagacctgtc

SEQ ID NO: 220727 - DNA, 518 bp, Homo sapiens
aattatgagcagctatatttgtagctctgctaagggaatgtagacatgtctacatatgaatacagccctcacctgtatagacactaaaatgtaattcaggtatttcatttcattctctcatctcctcacttcaattttaggtgagaataccaattcaattctccatacatcaaatttccttctcctgaaaaatattataggatttgtggacagaattacttttatgtaaagtcttcatgataactgaattggactacgttgtgtttgcacccatataaatctaaacaagcctgagagcagctttatctctaactttctgtctgactttctcctgatggcagcatgacggggctggtcagtgatttccgggttctgtgtgtggtatggagggaaaacatcaaaaagagggcagagcacattccctcccagatttttccccaataaatgatcaagtaacttttcctgatgatatgaagacagaggataaaataaagattgattgtttttatactgttaaa

SEQ ID NO: 220728 - DNA, 373 bp, Homo sapiens
ctttgtccatcaaatgcaaggctactgctcactgatctatctctccgaaggttgtaataatattagaaaccacagctcatctttcattgacttttgagcctgactcagaaacaggagtataattattaatggctaaactactttatcttatcttgggagacaaatttcagtcatattagatatcaaaatattttcagggcacacatgcaagataatatgtaaataacaccaattaaacatttagtttcattctatagattttggctacaggagttgcccattccatggttcaagaaaattgctattaatagagctttcacatactgaaacctgtttttctactgactttcataatgaaattagagatgtttct

SEQ ID NO: 220729 - DNA, 528 bp, Homo sapiens
aacatgtcgaggctgttgctcaggatttcttactcctctcactgcacttccgtaaaactctccaagtgaggtttcaggaacacgcctttagaaggatggaaagaggtgttttgcttgttatagctaaaataaagactaggaaatccggggtgaaagaatgttaattgggtttattggtttagttatgtggtttttttttttttttgagacagggtcttcctttgctgtccaggctgtagtgcagtggtgccatcatggctcgctgcagcctccaactcctgagctcaagtgatcctcctgcttcagcctcccatgttgctgggaccacaggcatacaccaccatgcctggctaattttttaaagagatggggtcttgttatgttgcccatgctaatctcgaactcctgggctcaagcaatcctcccgtctcagcctcccaaagcactgggatcacaggtgtgagccaccacacccagccaagagcagttcttttttttttttggagacaggattttgctcttgttgcc

SEQ ID NO: 220730 - DNA, 530 bp, Homo sapiens
aatgtgcctttagtttggtttaactagagcatagatatgtgaaggtataagttcaggaaagagttgatagagtctaaattttgatatgagcataattttgaattaaggaggatgtattgggggctgggagcatatgattaccatatgcccaaagataacatgggaattcttcctcaaatttatccgttagaaaagaggggaataaccatgtattcagacctttatcgtactctcatattacagggttttcactgtcctttactttgaacaacaacaaaccaaaaaaggttaatgaaataaaatgaaacaggtgagaacaaatgtgcctgcaaagacttcagctcatgtagttagaaatgttcattgagaacatcagacagaatatttttaaggaataaacataaatttagtccttattctcagcaatatgacttcactattctgaggactgtatgtgattttaaacaactggcttaaagatctctttaagatgtcaatataagggttacatgaataaaaacctataagag

SEQ ID NO: 220731 - DNA, 676 bp, Homo sapiens
tattcaaaattgagaaaattgggtggttataggattaattaaagaagactttgttttctcacattgtcagtgtgttgactttcaaccttagacttactcccatggccacaagatggctacagagtctcgaagtattgtgtcctcacattataatacatagaggcaagcctatgaaagtggtccctgtctgtgtgtgcgtgtgtgtgtgtgtgtgtgtgtgttttaagaataaggaatactttcccagaagctcccctgtaggcttccatacatgtcttatccagaatcagttcatgtcgccggtagggtctaccatgataatgatagacaaacacatttgaaagaaactaatggatttaaccaggttatttatatggaatttacattgcagtgaaacttcattgctatgacttggactattatttactaaataattactattgtatttatattaaggaatactgatatttaccatttatgtatacagagttcctcaatttaaaatcacatccacttgagtatgtgtgtgtgtgtctgtacatttgcatgtataaaagaaaaacaaaatgtaaacatcatttcaaggtgaattaaattacttttaatttctcttcccattccaatagtcagtatttctaaaaatcaaagatacaaagataaaaatgctttgtatttg

SEQ ID NO: 220732 - DNA, 516 bp, Homo sapiens
gagaagagatgaagggcaaaggtgagattctgcaaatccaaacgggaaagaggaacgagaggaggggacggagaaggtggggacattctattctacgcttctcaaattaagttcaaaataaaagggaaggtgtggcttgagtcgctcttcaaaggggaggaggagaaggaagaaagtccatctttttatacgaaattcaaaaaagcattttacattttaaatattcacaataaagtaacttctagtcagtgtaactcacgatttatttacaaagagccttcaacaggttactttagttgcacagcagtgtgtggggggggaaacgtccctcttcccatctgtggcagcgcccgcccgcttcgctccgaggtcccccatgcggtgagcgtgaacccttccacagcacctctcggcgccccctaccccgccgcccgcgggggcaaaatctgggggcgagggggacccgggcgctgaggccgctgcccgcctatggggacgcggctgggaccgtggccc

SEQ ID NO: 220733 - DNA, 366 bp, Homo sapiens
gatataaaggcatcgatacgactttttcattttcttattatttcttttccctggctaggtgagttggctgttttatattggcactaagagtttgataccactactagaatagtcaagtatttgacctggccatgagtaaaagatgtttgattgacagatgagtctatctgtgtcaaacagctttaccttgagaaaaatcacaactttgaaagcagtaacacttcaaaagaatattgaagattgtggccactttcccccacctctccccaaaatctatcttcattcaagttcattataagcagctcctttgggtaatttgggttgcgtgctttctccaccccttctgtcgtcttctcgcagagcgtc

SEQ ID NO: 220734 - DNA, 524 bp, Homo sapiens
acaacaattagctgggcatcgtggcacacacctgtagtcccagctacttgggtagccgaggtgggaggatggtgcaacctccacctcctgggttcaagcatttctcctgtctctgcctcccaagtagctgggattataggcacatgccaccatgcctggctagttttttgtatttttagtagggacagggtttcatcatgttgcccaggctggtcttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaaccagagctttgccagtcaattgcatccacctgtatattcctcccacctcctattccctgccccctctctgggacaggtgacccatcctaagtag

SEQ ID NO: 220735 - DNA, 554 bp, Homo sapiens
  misc_feature (4)..(4): n is a, c, g, or t
  misc_feature (31)..(31): n is a, c, g, or t
  misc_feature (45)..(45): n is a, c, g, or t
cagnaatataaggtgaggttgttttcttgcntcctggggttttgntctggttgggcttgtcccaagggagtgctgtaaaattgtgaaaggaaggtggggacagagctttgaggtccttgtagagagaagacaagagctatggaccatagaaccagagactatggagagacggaggagaagggcagggttcagaggtatttctgtatgttttgacataaaataagtgccatggagattacatgcaaaatggcatgcaaatgaggcctggtgccttttggggtatgaatcgtagaaccttgcttttgcaagaaagggaacttggccaggtgcggtggctcacgcctataatcccagcactttgggaggccgaagcaggtggatcacttgaggccaggagttcgagaccagcctggccaacatggtgaaacgccatctctaccaaaaaatacaaaaaaattatctgggcatggtgatgtgtgcctgtaatcccacctacttgggaggctaaggtaggagaattagcctgggcaacagagcaagactctgtctcaaaa

SEQ ID NO: 220736 - DNA, 369 bp, Homo sapiens
tagacgctgccagaattctttggcacaaaactcctctgagtcagagcctaacgctgttagcaagggaagaacagctgcaagggccacacatctgtgagtcttttgagaattttatgatgaataaaaactatccgttacacagactcatacattatatattaacctaacatgtcttcaattgcactgctaaccgtctcttttcatacttttttctaacgacaccccaatcccaacaataaattaaaaaatctgaaactttgactatctagtagcactgcatgccgtttcctagtcgtattcctattccgcctttggagtagccattcccttattcctttactttcttaataaacttggtttcgctttaca

SEQ ID NO: 220737 - DNA, 438 bp, Homo sapiens
cattttgaaaggtcgttatgccaataatggataacatttattaagcgccatgtgtgtcccaagtgctttatgaattgtatcactgaatcttcacaaccctgaagaagggattatcatcatgcctatcctgcggatgaagaaatcaaggcgagaaggttaaacactgtgcccaaggacggataataccataggggacagatctgaacccaggtggtctacttggaaattctacattctgtgtgacattagacctaggaggtctaattttgtgaggaaaacaaaaatatccaatgtacttttcagaaaatctattggggaaatagtgatcaattgcatcatattatacatatcctattgatatcaggggattgtaagtcacggagagcttatgctgcattatgaaaatgtggaataaaataaagcatgaataaaaacact

SEQ ID NO: 220738 - DNA, 366 bp, Homo sapiens
tgcgggggtagagtttaaagattttgaaatgactctacatgtatactggaatttaacaataaagtgagtggctggcagatggtggtgagagacacaactagctggatttcctaggccgactaagaattcctaagcctagctggggaaggtgaccacacccaccttcagactttcacttcctctccaacgtattagagcaagttgtatctccaaagggatctaaggaagttctatgctgtgtccttgggcatctaggctatgaacccagggagtcttgcccgtggtgtccctcccaatttagatatacagctctcgacatgggcagttatgtgggacccgttccccaccatccttgccagggaccca

SEQ ID NO: 220739 - DNA, 581 bp, Homo sapiens
caccatgcctggctaactttttaatttttggaaagcttgggtcttgctcttgcccaggctggcttcaagccatcctcccacctcagcttcccaaaatgttggcagtacagccttttctttcttttttaaatcaaggtaaaacctacacccagtaaagtgcacagatcttaagtgtgcacctcagtgagattttgcacaaacacgtaagtgtgtaaggcaccatccagatctccagcagtcccagaagtctccctctagcccgtccccatggtacctgcctccaaaggttacttggtgttctgatttctatcacaagtttttcctggtgttttgttttgttttgttttattttgtttagagacaaggtcttgtcacccaggctggagtgcagtggtgcagtctcggctcattgtagcctcccaggctcaagcgatcctccctactcctcctgagtagctgggactacaggcatgtgctaccatgcctggctaactttttttctaaagatgagatttcagtttgttgtccaggctggtctcaaacttctggcctcaagtgatccttctgccttggcctcccaa

SEQ ID NO: 220740 - DNA, 384 bp, Homo sapiens
ctcttcctcttacccccaatcaacaacaacaaattagtcatggcaaatgtcctggttcctgctcataatttcatttcagttaacctttttcctaccctgaccttttgactacctgagttgtgtttacctcaagagatctggattctagtactgctttggctgttgtattacctaagtgacttaaatcatataattcctttgaaccttggtttccttatccatgaagttcttcttgaactaaaggatctgagtctggtagacttgcatgttcgtggctcatttggatattagtttaatcccctcccacctaacaaatttcttcctaagttacgacttgcttcatggcagggtcatgttgtctctagttgattgggttgacgtcag

SEQ ID NO: 220741 - DNA, 694 bp, Homo sapiens
tatcaaatagctctagcaccttgtgactccaagtgtggtctgcaaaatggctgcacccccatcacgtgcagctgttagcaatgcagaatctcaggccccgccccagacttgctgagtcagaatctgaattgtacctaggtcctctaggtgactcacatgcacattaaaatacaggaaaaacttctagaattgcacattaaaatcacctgggaacttttacaactacagatgtccacctccaccaattaaatcagaatctttgggggacagggcccagacactgatatttctaaaaagtgtcccaggtaattagtatatttccccaaaatttcctgctcttaaaagtcaccttcgggtgacttgttgaaccaccaggcagcactcctactgaattgtaatcttcagagaggtgataaagatttagattttaaaagcaccccaggtgactcctgtggtcaggcacagttgggtaaaatggctctgccagaatggactggatgggggaccggaaacaaacacaattcggtacatttttattaatactgatgaaaggatcgactgagccaatagagccacctgcaataaagaccataaacaaaggctcacagagaggtgtagttcttcactcctaagcctcatccttttctatattgtaaggcttctacaattacaattcgtccacttttataattga

SEQ ID NO: 220742 - DNA, 1645 bp, Homo sapiens
  misc_feature (927)..(927): n is a, c, g, or t
  misc_feature (1641)..(1643): n is a, c, g, or t
gtttgtgtgctgtgtgctcgtgtgtgtgctgtgtgtgcgtgtgtgctgtgcgtttgtgtgtgctgtgcgtttgtgtgtgtgctgtgtgtgcatgtgtgtgcgtgtgtgtgccgtgcgtttgtgtgctgtgtgtgcatgtgtgtgcgtgtgtgtgctgtgcgtttgtgtgtgtgctgtgtgctcatctgtgtgctgtgtgtgctgtgcgtttgtgtgtgtgctgtgctcgtgtgtgtgctgtgttcatgtttgtaaaattacatatttatatatataagtatttaaaatataatgcaatttatttacatattggatttttctcatttctccacacaatctcttgtctctctgtctctgtctctctctctctctcaggcacacacaaacacacactctcacacacatgcacacacacacactctctctctctctctctcacacatacacacacagagacaggagattttttattagtggctttatacaatacataacacaatgccctttacagaagcactgaataatcttgacaattacaaatggattcctttgaaatattgtatgaacattaaaccaaaaaaatttatttgtgttaagaatagggtaacaaatatgaaagtgattttaataaaggtcttcctaaattttgctaatcaatgtatgcatcatagaggggtattatcttcctcaatcaccactaggagattaggagaaaaaaagaatagtgactgaacagacgtgtaagaatgatacacaaaacctcatagtaaaagtggaaaagaagaaacattttgtaaacctgaaatgtcttggaatataattttccatgtggaatctggctcaaatggcatgtcagatgccaactggagcacacaggcatgtgagctacagcactgtctaaaggatgccactagtctcaatatattnccagtaacagtgagttggtggaaagagctgttctggcctagtaactgaaggcaactaccaggcagttaaatgacagggcttcatgactgagactgctattgaaaaagaagaaggtttgtgtgtctgatgggtgaactcatgcaataatactaatatgggggcgggcatgggccgggggagttgaaaatgagaaaaagcattatatgaagatatcaagcaatcaatgtgaataagatagactcagagtagcaaaatgaaaagtaacaaggaatacaagaacagaagtctaggtgagacttcagtacatgatttaagacagaaatcttacacttttaatcaaaatgttgcaatattaagagttggaagaaaaaatgtaccttgttttgtgctgctaaaagaaatatctcagttttcataactggctctacagacttccatcactttctaaattggtaatgcacaaacaaaaatggcaaggaatttattcacttatttatttatttatttagagacaaggtctcctgctgttgcccaggctggagtgcagcagctgcaatcagggctcactacagcctcaacccctctgctcaagcgatcctctcacctcagtctcctcagtagctgggaccacgggcatacatcaccatacccagctaatttttcattttttgtagagacaaggtctcattatgttgcctgggctagtcttgaacnnntg

SEQ ID NO: 220743 - DNA, 928 bp, Homo sapiens
tactcatatttggttgaggtataagttttatatgtagagttagacttctgtattttagaagatttagttgacatggtcatatctactatcctaattttattttaaattatgtgttcatttttcacatatgatttgcatttgaaaattagatgcttctatattctgtcatcttttattcacttcatctttatgagaattacacttatttaaaggagttttcctatatataattcattatatattcaatattattccaaaatatttctcaaatatgtgaacattttggtattctaataatgtttagaagtagttttataacaattgttagagattgtaaatatactttaaagttatgacagatatgtaaatacattttaaaattatgacagacattcagatgttgagacagaaatccttgaaaatagttgtcaggactatcggttatatgttttaacctctgttagaaatggcatggggaaaaatttcatggcttcaaacacatttttaggagaagaaattgttgaaatacaatttcagcaataaaaggctcacctttatatgacttacctgtcacatttcctgtaaactgtttggagattgtttttgttactatgaatttctctgatgctttctttaatgaacagtaactgtatttacttgaaacacattgcttggaataatgcttgaattattctgagatgactttgattcatttgaaatggaaaacacttgaaaatgtaaaggtttgtttttcaaaaaattgtaattaaatagcttaattattgattgcaagagtccttgaatggtatcagtgtatctggagatcaagagtttaacatttcccttggttttcttcacaatggaaaagtctgaagttttattttgtcttaataaagcagtcatggctcttaaaactcaaaatgtgtat

SEQ ID NO: 220744 - DNA, 382 bp, Homo sapiens
tcccaaaggctgtgatgtatccaatagacacatgtgtatttttagtaaaaacctgctttgctatttgaaattataaagttgattttttttttcagtgggggacattaacaccaagaatatatcttttaaagcatttttaaaataagctccaaagctatgcgattccacttaagaatggggaagtaacttcctggccaacatggtgaaaccccatctctactaaaaatagaaatattagctgggcgtggtggtgggcccctgtaatcccagctacttgggaggctgaggcaggagaatcgcttggacctgggaggcggaggttgcagtgagctgagatcgcgccactgcactccagcctggcaacaaagccagactccatcta

SEQ ID NO: 220745 - DNA, 701 bp, Homo sapiens
agtgattttctttagcttttgaaattaaattcataatattacaattctgaattcctatgtatgtatatgttaagaatcctttaatgggactgactttcatatgtgtgtggctgcattctgaaatagttgtctaggtgatacataaagcagtgagtgctatttgtaagatatatttatatttaaagtcttcatacagttattaactagctccaatattactgaaatgatttctccaaatatcctatatttaattatcatgctggcaaatttattataactttgggttgaaaaaatatattatgatacatatccactgattaatgccacctatctgctttcctgaattcaaagtttatgattatttccataaatgtatttatcagtataatcaaaaataaaaataacataaataaaatttctgtgagctttacacatctaatgtgcaatgattataaatctggtcttatacacatggtaaaaaacatttaagtcacaaaagtatacttcaggtttaagtataaatctgaaattaaattctcagatttaagtataatttttaaaaactttggtaattgtgtccctactgttaaatttattgtatagttttcactatatcatctgaccttttaatgtttctagaaacttgtgtgaggtctcatacttcatggctaataaagtatttatttttctattcttgaaaa

SEQ ID NO: 220746 - DNA, 528 bp, Homo sapiens
tctgttcactgctgcagtctgggggtgtggtgggcaggccacaaagcagggctggctgagggccaggtcagcctgggatcagagcgccgggcacctggggacacctcaggctttgtcccgcttcgtgggtgttcgttacctagccttgggccctgatggtcgtgcaggtgtgcctgggtgctgtgtgcccacaagcactgagaccagtgccagcaccttatgcagggcctgcaaggtatggccgctgtgctggacaccctggggtacggggttgtgccggacacgcccatgatccaaggagcttggggcttccggggaagcagagctggatccaggggtgcatcagggcccaggaccacagctgcccctgaaggcccctgaggcttctcttccttctttgaagtgcctttggagaacatatattcagatgtcaaattgccagttgaaaggagaacatattttatttgaattggatgaaatgtgatccagaagtcatgttgcttaataaaagtgtgtggttttgattca

SEQ ID NO: 220747 - DNA, 460 bp, Homo sapiens
tcttattaagtgactctgtacctcaaagatcatttattctttggtgaatgaattttccattttagaaatcttagattccattgtatattacattatctcttcatattagttacacagaccagtggaccagactagttgaaggttgtctggacattttattttatggcttggaaattttagtgaaattaatgaaggaaacttccagggataagtcagaaataatttgtgtttagctttaaaatgtgttcatatgcttatgtttaaatagaagtttagtagatttctaaattgcacatcatgtttaatttcagcataatgaaaaaaatttaaacaaatatgtcatcatcatgtatactttgttgagagcagagatttttttcccccttcttcctgtcttttcactgctactattaccctcttttttgttagagactagcatttttgaggctgagtttcttta

SEQ ID NO: 220748 - DNA, 279 bp, Homo sapiens
taatcacttctttagggcccccctcttaataataatgcattagcaacacctgaattttggaggcgatctattcaaaccataggtcaggacatccaggccatcctggctaacacggtgaaatcccgtctctactaaacaaaatacaaaaaattagccgggcgcggtggcgggcgcctgtagtcccagctactcgggaggctgaggcaggagaatggcgtcaacccgggaggcggagcttgcagtgagtgaagatcgcaccactgcactccagcctgggcg

SEQ ID NO: 220749 - DNA, 197 bp, Homo sapiens
tgcttattgcaccatgatccctgaagattggatccagttctgtggaagctggcagaataatgggcccagactgaccagtgagctcactgagggatgttactagttggtccattgctcatctgccaggtcagagacaggtgggaggcaagagaactaattaaattggcagtggacattttacctctaaaatgtagggc

SEQ ID NO: 220750 - DNA, 518 bp, Homo sapiens
ttggtgttgatgacaatgcctaagaatagtcatagcactcagttacctttctgccttcaacttagcaaatataaaagatgtattaagacaacaatgaatcctgcttagaatcttccatgtaccattcagttaaagaaagtatgtggaaatagatacactagtgaatagtaccagatcattaatatttgaaatcaaagagtttaaaacaaggagtaggatttagattagatatacagagagctaatccttcaaattctggcctactagaagagaatactgagcaagattgtgagaaaatgatttgatgggagaacctgggacttgaagcttcccacttatgcttgtcaaccattacttcacctatccatctccctcaggaaaaaaaaaaaaaaagcaaagttaagagaatgacatgctgcagagctgcaataacattaaaagacaattcatcgttttagctctatttatcttatgtaaaatgctagagaactcataaacaagatatactcttagcagag

SEQ ID NO: 220751 - DNA, 102 bp, Homo sapiens
tcctgaacataaacacgtacactatatagtttgctgaaactctaaagaaagtgctttcattttaagatgtggatatatggatggttagatggatggatgtac

SEQ ID NO: 220752 - DNA, 238 bp, Homo sapiens
tggctattctttcatggtacaaagggaaattaagtcccagagtaggagtgtggattatctgagcctgagttgttggcgaatggcttggagtgcctttaaaaaacaaaaacaaaaacaaaacactgggcgttgtggctcacgcctgtaatcccagcactttgggaagccgaggagggtggaccacaaggtcaagagatcaacaccatcctggccaacatggtgaaaccccgtctctact

SEQ ID NO: 220753 - DNA, 578 bp, Homo sapiens
tcatcctgcagtttctgcaaaacttgtagccaatgtgttttcagtagctgggttggagcatgtcagtactatggatctgcacactgctcaaatacagggattcttcagtactgctgtgaatgacttacatgtggagcctgcagttctgtgatggacctgagagaatattgcagactggaggaactgcagcattgtttcacccaaagcaggaggagccaaagagactccaccattcatggacagacctaacatggcttgccttgcaggagaagtgttggggtggataggatgtttctggttggtgatattaaagactgggtggctgtccttgtggatgacatacccaatgcatgtggcacaacacatgactctgcagacaagctactgtctgctggaaccactaaagtttataccacttcagctctgaggctgttattttacaaacaccagtccccaacaagacaacatgattttgctcttacttgtttagccatgttcctctatagctccatgtattggtctgttttcatgctgctaataaagacatacccgacactgggtaatttacaaaagataga

SEQ ID NO: 220754 - DNA, 140 bp, Homo sapiens
tcagcaacccctaatattgcctgtggagtggtgactggttaaatactcctcaacagcaagctgggaatgcatcaagaccctattaaattcctggggtgtgggtggctctgcaagaaaacaatcagagacacatgaaaagg

SEQ ID NO: 220755 - DNA, 616 bp, Homo sapiens
acatctcagacaaaagggagctgggcttgccaccaggattcaaaacaattggtgaatgaaaactgattctttgcaaggagcccggttaaaacacatgacaagcgttactcatgtaataacaaacagcagggcagttcttactggtgatgaacctatatattaatggcattaggcattttatctgatgttgtgaaagaactgggatatttgtgtgggtgtaagaaactgattccagctccctttgtcagcagcaatagaaaggtagaactctgccagtcttctcaaggatggcgagttcatggtccctttgttcactctaactttccacttctgggctgtggaaacctcaaccacagatccatgcagtggttcttatcaccagcacttaaaagtatacacactgatacttctgtgctagaatgatttgtatgtttaacctcatagttgaagaaactgattgttagaaggactcaaaagtttactccaatgaactccacatgtaagactttgatttaaccaaactgaaatacactaattaaacagaagggattctagatttttccacatctacaaataggacaataaaggccttctgatgatttacacaaaatgctaa

SEQ ID NO: 220756 - DNA, 421 bp, Homo sapiens
cacagaagaaacaaaaatggccaataaatatatataaaaaatttccactggtaatcaggatatacaaatggaaataatgactttggcctaaaggtggcagaataaaatattattttaaaacaataatgttcagtgttggtggggtttgaggaaacaaacaggcactctcccgatggaagtagacatgtttagagcacattttcacagtactgccaaaacttgagaattttgatatccttttataccacagatctgcatccagggaagtattctaaggaaacatatcagtcagggtccagtcaactgacaaccggcacaggaagttgtcatggatgtacatgggcagagctgcaaggatgttcacggctggcctcattaaagcagcaagaaattgggaatgacttggtggcctcctcaaggc

SEQ ID NO: 220757 - DNA, 1274 bp, Homo sapiens
atttttttactgagatggagtttcgcttttgtcgcccaggctggagtgcaatggtgcgatcttggctcactgcaacctccgcctcccgggttcaagcaattctcctgtctcagtctcccaagtagctgggattacaggcatgcaccaccacgttcagctagtttttgtatttttagtagagacggggtttcaccatgttggccaagctagtcttgaactcctgacctcaggttagccactcgcctcggccttccaaggtgctgggattacaggcgtgagctactacatgtggcctctgcctcatatttatccagccagtgtagacctgggatttggagtcagacagatctgtgttaagttcgtgcattgtcatttgccaatttttgaccttgtacaagttacttaaccatcctgagccccaggttccttggctgtggtagtgatatagagcacctctctcctgaggttgtctgtaaggattagatgagccaaggcatggtatataatggtacttggcatataagaagcatttagaagttctgatatatgtgtaggaaaccccatcatccttgtttatgccatgtgagcagtttgacaaagctctgagttgaggcaggagagtcatcatgctatttaatgacaaatgctttcagtgtttcaaaatggaggtaaatggaaacttgatgtttttctcaaacaccattaagttgaggcaaggcttggaggagcctcaggaagttctcctttcctgtgactgcgggtctcgggaacggtgttggaatgcccctgcccgctggcttccttctgctgctttggggcctgtctgcagacaggccagatcccagtcatctgaaacaccactcagaaggcaggaatgtgcaatccgttccaagctggaagtgactttcatgtgacaggccgcaccactctgtgactctgtaactaattttccctgccctggaagctctccagattcctgggatgtgatcaattgaggaaaccacttcaggtcacattcaggagagtgctgtatctggaattgggtgtgagagctcccagcatgtggaaaattcagactccaagtttctttatgtttttttctactcttttcaggctggtcttgttaggtaaggaacatgcaaagaaaccctcaaagttgaaagaagttaagacaaaaacaagagctggaattccttgactgaagaggtcattgtacatggcaaacaaatgctcagcttatctttacttaactgaaataaacggaactaaactga

SEQ ID NO: 220758 - DNA, 639 bp, Homo sapiens
ccaacacacagcattcaacagactaagcacttattttcaagttactaatttttaatttacgaagcccttatgtgcaacatgacagtgagcaagagaggtacaaagctgaacccccagtctcttgaatatgaggggaagctgggaagatatcaacaggtgataaaaatatgctacaattaactgtggtgatgttgcacaactctgtaaatacactaaaaatcactgacttgtacactttcaattgatgagaaaactgagatatacagagatcaagaatcatccaaggtcacacaatacgaggtggggtcagaatgcaaacccaggcagtgtgcctacctagcccagactcttaaccactaagatgtcactaaagaagcatcaacatcaacaggaaacactttaacactacctaatgtccaacaacaaggattgattaaacacattccagaatattcacttgacagaattaatggatggatgggatggatggatggactgacaaatggatggatggatgaataaaacagtgggtgggttaggggatgaacgagtggatatataaatggttgagtgggtagaagggtggaggatggatggaggatggatgcatggatggatggatggatggatggatggatg

SEQ ID NO: 220759 - DNA, 460 bp, Homo sapiens
aatgctgatcatcattttaaagtgcttagactttgaaagcatcagctgaaattttttacaatgccgctgccacttatttaatactgttgaatgaaaaacaacatgccaaacagatgggataacctttttattccacacatttgtccctcttcccctactagtacagcttgacagaatggatgtttttgttacctggttcctttccagtatattttctgactgccaattttttcatttcaaacaagccttatttagatagtttaatagtgaataaaccaacataggacttttgtaattgagtagtttcctgtttacagagtttataaaatgtaacctagcagaaaaaatggaatgtgaaaaagtagacttttttgtgtgtgaagacctaaagtgaatctgcaaatataggattataattacatggtttccaaaattcaaaccacaaaatatttccattatt

SEQ ID NO: 220760 - DNA, 369 bp, Homo sapiens
ggtttctctctgggttgttcatatgactcagattggcctgatgggataaagggaagacatgctgtccctgagcaaagatgatgtatttgacagggccttttcctgataacatggaagtggaggttagcttggagcaatgaaaaactcctctagtagcatttgaaatattgctaaatatcaatcatggtactaagttatatctattagcccagctaagtgtttttattatatcatttcttttttaaccttctgatacactgctatttcctttgtttaaaacatatgaggtaggtattattattattatccctgttaaaagataaactgaggcatattaaaattttgaagagtttatttgaacagattggg

SEQ ID NO: 220761 - DNA, 347 bp, Homo sapiens
ttaaaacaaattttttctatgtttttatatgttctatctacatgtattttggcaggggcaagtaggcaaaaagaaaacaaatcaattaatacctcagcccttaaaaacatcacttactatgagtcatgagttgtgcttgaatattttagggggaaagggaagtcacgaagctatatatagactagatgtggtatattagaagcagccaacaactttttcaggaatttctagttctaccacagtaatgtagacctaaccgcagactcagtaacactttaagtcccaatcaaggataccaatccatggcttttcactaccttattcttaacccacaaagaaagagcaaa

SEQ ID NO: 220762 - DNA, 407 bp, Homo sapiens
tgaggccgggcatggtggttcacacctgtaatcccacctgtttgggaggctgaggcaggtagatcacttgagaccaggagtttgagaccagcccagccaacatggagaatcctgtctccactaaaaaaaaacaaaaaacaaaaattagctgggcatggcggtgcatgcctttaatcccagctactctggaggctgaggcaggagaattgcttgaacccaggaggcggaggtttcattgagccgagatggtgccactgcactccagcctgggcaacagagcaagactttgtcttaaataaatcaataaataaaagaggtgacacttgatctgggtcttagaagaggcatctatatgtggcaaaagtcactctatcacattatagaaggtagatgggaccggaggctgt

SEQ ID NO: 220763 - DNA, 2858 bp, Homo sapiens
  misc_feature (824)..(824): n is a, c, g, or t
ggcacccaataaatacataattattagaatgaatacattctatcacaatgtcttaattcaacagattcttggcacctgtggatttaacactggtagtttctactatgtacaaatggctttctagggtcatggcattcaggtatcaaagaaactgatgttttcagctcatgttcacatagttactcttacaaagtaatataatcctggttctactacttacaatctgtgtaaccttgaacaaattccttaaactcttgtggagctgctgtgaaggttaaatgagttaattcacataaatacttaaaatcgcatctgatacacagtagataatattcaataaatattagctctgtgtgtgtgtgtgtgcgtgtgtcatacttatgaaaagaaagccaacaggtggtaccaaaagtgaagataaaataagatagtctaatcaagtgatggttttcacacacacaaaaaggatgttttatggtggaaaatgttattctatagctgtgttcttgaactttaaaagtagcaatgatcttgaaataaatctctcagaaatgtgaagactgtacttcttgctgaaatcaatataacagcctaacaggtgtctcctgtcttgataaagtaggccattcctaaatctatcccatgctgtggatgttattcccactgctaaaacaactttactcacagtctgttcaatgctaatctcaaatataatctcatcagtaaattcttttcctaatcattttccaagatacctgattactcctgtctttgaaatatccaaatagtctacagccgtaccatcctgaatgtgccctatctcntctgaaacatccaaataacctcgaacttcttattctactacatagtaaaatcatttgtgtacttatcctactagattatatgagactgcttcttgttcatcatgcattcaagatttactgagtgcttgtcatatgcgaggtacagaggatacaaaggcaatgaggacatgcaataaataatgcagcaacaccatagcagtaggtacactatgcagagatggcataaatgaggatgatctcttctaccacacatctgcagtatctagaatggcacaacatgtatggtagggacccataagtatttgtcaactttaattcctacctgctttttgaagtttttccataccactatagcttccctttttttttggttctcctcaaggagaatggtatagacagaatttgctccctaaaagtctgtctacaccattctgcacatggtatcttttaatctatgtgttagcatcacaggctgttatttaatattttacatataaatatgtcctatcttccccaactataaaacatgtgttcaaaagagcaagaaatcctagagcactctgtacttattactaagcatttagtatctgttcaatggtcctacaatttccgaaagcaaccaaaatatgtcatgcacctatttacatagctgatagcatcacttctgaaccaccccacctgtgctctgggttctctatgaaacaagtagctttcacataggtgttcttaaagcaggaggccaaagaaatgtctgctggaagcatgagactatgtcattgttctcaagctaggagtccagaacttagaaattctgacagatttagctcttcttccatctagatgcctgggtcctctgagaattcagacacaaatttgtataatgaattcacccagatattttgctaagctaggtgcctataagataatatgcacacagaaagcactcagtaaatgacagtttcctttttctccaatcttacaaggtcctagatcctgttggtaactaagaaaaggtaaatgcaactatcaaccacttaattccaatgctttgactatccaggagaaattaattcctggttccctgttgattctaatctaggagacagcttaagggagctcatgggtcttgaagcttataaggtgtacagtaagtcttcacttaatgccactgatcattcttggaaactgtgatttcaggcaaaaatacatacagcaggtccttgaatagtgttgtttcattcaacttcattccattgtaatgttgatgagaacaaaaaattggttttgttatatgtagttttgcttcaagtcgcagtttcaaaaaacttatgttaagtgaggacttaattcacctgaaagcttatcacacactcaaatataacaaataggaaacattatgcaacttgaatacaagagtatgttcattggtttctatagttatcattccatgtacagtattcacgtgaattattggatgaaaagtccaattatttacatatttggatacaatcatactatactagaactgaagaccatacaggtctctgttccagcattttctggctacctcatggcactgcataatcacttccacccaaatctagccaaatctaagtttaagcacttctgtatctattccaagacaaactccctttcttgtttaatctcagtgactcttacttctagagagggcactcttccttctatatctcttccacctctaacctttctaaccatcaagaacatacaatagatagtagatctcacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctg

SEQ ID NO: 220764 - DNA, 734 bp, Homo sapiens
ttgggggaaagtagcattttgaaataatcctagagcattctccatagccaaggtttactcctcaacggaaacaactttaccagagccttagttgaccatggagaagggcagttagccccctacatccctctctagctttcttgtgttacttagtggaaggaaaaaaaggataagaaacacttctgaagtccaattcagggacttgagcccactaaaagactgaaatatacttacctcctccacaccttaccaccacatcaacacagctccagaataatcacaatgggttacaatggaaagagctgcaaaacatagactctatttaagaaggaattcttagggaaatccaatgtggagaaaacaaagacactgaggaaactaaagtctctggcatctatagctatggaaaacatgaagcacaacccatctgctaggcagattgacataaaacctcatactaaagacctattttcctcagttctcattacctgatacatcatgtttgacttttaacaaaaaatcataaggaaggctatacaaaaagaaaaggaaaaacacagtcagaagagacaaagtaagcatctgaactagactttgacatgaaacaaagtttggaataatcaaatagataattaaaaataactatgattagttatgttaaggactgtaatagaaaaagtataagcatgcaagagcagatgaataatataagcagaataatgaaaactctaaga

SEQ ID NO: 220765 - DNA, 476 bp, Homo sapiens
gggttcaagcaattctctgcctcagcctcccaagtagctgggattacaggcgcccccaccatgcctggctaatttttgtatttttagtagagacctggtttcaccatcttggccttgaactcctgaccttgtgatccactggccttggcctctcaaagttctgggattacaggtgtgagccatcgtacccggcagccctggtttcttcttagttttattggtctgtgttttgatcagcacagtcacttttttgttctctttcctggtaagcagggagtcaaaacaatagcaagaaaatgccagaaatagaatttctactactttgtaaactctaggctcgtgggtctcctagctctcagtacctggctcactgtaggatgggtagatgggtgaatgaatggataaagaaaggaagtttgttcaccggagaggagatgaatttcagtaagtttcatgtaacagtgatcaggagaaat

SEQ ID NO: 220766 - DNA, 409 bp, Homo sapiens
attaagtttgctttcattgttctatgatgtattaacaatgtttagcaaacacaatttaaaaaaaaaaaaagaatgacaaattttaaacatatagaaaacaatggagaatggtactggaaaacctatacatccatcaccattcagtccaatgtcaacattctgtcacaattgtttcagatctttttatgtgtatttcaaaatttaaaaacaaaaataaaaacatacaaaaaaactaaccaagccacagtgaagccacctgccagcccttccttcttttgttgtgatgataaatgttctgaatttggcactcttattcacatttagattttatacatttaccacttattattgtatctataaatactatatatattttacaagttttaaaactttatatgaggccaggtgt

SEQ ID NO: 220767 - DNA, 454 bp, Homo sapiens
caggcgctgaagacttggattggtttagacctagaaggaagtggcatttgattggttattataagtgaaaagggcccctccccgggtgagatatgccagccccataattaggacctgaaaatctctgccaggcctgcctttgtgacgtggcccagtctacctcagctatggaacaggccttgactggtgaggcccaaagccggtggccccgcagaggcgggagtggggccatggctgaggcgcctgggcccagtggcgaatcccgaggacactcagccactcagctgccagcggaaaaaactgtcgggggaccatcgaggggctgctcaagctccgtgctcagagtgtcccagttggtgctccaggccatctccactcacaaagggctgactctggcagctctcaagaaggagctccgaaacgccggctacgaagtgcgcaggaagagcggccg

SEQ ID NO: 220768 - DNA, 391 bp, Homo sapiens
attgttatgaaagtaaatatttatatcagagttgacaaactttgtctgaaggtcctgagagtaaataaatattctaggttttctttttttttgagacggagtctcgctctgtcacccaggctggagtacagtggcgcaatctcagctcactgcaagctccgcctcccaggttcacgccattcttctgcttcagcctctcaagcagctgggactacaggcgtctgccaccacgcccggccaatattctaggttttgcaggccatatatggtaactgttgcatattcttatttttctaagcagctttttaaagatgttaaaatcattcttagctcaaaggccttgatttggtccatagaccataatttcccaacacctgacttgtatttatca

SEQ ID NO: 220769 - DNA, 609 bp, Homo sapiens
gaaccttggaggacctattgcttaaggtgtgggcgaaagaaagtaagttagggcaagagactaaggtatgccagagacccaggacaaaacacagtgcagagtgatgtcacagagccaaatgggagtgcaagctatggcaagccctcccaagtatgtgtgggttaaatgtgattaaattcaaaatctctcaacccaaaaattttctccacaaaggaagtagagaaacaaaacagttcattattgaataagcattaaaccagaatgtgatgtgtgaatataatggaatggaatggattcgaaagaaatggaatggaatggaatggagtggaatggaatggacccgaatggaatggaacagaatggaatggaatggaacgcactcgaatggaatgaaatggaatggaatggaatggaatggaatggaatggaatggaatggaatggaatggaatggaatggacacgaatggaacagaatggaacggaatagactcgaatgggatggaatggaattgaatggactctaatggaatggacatgaatggaatggaatggactcaattagaatgcagttgaattgaaaggatccaaaaggaatgcaatggaatgca

SEQ ID NO: 220770 - DNA, 213 bp, Homo sapiens
tttcctgggatgtaggtacaaggatgtccgctgcagactctttgcagtaaaaaattagaaacaagcaaagcctgcctcaacagcagactggttaaataaattatcaaacgtccataagacagactactttgcagaggatacaaaaaatgcaggaaacctttatgagctgatatcaaactatctcccaggcacgttatgtgaaaaattagcaaa

SEQ ID NO: 220771 - DNA, 589 bp, Homo sapiens
taggattttgaataattttttctctagaattttaaaaattggtttcacaacgtagtcttcatcaacgagttattaatggtttttatataaatcaagtagctgataagtatacagatgctgtgttgacatttctgtggaaagagatactttactgacttggaaaaggttcgtgatcacacctgtctataagtgctgccctgagagtcccagcttgggaccttgacagaatacaagagtaaagtgtcgtgtgcgatcctgagcagaggggagtgtacgcaggcatggagactggcgcgtctggaggatttgtggacagaatggtgtcaaggattgcagcagacctggagatagacagtaaaaacttgctgaactcctgagtgaggtaaaggctactgacgcctctctttgagggctttcatttttaatgattgaactgtgtttctttttttactttaggggctgaatcgtagttttcctaccatcacccacctacatcctacacacctggacattttgaggctaactacaaaagcagtgtagcctgttcctgacattttatcctgaggatgcgtgaaaaaaaaaaaaaaaa

SEQ ID NO: 220772 - DNA, 770 bp, Homo sapiens
ggtggggggaagacaaggaaggaacaactgcctgtgagccttgaacaagctacttccattttctggctctttagtctcctcatttgtaaaatgagggggctggagtaagtaagctctataaggctctcagctgtgacatctatgcataatcacagaagatcgaagtgtacagaacaccatggaaactgaagagagattctgaaaggaggctttaagaggtcacttgcatccaatgctgcagaagtgtcagagactgaggacttaaatgaagccactgattagcaatttaaagatcctctccaaggtaagacagggtctcactgagtgcagcggcacgatcttggctcactgcaacctccgcctcccaggtccaagcgattctcctgcctcagcctcctgagtagctggcattacaggtatgaaccatcatgcccagctaatttttgtgattttagtagagacagggtttcaccatgttgaccaggctggtctggaactcctgacctcaagtgatccgtctgcctcggcctcctaaagtgctgggattacaggcatgagccaccgtgcctggccgctttctgcatttttagtgtcactcaacccttgttgtctctgattgtcaaggcaacgactacgtgtaaagtaatgtggacagagtcttggacagagaaatgcctcagaaatgttttgtgatgaagatgaaggagaggcgctggaagcagaaactggggagggggtaggattcgtgtctccacttactctccacccca

SEQ ID NO: 220773 - DNA, 382 bp, Homo sapiens
ggtggggggaagacaaggaaggaacaactgcctgtgagccttgaacaagctacttccattttctggctctttagtctcctcatttgtaaaatgagggggctggagtaagtaagctctataaggctctcagctgtgacatctatgcataatcacagaagatcgaagtgtacagaacaccatggaaactgaagagagattctgaaaggaggctttaagaggtcacttgcatccaatgctgcagaagtgtcagagactgaggacttaaatgaagccactgattagcaatttaaagatcctctccaaggtaaggcggagcttgcagtgagccaagatggcgccactgcactccagcctgggtgacagagcgagactccatctcaaa

SEQ ID NO: 220774 - DNA, 406 bp, Homo sapiens
tgtgaacgctgcgagagaaactatataaaaatccaaatgcttctgtagaacgcttgaaaggtgatcctccaaaatgaaaattatagcgttagggtggtgggactacggtgatttgttttttatttcacaacattttatttaaattccccccctatgattaaaaaccaacaaagccaacgtgtcggcccggcagggagccctggcaagggggagggggcggggcagcgccaggcgagagggcgcctgcacccacggcccccgcagggcgctgagctcaccggctgtgccagccacagaaacctatgagatctcgagaagctgaggcgtatcggtgactcagccttcgtgttgtgctgtgcaacaatagcttttgtcctttgcccaaaaccctaggccagtgtgctaa

SEQ ID NO: 220775 - DNA, 569 bp, Homo sapiens
agtttcctgctgtcatccatgtaagacgtgacttgctcctccttgccttcatcatgattgtgtgcagcagctgcaaggcctgcgtgatggaaggcgagagcccctggccggctgccctggccacaggccacgatcagctgagtgccttgatggctccataacggctttctcaatgagcaagctacttttcataacaacaacaaagcaacgacgccttgatgccacattcatgccaccgccctcaccacttggcccccgcagcctcggaagcctgcccacctgcaggtgtggtttgcacaggacggcacatccctcctcgtcctgggtttaagcttaaacacacagatggagagaccaaggagctgaggcgctaaggagatgacctaaggttgcaaagtgaaaagcaaggccaaggaggggcttcatttcaaataccagatgcggggccggccctccatccactcctcggaacgcggcactccgcggcctcccgggtagacggtctccaccactacttgcttctgttcatctctgacggcagagttaaataaaattaatactattattga

SEQ ID NO: 220776 - DNA, 477 bp, Homo sapiens
agtttcctgctgtcatccatgtaagacgtgacttgctcctccttgccttcatcatgattgtgaggcttctccagcaacgtggaactgaagtgacggcagccctgtgactgttaacccggaaaactgcgagaggctttcccatggaggggtcctcacacctgggttcacccctgccggaagacactgctgcattgtgtgcagcagctgcaaggcctgcgtgatggaaggcgagagcccctggccggctgccctgatggagagaccaaggagctgaggcgctaaggagatgacctaaggttgcaaagtgaaaagcaaggccaaggaggggcttcatttcaaataccagatgcggggccggccctccatccactcctcggaacgcggcactccgcggcctcccgggtagacggtctccaccactacttgcttctgttcatctctgacggcagagttaaataaaattaatactattattga

SEQ ID NO: 220777 - DNA, 528 bp, Homo sapiens
atttgctaaagtcctaaaattttgtgtatacatgttggcctaaaatatttttgagggctcacaggcatattttcttttgggaaaatggaaactgcctaatacatgagatgatttatatacatgctgcattttacaagcggttagggaaacacatgtctattttttttctaaatcaaataatccgtgtgtgcaccatgctaccttgaatatcagattatcagatttaccatccctattagggatataaatgttccagaagaacataagagcaaatttttagaaagattaatacagaatctaaagattgaagggataagatgatttacattaaatctgtttccaggatatcctagttgggaaatcaacctaaatacccgaaaacttaaataatccaagacagtatgcatttgcttaacagactttttctccatcatttgtctgtgtttagtaagataaaagaaagacttgcggccgggcgtccgaggcagcgggtcacctgaggccgggagttcaagaccagcctgacca

SEQ ID NO: 220778 - DNA, 457 bp, Homo sapiens
cagtgattgctcccttgctcatataactgtttatttttcctatagttaatagctacttgttttttcatttgttagtaatgcaaattccgtctccctaaccccaccactgaatgctccaagagatctaacaaatgcctatcaatatattttcctaaaatcttgaacacatcatcaattaattccattttctttccttggaaacctttcttctgcagctaatagtattcaattttcaatggactagttgctctctaggcccagtagctcttgtcatgggatttatttttgctgtttttctatgttaaatcctttgtttcctggattctataacatttgtctttgttgattatgcacttatttggttaaagcatatgttccagatgctttctgaaaaaatatacacgagccaggtgtggtggctaatgcctgcagttccagctacctgggaggctgaggt

SEQ ID NO: 220779 - DNA, 346 bp, Homo sapiens
tactcagtacatcatttacaaaaaccagacatgcaaagaaacagaaaaatatggcctgtatgcaagaaacataatcctaaaagtttattctttaagaaaagggcttcaaaatacatgaagcaaaaactgatacatctgaaaggagaaagacaaatccacaactttagttgaggccttcagtgcttgatagaacaagcaggtggaatatcagtaagaatatagatgaacaatactaacaggcagctagatttcactggcatttatacgacattccagccaacaacagcagaatacattctcaagtgcacacgcaacattctctaaaataaacaatattctgggccat

SEQ ID NO: 220780 - DNA, 121 bp, Homo sapiens
cttcctgcctgttctcttgagagcactgatgtatcagttacccagttcagtggaaaaaaaaaaaagggtaggggtggaccagtaactgaggtagttaacacaatctgttctcccatttttt

SEQ ID NO: 220781 - DNA, 320 bp, Homo sapiens
atgctccaatcttatcttttctatctaccacctgagtgactttgggcagattcttaaactctctgtatatcagtgtccttattttaataatatttgcttataaaaggttattgggataattaaatgagctaatacaggtaaagtgcttagaacagtgctagacagagtggattgtacaaatatcatcactattgttattgtatagatatagctattattttataggataataattgctatattgtgctctatattactattttagtaggctctcagtaacaaattatggaataaatacttgcagataattatttgtactg

SEQ ID NO: 220782 - DNA, 408 bp, Homo sapiens
ctttctgcatagtaaaataaataattaactgaatgaacagaaactgaatgaacagaaattctcctatagaacgggagaaaatatttgcaaactatgcatgtgacagggaattaatatccaaaatttgtaaggaactaaacaacaacaaaaaagacaaataatcccattaaaaagtgggcaaggaacatgaatagacatttttcaaaagaagacatgaaaatggttagcagaaatatgaaaaaatgctcaacatcactattcatcagagaactgcaaattaaaaccacaatgagacatcatcttacacaagtcagaatgtctattattaaaaggaaaaaatttaacagatattgtcaaagatgtggagaaaagggaactcttatacactgttggtgggaatataaatta

SEQ ID NO: 220783 - DNA, 179 bp, Homo sapiens
tctttcacatctaatcatttgttcatttcctccaattcattccctagtcctcatgccctagtgtatatatatttcaaaacaccatgttgaacatgataaatatatgccttttaaatttttcagttaaaataattttttttaaaaagtatatgcaggagacacagactgttgtagtggtt

SEQ ID NO: 220784 - DNA, 264 bp, Homo sapiens
gcctgaatctgatgcatattaagattctcctttgtggaagaggtaaatgcctataatgctgtatctaagaattgaagccagtgtgacatgccttgaaaacctcaaactgtactttctttcctatgtgcatcctaacttctccaggttggatgcagttcattgacccagaaggtatctgatggcatggagttgacatttaaacaaactttctgactcaggtggttcaagaaaaaagttttggttcatcagaaagagaagtttgtt

SEQ ID NO: 220785 - DNA, 477 bp, Homo sapiens
aatagccacaattagctgaaaaggctattttaaaaacttttccaactgcgtatctgtgtgaagtcaacttacttcaacaaaaaagtttggatgtagaagcagctgtaagaattcaactgtttattataacaagatactaaagagactgtaaaatgccacccttctccttggattgttttggaagttattcttcataaaaaatgttaacgtgggcatgagcccccacacctggccttttcagtttttttatttttattttttctttgagacggagtctcgctctgtcgcccaggctggagtgcagtggcgtgatcttggctcactgaaacctccatctcctgggttcaagcagttctcctgcctcagctactctggaggctgaggtggaaggatcatttgggcctgagaggtcgtggctgcagtgagctgattgcaccactgcaccccagcttgggcgacagactgagagcctgtctc

SEQ ID NO: 220786 - DNA, 468 bp, Homo sapiens
cagtaggcagggtagtgtgaggggtgggtactattgggggggtgcccagaaacatttgaaagatgggatcatcgcaagattggggaggaagctggtcccccaagtcaaaagtgaccatgggggttcaggggggaggagccccttttgctgggagatgaggtgctgcctcaagaagtcagggaggccaggtgtggtggttcacacttgtaatcccagcactttgggaggctgaggcagcaggatggcttgagttcaggaatttgagaccaacctgggcaatggagtgagaccctgtccttacaaaaagtggaaaaacttagctgagcatggtggtatgtgcctgtagtcccagctactcaggaggctgaggtgggaggatcgcttgagcctgggagttcgaggctgcagttagctgtgatggagccactgcactcagcctgggtgacagagtgagaccctgcctcaaaa

SEQ ID NO: 220787 - DNA, 587 bp, Homo sapiens
ggtcaaagtgaacctttggatctgataagaccaagtacatactcccatgctatagtgttttcactaaaacacttttagttttataatttaaaattgtacctcatggcattggaggtgattagacttttcctacagatggaactgtgtgttggatctgatttttagttgggcagcaaacctacccagaaccatctacttgcccagttttatccttacccacagccgcctcatatttctacagcactttatgtttcacagtaattttccctccttgattctacaacttctacccctagaaacctgtgttattttcatcccttacagaatcacagatctgtgagcggaacgttgtgttcacaaaatactgttgattattttaccacttcaatggttgtttcagacaaccacccttttcttttcattattgcttaaatatatcagtgcatggtgtcatgggttacagctaataaaaatcccactcgagtgactgcagcctggcttggtgggaagtgacactgcgagctgcaggccgactctgaagaggcaggttttagatgtgccatgatgccagggattgatcttggctc

SEQ ID NO: 220788 - DNA, 472 bp, Homo sapiens
taccacgtacaaactggaaccaaaccaaggtaatgagaaaaggtgaaaaggggacttgtccagacttttctcccttttggcaagttcaaaagtcaaacctgaaggcgggcaaatgggcagaacatgggaggatgctagattttctcatcctgtgaattcatgacaaggagtttttatcctagctctgagagttccaaatgggaactggaagttacttcactctccatctctcaaggattgactcaatgagcttatatccatccataatactgagctgttatcatgtgtgagtttccctttaaacattgaaacagaaagaaaatgacagtaaaagttacaatagcccctccatgaaatcattaaacaaagtctatgaacattaatattcccactttgttagcatttttgttagtattaacatgcatatcatgaagcttccctttttattataaataaattgtacatcaagttc

SEQ ID NO: 220789 - DNA, 457 bp, Homo sapiens
  misc_feature (436)..(436): n is a, c, g, or t
aatattccaaatagatcaaaatttgaccttcaagtgacgaggcaaaaaatataatagatagggttgatcaacttcattaggatgacattggcctttccacagaaaccaaggctatctaaagaatgtaaaacatattttaaagatgaaaaggttctggagatggatggtggtgatgactgcataacaatgtgaatatatttaatgtcatagaaccacacactaaaaattagattaaaaaggttaatttttatgttatgtatattttactaagtttaatttttctttctttttttttttttagagacagggtctcactctgttgcccagcctggagtacagtcacatagctcactacagcctcaaattcctgagcttaagtgatccttcagccccagcgtgtgaagttgcagtgaccagtctgggtgataaagcaagnctctgtcgcaaaaaaaaaaaa

SEQ ID NO: 220790 - DNA, 178 bp, Homo sapiens
aggcacgaggaaggttttgcaggaaagtcaagggagggtttggggggttgggggacagaaggcaagggcgggacaaaaggaagtggcagatgtttctaaagtgacacccccgtcagcacagtttatattcaacctgatgattactagcgaagcaataaaaaaatatttaacaacctca

SEQ ID NO: 220791 - DNA, 339 bp, Homo sapiens
gccttgtttgctgtgcagcggatactctacaggtacatttcctttttggaaccaaaagggagggatttgacaatattgatggtagatcttttttctttagcaagaattaaggattttggtgggtggggggaggcttctgtggggaccaagacaatgtactgtcagtcaggatttaagtcgaactacctcatcccttgccccagagaacagttgatcgtgttttaaaccaaaaggtgcggaatggagagagggaggcggtgcattgcagcttccgatagagctttttatttttggatatcaggaaccaattttgaagatttcttaagaaagtcatttaca

SEQ ID NO: 220792 - DNA, 390 bp, Homo sapiens
taaaattatttttcaggccggacatggtggctcatgtctgtaatcctagcgctttgggagaggaacaaaagatcaataattttttcaaacctacagaaataactatcatctcctatgttaactgaatttatgttcatgaaaaatcaatgagttattcattccacaattattcaaccaagtatgagctcgctggctaacacaatgggatttgcaatgggtatgaaaatgagtttccaggccgggcacggtggctctgtgaagtcctggctttattatgctactaaagaggaggcatgtggttctaacatatgaataataaacagtaatattttaaacttttttctcttttttaaaattatttttcaggccggacatggtggctcatgtccg

SEQ ID NO: 220793 - DNA, 636 bp, Homo sapiens
ccactgcactccagcctaggcaacaagagtgaaactctgtctcaaaaaaaaaagaaaaattatttttcttttttattgttattgttagagatagggaaggcctcgctatgttgcccaagctggtcttgagctcctggggtcaagcgatcctcccaccttggcctcccaaatcattttaaactcttgattataaacttaaatctttactagtacttcagatactggtatataataggtaactaaattaaagttaaattcccttctcacgtaaagtttaagtttcattcaataactcaatttggggagaggaacaaaagatcaataattttttcaaacctacagaaataactatcatctcctatgttaactgaatttatgttcatgaaaaatcaatgagttattcattccacaattattcaaccaagtatgagctcgctggctaacacaatgggatttgcaatgggtatgaaaatgagtttccaggccgggcacggtggctctgtgaagtcctggctttattatgctactaaagaggaggcatgtggttctaacatatgaataataaacagtaatattttaaacttttttctcttttttaaaattatttttcaggccggacatggtggctcatgtccg

SEQ ID NO: 220794 - DNA, 185 bp, Homo sapiens
agaccactgttctctggagtggatctagaggttaaaaagtcaagctattttgaaccaactacttagagtggcacattctttaggggaggtgagcagggatctattgaattatcatattgctggttaatcatgattaagaatctatagaaccccgaccgggcgcggtggctcacacatgtaattgc

SEQ ID NO: 220795 - DNA, 623 bp, Homo sapiens
gagtttaaagaaacaaactgttatgtttcacagtgaatttaattaaaaatgtatgtagatatagttgatttttcataatacaaaaggacctaggacctatgtcaaagtactctccaaactgatcataaatgttttaaatattttttgctttaaacagcaagttcatctgtgatacataatggagaattccagaaaagatcattttagagtttggtttcaaattttattccttttttccaaaacgatatttgtatatagaaattcgaaaaattaaatgatatcctctacactgtaatacacacagatgtctctgggtgaactgctgactacataaatagatctttaccatagtaacctaaagaccatactgttcaagaccagagatttacaggttcagaaactcagactcatcagtgctcaagggccagtctttcacttacttgggactgcaggtttttatcaacaatgtgcatgacatattttaaaaagaaaaatccatttgttaatgtacaatgaaagttataaccatcaggtggattaggtaatatctaagtttattatttaacctgttggcaaattacatgggaaattacagtgatcaatagtttgcctattagtcgtag

SEQ ID NO: 220796 - DNA, 482 bp, Homo sapiens
gagtttaaagaaacaaactgttatgtttcacagtgaatttaattaaaaatgtatgtagatatagttgatttttcataatacaaaaggacctaggacctatgtcaaagtactctccaaactgatcataaatgttttaaatattttttgctttaaacagcaagttcatctgtgatacataatggagaattccagaaaagatcattttagagtttggtttcaaattttattccttttttccaaaacgatatttgtatatagaaattcgaaaaattaaatgatatcctctacactgtaatacacacagatgtctctgggtgaactgctgactacataaatagatctttaccatagtaacctaaagaccatactgttcaagaccagagatttacaggttcagaaactcagactcattcctccccacagtcatcgacccttaccacgctagtcctacctatctccccttttatagtaataatcttata

SEQ ID NO: 220797 - DNA, 1227 bp, Homo sapiens
  misc_feature (1207)..(1207): n is a, c, g, or t
gctgcggcttcccagaggcgcgagtcgcttttccaggagccgaggcccaaacggggccgggcctgaagggtcccccggccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacacccagtttacgatggactgcgtagcgcctacggaccacgtgtacgagcaccatgagaccacgcatggcggctgcagaggacgaaagaccatgaactactgtgaagactggccagaggcacagaggatttcagcctcgctcctggacagccggtcctaacgagacgctcgtggatttcgataaccacctggatgaaattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggctttgaactattaatcttaganaaaaaaagcaactatcgccc

SEQ ID NO: 220798 - DNA, 1127 bp, Homo sapiens
  misc_feature (1107)..(1107): n is a, c, g, or t
gctgcggcttcccagaggcgcgagtcgcttttccaggagccgaggcccaaacggggccgggcctgaagggtcccccggccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatgtgaactactgtgaagactggccagaggcacagaggatttcagcctcgctcctggacagccggtcctaacgagacgctcgtggatttcgataaccacctggatgaaattcggaatgactggacaaacccagagatcaataaagctgtcctacacttgtgctaggcaggcaccgctgtgactgggctccgggcctttccactacgttgaagaagaaaacctatttttaaatgtaaataaaatatctggtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggctttgaactattaatcttaganaaaaaaagcaactatcgccc

SEQ ID NO: 220799 - DNA, 347 bp, Homo sapiens
aacataagcttctcagagattgtaagctactagagggaagggaccatgaaccacgctggattggattttgaaccacactgccaagccaagggcacagcactagatacttccagaataataagtgcaccatggactctgaatccagatgatctgggctcccactccagctctgcaacaggctggatgtgtgatcttagtccagttatgtcatcgatatgtgctttagttttgtcatctgaaaataggaatactgaagtgggaccattgctgtgaagattaaataagttactatttgtaaaatgcttagaccactgaataaaagtcttcccgctgatgagcaacagatt

SEQ ID NO: 220800 - DNA, 283 bp, Homo sapiens
gtactgaaatctcaactcacctggtgtcactcccagggcacaggctaggacaacacgcacccgtccctggagaactctgggctggttcccccttctccccctgctgaccccctcttagtctacctccgctcctcccttcccccaccggagaacctcccagggtttccatttcctcccggataacataacacgtgctgccctgtgaggaggtgctaaagtcaagagcaaggtggcagggggctttcgagcaagaggcgacctgacttcagagaccctcagtccc

SEQ ID NO: 220801 - DNA, 691 bp, Homo sapiens
catctttggatgcggctattcctagaaaaactaccattttgggggaaaaacgtttatacaacaattccatattgtctccaatgcagcaatgggttaagtcacaattacactggaatcaataagagaaaaagaaaatagtttttcagaggggctgggctggcgattcttttttcactcatcttaatgctaaaaagaccaacatttgtcacaccgataatattttagagggctttagccctcaactacctctagctgacaggaccatcagtaacatcagaatgagaagatacagaaaattcttaaggcattctgggcataattgagtccaagctacttccctgggaggctctcaacagtgtcatgctgactccaaggcctggaactttcttatttttttacgaatcattagaatatctctcaaccagagctggagttacacaagccaccaaggccacagtgcactctgtgtggtctaaggcaagagtaagattttgagaaccaattggtagatcaccatcaccactgatcaaacttagtactaagtccaagatctgttcccttcttgagatgggagaaataagaatgaaaaaagaagaaagcaaacaagtaaatccctgaaaatatgatgaaaaggtgctaaaataacaagaacacaataataatgataaagagaaagaaaaaagaatcaaag

SEQ ID NO: 220802 - DNA, 1384 bp, Homo sapiens
tctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaatatctatttattattaaaaccatttataaggctttttcataaatgtatagcaaataggaattattaacttgagcataagatatgagatacatgaacctgaactattaaaataaaatattatatttaacccttagtttaagaagaagtcaatatgcttatttaaatattatggatggtgggcagatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaataaataaatattatggatggtgaagggaatggtatagaattggagagattatcttactgaacacctgtagtcccagctttctctggaagtggtggtatttgagcaggatgtgcacaaggcaattgaaatgcccataattagtttctcagctttgaatacactataaactcagtggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacaccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcagcttggtttaatgagtgtgttcatgaaataaataatggaggaattgtca

SEQ ID NO: 220803 - DNA, 960 bp, Homo sapiens
agcagtggctcacatctataatcccagcacttgggaggccgaggcaggtggatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaataaataaatattatggatggtgaagggaatggtatagaattggagagattatcttactgaacacctgtagtcccagctttctctggaagtggtggtatttgagcaggatgtgcacaaggcaattgaaatgcccataattagtttctcagctttgaatacactataaactcagtggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacaccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcagcttggtttaatgagtgtgttcatgaaataaataatggaggaattgtca

SEQ ID NO: 220804 - DNA, 681 bp, Homo sapiens
ctgggatgcttacaggaagctcatgggccttccacaatctcgggtcacggactacagagctaaaataacacagaaatttaggcctgtgggttctaagcctggtcgcagagtcgagtcagtcctcttctgtaagaaggctgggaatgcagacagcattcactgccctgacactccctccctgccccttcctgccaaagccatatctcagtaagcaaaggaagtgcttcttgaattgttttgagtaggttcctctgaaaacccgagaaaagtcctgcagccgcagagcccagtccatgaagactccaacatccctctgttcaaccctgtaatggttctcagatgtcagaagcagtcgaatcatttggaataaaaagacacctggacctctttccaggagcatcccgccaaatgggtcaagggtggagctcagaatttgcatttttaaaacaagagcccaagaccacgcttgatagtggtgtccaaacgcccattgccctaggttaaaaacttgaaggaatgaaaaagtgaatgccttatcaaaatcacccctgtaatatttcttgttaaaatttgtacaaggccggatgtggtggctcacgcctgtaatcccagcatactagggaggctgaggcaggagaatcgcttgaacccgggaggtggaggttgcagtgagctgccact

SEQ ID NO: 220805 - DNA, 482 bp, Homo sapiens
tctgtatagaatatatacctatacacatacccaggggaatgctgtttattgttttacaatgtgggatcatttatacatcttttctctcctcatctcaacaccacctcatagaaactcctccaagctatctggcatactctgattttccatgttcattggttacatactatgccatggtgtggacgtgtaataatgtgttcagcttttccctcttgggaggcaaccctctgtttcctggcttttgctccaacaaactatgccataacacccatctttgaaatgtacagtttcagagcaggaggtgaagttggatgctctttcattcaatcccacagttaagataaataaggatcagaaaagtaaaagaacatgcccaaggtcacacagctatttgcttggtgctttgtaaaaatttgaatagctattatttcacatgctcttcacaagcagggcaagtattatcaggtcaaccttaaaagtgg

SEQ ID NO: 220806 - DNA, 480 bp, Homo sapiens
ggggaaaaaaggaaatagtgtatgccttcaagggtcttatttttgacaagcatttatattgcactacagtacagcatatacttaaatattaatattgagtgtaaaataccaagttagaggtgggtcttttaagtgagatttgccaggagcaaaggtctcgtggagcagccgttgctcttgccagatggtacaatagcttcagcatctgcatctcaagaactgaatcagaaatgcacagtcatagatcatggatctgtgactgaagccttcctaggcttgcctcattgtgcctaacatagtgtctggtttctagcagcaggatgagggcagaaagcgagctctggtagataggtctgtgtttgtgccattttgctttcctctgtgagctctaattttggttctctgagttctgttgcagagtttcttcctgttggtgaatgctaacttttaaaacatcacatgaaaaatacagggaagtca

SEQ ID NO: 220807 - DNA, 599 bp, Homo sapiens
attattgagagtgattgtttttaaaacctagttggctttcatctaattcattgccattttaagtgtgtattattttagagcaaacttagaaaaacagcacatttctagtaacttacgacattcgatgaatgataaatgttcaagttagactaaaggaactttattccaacttctagtaactactttcttcatttttctctcatcagtttaggtcttaggatctaccatctgttacttttcagtttctcatctaaataaaacaagatctgctgttcatattgtttaatttctcaggaagggtacattttgggctttgggtttatactgcgagccttttttttgtttttcttgtatgtatacctaagtagtcatatgttttcacatggtcagagttttgataataatactctacctagcttctgaacagtttaataatagatttaatccgtgagaggaaataccctcgaaagttactatagaaataacaccttactatctggtggcatttacttagttcttagaactgactaattagtttatcggttaaagtaatttgctattatattgtaaaatagtacatttgaggctcacttataaaa

SEQ ID NO: 220808 - DNA, 624 bp, Homo sapiens
  misc_feature (2)..(2): n is a, c, g, or t
  misc_feature (4)..(4): n is a, c, g, or t
  misc_feature (6)..(6): n is a, c, g, or t
gncntnttggccgggcagcatctttggagggctggagtgcaatggcgcaatctcagctcactgcaacctccgcctccagggtttaagcgattctcctacctcagcctcccaagtagctggaattacaggcatgtgccaccacactcagctaattttatatttttagtggagacggggtttcaccatgttggtcaggctagtctcaaactcctgacctcaggtaatttgcccgcctcggcctcccaaaatgctgggattacaggcctgagctactgtgcctcagatacatacttaatttttatactgagaatgtgttcaaagattttatgataatcaaaaatctaaaaactttggtctgtttgaggacttgtagattgtactcattagccccctgctcacaactacattttattactactccatagacctcttaaaagttccaggtttttttgttgagacagagtcttgctctgtcctccaggttggagttcagtggcacaatctcagctcactgcaacctccatctcccaggttcaagcgatcctcccacctgagccccccaagtagctgggactacaggtgcatgccccacgctggctaatttttgtattttcagtagagacg

SEQ ID NO: 220809 - DNA, 184 bp, Homo sapiens
tgcacttggattgattgttatcttattgatttaaaagaacccttgtattttttaaaaatatgctttttgtcatataatgaaatatttttgaaaatatgattaaatgtttttttctggcttattgactgtccagtgactttgtctatggagtttattgttgcaatatggaataaaatatgtttat

SEQ ID NO: 220810 - DNA, 829 bp, Homo sapiens
  misc_feature (664)..(664): n is a, c, g, or t
gggagacacagactgtaaatgagtaacaggaaaacattcctatagctgtaattgctaggtcaaaattacctgaaaaaatataaaaggacagagctttagcttactttataccaatgactatcctttcagcaaataaacaacaactaaaacccagcaatattaactcaataacacgttctgttttcctttaaggaaaaattttcttaaaccataatatcatggactcaaacttttatcaaagctcaaagctaccaacttactaaataggccatcttagaaatgtctaaggtagacagtttgtcaattgagacaaaatttctgcaaagctagggaggaaacaggtttcatagttttgtacaaaacaatgagaactaattaattttataccactttccataaattcaagtccagagtaaatcagatacacctgtatttttaaagtaaccagaatgggagaagtgggggagaagcaatttaacaagttatccagacttacattatccaggatgaaagtcacgtgataatcttgggtctgtcttgaccacaaaaacatatgcaccaaatcaaaatttaattacactgtataacatagtttaagttgtgcttcatattttattgactgctttgcttctgacaggacagtttcctgaaggaaagttccaanaattgaaaagttacaacacccacataccaaagactgtttcctgaattttgttacaggaagtgacatctgctataattttaacatttacttcccagtaggagttccatttaaaatgtcttgttgaacattatttgttcagcagtacccctaggcaaagcttttctt

SEQ ID NO: 220811 - DNA, 455 bp, Homo sapiens
tgggtccagggtctcaaacccctcgtggcctatggaacaccaagctctgtgcctaagggtggaaggctgccctgccacactgcaatctaagcccaggacataaaacccctcgtggcttgtaaagaatccagggctctgggcataaaacccctcatagcctctggaatgtgtccagactcgctggccccttgctccttgctctcccaagatcataaactggttgtgtcttgagtgaaaagaacctgttctcctttatctcaactagcagagcatacgctaaaccgtcatagctacgcttggtgcaccactacctttctacccccatgtccgcacgtcctcaccacctgcttctttgtttgattaccaataaatagtgtgggctcccagagctcggggcctttgcagcctccatacaccagcgttggccccctggacccatcctatgtactcttaac

SEQ ID NO: 220812 - DNA, 619 bp, Homo sapiens
gaggtttatctgtgagcctttggactgctgtatggacaacatactctgcagtagcatgaagaagtgagtgaagaccctcccttgaaccgtttgccctgaaagaacagaagtcacatcttgatatctcagtgcctttacagtgccagggatggggtaggtgctgagcgcctggtatgtgctcaccctatgctgtacaacacacagaaagccccacagggtttgaactgtaattaggtagagggtgtgtgggactcgccttgggtctctgactttggcttctgctcccggccttggataggctgatattttctagtagatatcagagactccggttgatagcaccacaatggcttttctcccaactttttgttttacgtattatcaagccaacagagaagttgcaagaatagcacaatgaacatgcatatacccttcacctggattcaccacttttgtttcatttctctcagtatatatgtttgtgtgtgttggagacatatgacattttacctcgaaaccaggcatctcctaggaaaaagagcagcctcccatataacaacaatacaatgataacccttaaaaaactttgcattaataaatcccattagtaatataccat

SEQ ID NO: 220813 - DNA, 115 bp, Homo sapiens
cacctccttttcctcacaaaggcttagagaccaccatcaacacaaccaccagggctggtgactttgttactgactcctactacatcttaattgttttagggctaagacaattctt

SEQ ID NO: 220814 - DNA, 368 bp, Homo sapiens
atactaccctggaccaaatcccacacaaggttcatgccgtttggtgcattctagcaatgaaccatgtagaaataaagtttagagagatgaaaacagaaggatttctgtggacaaaaggaatagcgctgcacctctgtgtaaaacggttctcagctgtaataatagaatactagttccttaggtttgtccttaggagacatcttgggagagttttttcttccctctgctgtctttaaggagttaaagggccctcttagcctgaatgatcctgaaacagacccagtcccaaattgcgtgatgttgggcaggagtggggataggccctacctgagaatagcatactgtctagaataagacttctttctttg

SEQ ID NO: 220815 - DNA, 197 bp, Homo sapiens
cgaactcctgagctcaggtgatccaccggcctcggactcccaaagtgctaggattacaggcatgagccaccacacccagccaggagcctgcattttaaactcgcactgcacctagctctctgagagctaaggaagtccttctgaataggtacttcaatgattcccaaaactttttcttgccatggcacacgttaaaa

SEQ ID NO: 220816 - DNA, 188 bp, Homo sapiens
gtttatgtaacccccatgctcggccagagcgggtaagcctgtgggcagcagctccctgggcaggcttgggaggggccagccaggggccccagaggggtttgggccgggccaggcgagagccctcccctcagccagtcactccagctctgtgccaggctaggggtgggactggaaacaaagtgttcaga

SEQ ID NO: 220817 - DNA, 487 bp, Homo sapiens
atcacatgtaagagggatgtttgaaggaggaataactggtcaaggaaattgggtcatgagtggcaacaggaaatttaagaaggatgtagtggccaaaggtatcatacatgcattgtatatgtatatagatatatatctttcaatgtatgtggatatatgtctacatacatatacaatgtatgcatgtagatatacattgaaagtatagatacatatctatatacctacatacattgaaagtgtatatagatacacacacacacacacacacacacatatacaattataagggagggggactagaataaagaaacctatatggttgcaatactttgacgttgtatttagaggtaaaaggctaactctaagtaggtaggttaggtgtatattttgtaattcctacagcaaaaacatagcccagatatgaccaaaagccatttaataaaacaaaacactaaaaaatattcaattaatccaaaagtaggca

SEQ ID NO: 220818 - DNA, 304 bp, Homo sapiens
gaattcaggcatttggcaacctcattctgaattgtcagtacccacaagtcaagcagtgagacccacttgaaatgctggtcctgtacacaaagtgggtgagcactgtattgaaagacagtcctttccagtgctttcccctgaaattccttgtaaggaccaggagacgcctgcagtcggcctggtgggaagtagtgggcctggctttggagttaaccataactcattttgctgctccagacagtcctcctcccaccccaccccaccccacctcaaaaaaaaaaagagagaggagggggttgtcttt

SEQ ID NO: 220819 - DNA, 330 bp, Homo sapiens
aggagggcatgttggtgagtgtgcctgagtggagagggctgccagtttaagagtatgatagacggagaataaccagtctcttaataagaaggctggctgggagcagtagctcatgcctgtaatctcaacactctgggaggccgaggtgggtggatcacttgagaccaggagttcaagaccagcctggccaacgtggtgaaaccccacctctactacaaatacaaaaaaattagaagggcctggcggtgtgcatccataatcccatctactcaggaggctgagccagggtaatcgcgtgaacctgggaggcggaggttgcagtgacccggg

SEQ ID NO: 220820 - DNA, 629 bp, Homo sapiens
ccgtggctcacacctgtaatcccagcactttgggaggccaaggcgggtggatcacgaggtcaggagattgagaccatcctggctaacacggtgaaacctcgtctctactaaaaatacaaaaaattagctgggcgtggtggcgggcacctgtagtcccaactacttgggaggctgaggcaggagaatggtgtgaacccgggaggtggagcttgcagtgagccgagatggcgccactgcactccagcctgggcgacagagcgagactgtctcaaaaacaacaacaacaacaaaactaaagctaaagctctttgcaggcctcctgttctgagagtgtccggtataagagctgctgacagctttctgacatgggccgtggcagcacccagacctagctcccccagcagatagtgggaagctcgagttgcacaaagatcaaagctcatttcaaggtcagattcctgctgtaggagcagctgagcaatgaaggaaatacatcagccccctcagctatattcttagcccagggcctacaacctagtgagttaagggctcagaaagtatgaagcacttttcaatgtaacagtttatgtgcatctttcattaccagcatggaaccaaccctgccccat

SEQ ID NO: 220821 - DNA, 599 bp, Homo sapiens
ttcttccatctactcccgctacccaactctaggtaaccactaatctactttctgtctttacacatttgcctagtttggacatttcataaaaatgtttggatcttggttaaccaagggtaactgaatccccagaaagtgaaactacagataagggaagacttctcagagtccagaaatattaaatggaaaattccagaaacaattcatatgttttaaattgtgtgccattcttagtagcgtctgagtagcatggtgaaatcttacactttcccactccaacagaatatgaattatccctttgtctagcacaaaccaaaaataaaattctaagccccccaactaactgcatggacccctcctctcagcccagggcattctaaagtaaacctgaaacagtagttcaggccatggtgggaactgtccataactttgacctatttttctgttgggtgtcttgctgttttctttttccgccttctttttttttcttttttgagataaagtctcgctgtcacccaggctgtagtccagtggcgtgatctcggctcactgcaacctccaccccttaggttcaagcgattctctatctcagcctccct

SEQ ID NO: 220822 - DNA, 449 bp, Homo sapiens
ccatgccttttataacctagtcttgggagtcacacactgtcatttctatcacaatctattcactagaattcagtcactaagtttagcctatatgcaatgggaagggaaataaactccaattattggagggagaagtgtcaaagaatttgtgagtatatattaaaaccaccacatatctcgagaactttgtagagaccttaatatgctaatgtgaatccagtagtatgggtaccatttcccaagcatatttgaccgctgaattcatttttgtggataattttgcagaaccagtgttccattgaagacactttgggaaacactggtttaacactgccatcacaaagaaaaacatacgtaaatttcttcaaggctacaacatatcacattattagcttgttatcctggtgctcgatttgtagatcttaaataaataccgactttactcagtg

SEQ ID NO: 220823 - DNA, 409 bp, Homo sapiens
aaactcctgccctcgtggagctgatattctgatgaggagacgcacacaattaacaagcaaataattgaatagccagcatgccagatgttggtaagaggtatggagaaattatttgtatttgcaggggaggtggcataggtgtctggctacttcaaatagaatgattaagggtagagtcaaccgaaaaagtgtaatctgagcaaagactagaaagaagtgaaggttactgaggggaggagccccagctatggttgatctcagaaccctacctagaccatactccacacaatcagctggacttattgctagtcagtattgtcacagggaccccctagcagcatgctttctgctctgatgaccatatggcagatctgctaccttaaatgtccctctactagggaacccaatc

SEQ ID NO: 220824 - DNA, 478 bp, Homo sapiens
cagaatgtcttgcattgtacatgtgtgtctgcagtatgactttgccactcccctgtcgagggttggcatctatttctccatccacttgaatctgggcaggccctgtggctgctgtgagcaatcaaatatgtgatcctataccatttgtagcatagcccttaactggtctagctgattctatttctggcttcttagaagcccgtcactatgtaagaagtatagattcccagagatcaccttgctgcgagttgctgaatacacatggaaaagccctggaagataagatacaatgaggagagaggaaaggtctggtgaaggaacatcaaggcatgagatgtgtgcgagaaaccatcttgggagtagatccatcctcagtttcttacttgcccagctgatgccacatagatcagggcccccctactgggcatagtccttcctgaatttatgacccatagtattatgagaaaaagtaaaaaat

SEQ ID NO: 220825 - DNA, 347 bp, Homo sapiens
gaggccgaggcaggaggattacttgagcataggagttcaagatcagcctgggcaacatagtgaaaaaccatctcaaaaaagaaaaattagccaggcatggtggcatgcacctgtggtttcagctacttaggagcagaggtgggaggatcgcttgattctgggagttcaaggttgcattgagctgtgatcgcgccagtgcactctcgcttgggtgacagagcaagaccttgtctcaaaaaatttaaaacaaaacaaaaaaaactggttatttgtctttttattgttgaattataagagttttaaaaaatatattctggaaacaaatcccttattagagatatgatttg

SEQ ID NO: 220826 - DNA, 532 bp, Homo sapiens
aggtgtgagctaccatgcctggcctattcactttttttctgtttcctttgatcctcttgcctatcccgtctgccctgaaactttcttcttgccatgattctctttcattgtgtcccccaactctggagatccccaggttgagtcagcctccttcccggacttcatatcctcctaagagtgggcatgccccaaggttgtgccattgatcctcgaattatttcactgtatgctttctccttaggagtcacctgcttttatgacctccctttcacctttatgatcatgacctcagatctttttccaatctaaccccttcacctctaagtgcgtggcccatatcttcaattcatgttctgacatctcctcctgaaataaactaccttcatataaaacttgtcttatactgagtttctcatgtttctcccaaaccccttaactaagttcattgacaatacttaacatcacagaaaagtttgtgccttttgacctaatattctcactcatgctaattagccctaaggggaaaaaaaat

SEQ ID NO: 220827 - DNA, 559 bp, Homo sapiens
acttgagtatgccaaggaaaagagttttatacttggataaattaattttctgtcagcttgataatcaagtttaatgtaacaggagtagtatgggtcaccttgcaatactattagttggatgcctcatttaattgacgtgaattcaaataatgatttaactattcagtaaagaacttaaatttatcttggaagtatactcttattcactaattggtacaaagaccgaggaggggacactgggctcttgactgtgatacagtgaagagactagggtttagtcctatttttgtaagacaagatattttacctcacttggtctcatttctcacctttaaaatgagggttttaattagattagtggttctcaaacttttgggtctcaggatacttttttactcttaacagttacaggattcccaagagtttttgtttatgtggattaaatccagtgttaagatattagaaatagaaactgaaaaatattccatgtgtattaaaaataacaatacctatatatgttaacataacacaatttaatgaaaaaaataagagtttaaaa

SEQ ID NO: 220828 - DNA, 525 bp, Homo sapiens
tatcaccctgaaggagcggacgcaggaagcagggaaaaaccaaggactgggctgccggcggggcagaaggccagaagctaatgacctaaaacggaacaggctgtgagcaattcgatcaaactcgaaatgcaactttccaacaatgttcttaaaccgctgtagccccagcttgcttggcttggggtgaaaagtgtgggagaaagtcttcacggcctgcagacttgcttgccgactgaggttgatccggcagttttccgttttgttttgagcgcgaaagcgtggctggctggtggagctccaatctattccgcagcacaaacggcccttctgaggctctgctccccgaggctggcggaaggaagggcactggctactccggtacccaccgaaacaaaaccgacaaacgcaaccgaattaacactattgcttgtttgggtcactgaagaaaacttttcccgtgtcgacagaattctagcccgactttcgtttggaactcaggatcagacctttacaaaattaccgacc

SEQ ID NO: 220829 - DNA, 548 bp, Homo sapiens
tccttttgtggttttggaacttgaggtaaacaaggtgatactgcgtggacccggatgggattgcttctctcccttggtcttgtcttgcatgtgagattcaccccacagctgtgcgtggccatgggccatttgttttcatgcgtctatatagtgttccactgtttatcgacttatccattctgttgctggtgaacatcagggttgcttctgatttttggctattgcagaaaatgctgctgcaagtgttattacacaagtctctgtgggtcctaggggtggaatcgctgtgtcatggggtgtacctgtgctcagctctaccagatcgtggcaaatggttttcccacatggagctctgattgcagtctgcctgagttactgtctactaatttgcatttccctgattattgataaggctacgcatcttttcttttttctcttttgtagagttggaatcttgctatgttgcccaggctagtcttgatctccttgcttcaactgatcctcctggcttggtctcccaaagtgctgggattacaggcatgaaccac

SEQ ID NO: 220830 - DNA, 323 bp, Homo sapiens
gtaatcacagcaacaaccccaaataccacatttattgtctcttacaaagcatcataagttacattaatcactggttttaactacattctgttacagtttggactctagtaactaggcaaatacaaaccaacaaaacagcatataaaaccacatggaacaaaaagcacactactctccaatatgcattttctggagccaatctgatatttaactgggataagacattctaaatagcaactgaaatattgatataccagaacatcatgaaataaatatttttcccaactctgaagacattcctttcctcatgcaaaatttaccaa

SEQ ID NO: 220831 - DNA, 533 bp, Homo sapiens
atgatggaaaattaagaacatgtaagcaattctggcccaagacaggagtagggaggtggtgtctgagggttacttcccttccatgagattgtgcgaaggcagcacttcacagagcgtgggcgtctcctggcccgtccacagtgggtcctccacaacgcccctgacacaggctgagcaaacccttttaatgaagaccaattgtgctttatttgagttggaataggtacggaagtgctctctctgagtttctgacacaaataacaaacaaagccatggccagggtcccaggctcctcaggatttcaagatgtccacatctggggagaaagaagtggacacaggtctgcctcccagctctgggttcacatggtgagacagagctcttgctggctctttccagtgtctggttttgacatcacaaagggctgtggacttttatgatctcgtataagagattcttccattctccgcattaaaactgtcccctgaaagggatatgatctagccaaggctgtgacacaagagacatgtgaa

SEQ ID NO: 220832 - DNA, 233 bp, Homo sapiens
cagaaaaggtcatataatgtaaaggggtcaatttatgaagaagatataacaattgtaaatatatctgcacccaacatcagagtacctaaatatataaagtaaatgttaataaatctgaagaatgagatagactgcaatatagtgtagtagactttagtatgcctctttaaataatgaacagatcatccagacaaaaaatgatatagaacttgaactacatcttagaccaaatg

SEQ ID NO: 220833 - DNA, 503 bp, Homo sapiens
gctaagagctttaataaccacatagtctccatatcttcttctcgtaggggacaaagaaagaaaaaatctcttgggcgtggctgcatttgctggcatcagggatagagagaaatgccagcactccctggggtagataatttaggggagtcctctgcatctgtcctgtggtctttcacagctcatgttttctcggaacgatggacgcacaatgacgtcctcagatggtttctcaggcaagtttccagtgaacatgactttgtcccattcatttgtaactgggcagaagctgggtcccagattcttcctggtggaggcattcggagagcaacaccctggccttaacacactacatatctttgaatttcacacgggggcagccttctgggaaaaccactgacagatttctcatggaggagtcagctggggttgggaagagttgagcgctcatgatcctctcgtgggaaatataacattaaataaaatatttctcgaatcctagcaat

SEQ ID NO: 220834 - DNA, 381 bp, Homo sapiens
agtaagaagcaggattggtaggaatgagggaaaaatcacactaataggccatatctgagttttacattttatttcattagtggtacagggtggaccaaagagactctgcattggatacagccctatagcaactgatctttgatgactttggagaagtaaaaagaaaaaagaaacttttacgcataaccttgtgtcataagaaacataactgttaactgggaagaatttctgctaatccagaaattcttggcttagcagaaaggaagatcttagctccttcctcttataaacctcctgccagtagtgatcataagaaaaactcatcacattcaaacatgagcagtagtcaaagaggaattaacacaggatttgtataagtat

SEQ ID NO: 220835 - DNA, 494 bp, Homo sapiens
gcactgtggtattctggatgagatgattctgggacagaaaaggaatactgggtaacaactaaggaaattcgaataaaatattaactttagttgacaatagtgtattggtattggttcattggttgtgctaatgcaccatattgaagtaatgtaagatgttaaaaatagagggaattgggtgtaggatatatagcaactctactatcttttcagcttttctcaaaatttaaaactattcttaaaaggtcactctccttcctcctcttccacacaaccccattgcgttattcagtatatattgcatcttattttggcttcacatatctagaaagttgaggaatatggaaaagagcagggaaagtaaaagataggaaaggttaaaatgtctaagtgacttaaagttacctagctcaacaaagacaacagtgtcaggctttctgaaaattgtttcaaaaggctttcacaagtatgtcactgagtagaacacaaaacaa

SEQ ID NO: 220836 - DNA, 521 bp, Homo sapiens
gcttttatttgtagatgagacatttatgtgattgagtgaattagccattagacattttcattctagctctacagctgcaaagagggagggggaagatgtcttgagtcttgttcccaatttatcactaagtgcatcagaaatctgtcttccaacacccttggaaagaacagggtggtttttagatgtttgtgctcagacagcgggcaacagcagattaaataacaaggcaaaaatactaggaatgctggtagaaatctatgaccgcaggttaaaaaaaaagaccactcaagtaggccagacccaggagacctgggaatctagaacctggtaagcagtctggaattgggaaaggagaaaatctacttttggacccaggcattagaccgcttaagagaatctatcagtccaggtgatgagtgtgtggctgcaggccagcaggctgtggaatggcaagcagataccttttatatatttcttttaaaatatcagttaaaaaaaggctatttatattccataaaact

SEQ ID NO: 220837 - DNA, 409 bp, Homo sapiens
taattcattcaacatttattgacaatgatcatttgtgaggtactctgcaaggggcagaggagtaagaattggtccctgccctcaaggaactcacagtctagggggggatacagacacaccaatcccagtgccttatttaacaacattcttgcagtggaagaatgaacacagggctagagaagcagagcaggaaagacaatctgtgcttaggaaaactgcagatcaattcatcaaatgctcactactgccctgtgctgactttagttaaacatcagtaggcttcaagaggcaacagcttcttatgcttcttcctgctctctgcttttactcccctcacagccttaccagcaacgtcttcagtggtaagatttagtagaaactcctagagcccttttggaaagacatttgg

SEQ ID NO: 220838 - DNA, 412 bp, Homo sapiens
gggatattaaatgattatgaaacttagctgcaatggctaacagagtaattataaactttttggtgtcacccggcttcttctgataacaccagagagtgtagatgtagaaattgtgctattgaaaatttaaaatatctggcatggatgatcagaaagcctaaagagcagatttgaatgagcctctcatttcctacggccatagagaagatatagaagagaactaagtccaaggtttgattgtgacaattgcggagttttaattctaataaattctcaacatctctaggtctcttatgctgatagaaaagtatcagtggaaaaggggtgaagttttaaaccacaagacagagacgtttgagcagcatagataaggctgagaattttcatgttcttcccagtcccaccatcaatt

SEQ ID NO: 220839 - DNA, 434 bp, Homo sapiens
tcttgattgttctcctttgataaaggaaaattagtcccctgatcagtgtcagtagatgtaaagcaattttgctttggaccagagactttcagatatttataggaggttgtgagagtgtcagtgagttgaccaagttctcacagttagacagtgtggttagcaaatactagatctcagtccattgctttgtccacttcaatacactgactcagcatagtttactgcctctatttatgtcataaagtagtttttgttggtctactatgtgttagtataaacatacccaatttcacttcaaatacagtgatttcgttatactttttgtattaaaaatgacaagaacaaaaggtggtagggaggaagaaatggaagaaggaagggggaatggaagaaataaaactggaaaacaacctaagtaaatgaaaagaaagttt

SEQ ID NO: 220840 - DNA, 440 bp, Homo sapiens
gtaggaaactacttaaagatgtcccacaactcactgatgctctgttcatttttattgtcagccatttttctctctgtgtttatttgcagtttctattgcttttctttaagtttactaatcttttcttcttagatgtctaaactgtgattaatcctatccaatatatgttttatttcagaaattgtagattccaaaaagcttaatttacattttaaaaaatattttccccttccttaatatgttcaatatttcttctatcttcttaaatatatggaatacagttataactataatttctgtatagttctcttcattgacttttctctttatgagttatattttcttgtttctttggctatccggtgattttttgttgggtgccagacattatgaatttttctttttaggtcctggatagattaatattcttatagatattc

SEQ ID NO: 220841 - DNA, 476 bp, Homo sapiens
gaaatccaaaatagtctttatattctattcagaaaatatggtatggatagtggtactactaacaaggctatttaagaaattagttgcaaagtattcattgagcttaatagaaaataacatattttaaagaattaaacctcatcataaaatactttttgtctttttttcctttttgtggagatcaaggtcatgctgtattgctcaggcaggtctcaagctcctagggtcaagctatcctcccacctctacctccctaagtactgggattacaagcatgagccaccacacctggccctaaccataaaataaaacaaaggttaaccttattataatgactagaaatgtaaacagtgccatttaaatattattccttttaagacaatacttgccaaattagtgtcctaactctgtcttccacatagtaccacccaaaaagtgctccatgctcaagtaagtttggttaaatgaagtagatt

SEQ ID NO: 220842 - DNA, 270 bp, Homo sapiens
agataggcctgggttgctggtgggcagccgggtgggtgactgtgtgtagagccacctgctccaggcccagccccacctcctgtgctctcttgcttaggacatcagtgggaccctgagtgctttggtgggaccctgtctgtggcacggggtggtagctgtcccatccttttatatacctgcaaagggttggggatctcaaagagcttttgtttatgtgagtcacatctgtaaatttaccccatgataaataaaatatttttttgtttttga

SEQ ID NO: 220843 - DNA, 136 bp, Homo sapiens
caattcaataagaagttacagcacagtctcacacatatccaattaaccttggcctttagtcaacatctgggttctttttgtcattttcaaatactatcacccagaggtgctatgatttatattggggaggggatta

SEQ ID NO: 220844 - DNA, 294 bp, Homo sapiens
gcacgagcaaggagaagcattgttatctcccaggtttctaatctataaaaagaggataagaaacctgggagatgacaaggagaagcattgttttgtttcgtgctttcctttcactgattttctggtactcaacaatgaaaatataaccagaaaaattatttcataactaggaaaaaaaccgtgaaaacatgctattttaatatatttatcccataatatgactatacatttcagacattcgttacctaagttacagacatctaatgtgaaaatttgtcagaagtatgaaaagta

SEQ ID NO: 220845 - DNA, 508 bp, Homo sapiens
aggttgccatgagctgagatcgcgtgccattccactccaggctgggcaatgagtgaaactccatctcaaaaaaaaaaaaaagaaaagatttaaacataagacctgaaattataaaacagctagaagcaaacatagggacaactcttcagagcattggtctaggcaaaagttttatgactaagacctcaaaagcacaggcaacaggctgggtgtagtggctcacacctgtaatcccagcactttgggaggttgaggtgggaggatcagttgagcccaggaattcgagaccagcttaggcagcataatgagaccctgtctctacaaaaaatttaaaaaattagccaagcctggtggcacgtgcttgtggtccaagctactcaggcggctgaggtaggaggattgcttaagtccaggagcctgggagatcaaggctgcaatgagctgtgattgcgccactccagtccagcctgggcaacagagcaagacacttgtgttaaaaaaaagaaaa

SEQ ID NO: 220846 - DNA, 409 bp, Homo sapiens
aggtaaacaatgcagagtattgttaacttggctgggtaaacaggtaagttctcagcccccctggaaaatccatgatctcctaaagtaaagcaatttaaaattgttcacattatttgtgtgtgagtgtgagggggcgctttatcaccctccacctctcatccccccaccacaagcagttgccaaattcaaataatttttccttcaatgcctctcccgtgtgaccgctccttttttttcaaaagtaaatcctatgtctgggaggtaacccgatcaccgcggaaagaacgccgacatggaaatcttaggattggtttctcgttccaggaagttgcgctactttgggcaaatcacgtcacctctgggactgtttctaatcagaataaagaaagggctggaccaatctttcaga

SEQ ID NO: 220847 - DNA, 295 bp, Homo sapiens
aaaaaaagcgcagaatctacaatgtatgttcaatctacataacaatctagaactaaaattctagataataccaatgtcatggagagagggaggcggagactgacggacgtggcaacatgtggagacatttctcctgtcagaaacaagatgtagatgaagatgaggtttagaaatcaagctgggtggccgggcgccatggctcacacctgtaatcccagcgctttgggaggccaaggcaggcagatcacttgaggtcaggagtttgagaccagcctgaccaacatggtgaaacccg

SEQ ID NO: 220848 - DNA, 351 bp, Homo sapiens
  misc_feature (249)..(250): n is a, c, g, or t
  misc_feature (252)..(254): n is a, c, g, or t
aacaatataagcaacagaatattagataattcaaacaattaaattaatactcataaggcagtgatataaatggcaacttattaatacatgggggagagtaaacaaatctcctatgcagaaaaattccaaataatttatgcaaattctcagccattcacgaggtacagcataactccccaccccttgagtatgggctctgcataggaatttcctgccaaagaggaaatgctgtggggtggggggaggggnngnnnaaggtaaatttacagtggaaaaacctgacaaataccatctcagccaggtgatcaagattaacattaatagcgataagtcatgttggcagtatgtagc

SEQ ID NO: 220849 - DNA, 537 bp, Homo sapiens
atctcaagaaaccactttctttgttcatccctatgaagcaactcctcatccatttaaatttgatcatgagatagcagcaatctagtcacattttcagggttcacttctaattcaagttctcttgctgtttctaccacatccacagttacttcctacaatgaaattttgaaactgtcagttataaaagtcagaatcaacttcttccagacccctgttaatgttgctattttgatctccttccatgaaacatcagtgtttttattggcatctagaatgctgaattctttccagaagattttttctttgcccagattttggatctgggcaaagaggccaggaattcttcctaacatctgcaatgcccaggagagctcctccacaacaaaggattatccagccaaaattgtcaatagtgaaaaggctgagaaatcctatactggagaaagcatgtggaaacagagaagaaaaaaaaattaaaagacagaatgggaacatattaggtcaaaagacagaggagtcaagcatatgaaatggcta

SEQ ID NO: 220850 - DNA, 714 bp, Homo sapiens
ggaaaaacaatcactctgctctttaactcaatcactcccccacattttgcatttttgatgtctgaatttacatcttttatatcacttatcccttaacaaattattgtagttgttattatttttgttttgtattttaaccttcttactaaaaatatgtaagtggtttacattcaattattactatattagagcattctgaatttgtctgaatatttatttttacctgtggatttataccttccaattttttgcattacatattagtgcccttttctttcactttgaagacggttctttaacattttttttaaggcaggtatggttacaatgaattccttcatcttttgtttgtcttagaacgttttaatctctccttcatttcaaatgagagctgttctggatactacattcatggttgacagtttttttcttcagcacttgattctattatcctactctctcctggcccacattgcttctgctgagaagtctgctgccaggcacattatgtattatatgcttcctttttcttagtgctttcaggacctactctttgtttttgacctttgaaagttcaattataatatatcttgtggttgtcttattcagattaaatcagattagtgcgctttggccatcctaaacatcttaatgtttctctaagtttaaaaagttttctgttatttctctgaataattttctaactctttttca

SEQ ID NO: 220851 - DNA, 610 bp, Homo sapiens
actaacagcaccaatgaatgcaaaactttatggaagcctatatatatgctacctgtttatggcagtaaacgtgaagagaagaggtgtttatctttctcttttctcctgaatacttctgaattatatctcaacacttagaatattagcagccagccagtactctttgttttccctctcgaaaatatgaactttaaatcagatatttttgcaggagaaaataagtttagtaatctggggtcttgttatgaggcagaatatgcatcaataagcagaataaaatgcattcagctttcaggctaggcctggacaataacgaccctgcaaatcagagctagaattctaaatgctgtgcctgggaatctgcccagggccttttgggctctcatttttgctgttttgtatttgatatttcatttatatgcatcaaactaataccaactttcatatttgggcaaggaaaggaagagagaatggttgctagaattaaagaactccaaggaactctctaaggaacatagctcctaataaaggtttcagagttccatatttttagaaaacatgtatgtattgattatctacaaagacattcaacacacctccttaattctag

SEQ ID NO: 220852 - DNA, 547 bp, Homo sapiens
ctgcaggctcctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaattttgtatgccagccccagctgtgcctaggcacgtggtgtgtgcaaatgaacgaagcaggcagccctatgttaaggaggcaggtccagagctcacccaggcacagcacaagatgagtgcctggcctcagtgagcgagcactggctgctatgaggctgtggtgtggaaccttgacactaggggccactggcctggcagtgtgacctctaccttatcaaccagagcagtgcaacagaggcagacctcagtgtggtgtctcctgtgaa

SEQ ID NO: 220853 - DNA, 752 bp, Homo sapiens
atgtgtaattcatgagaaaatctatataatgcattgattaccatgtatacttaggtgtttaatcttatttttaaaccacatttcctcaaatcttaaaattacagaagtctgaaactttctactatttataaattagctggaataatttactttcatggaagctccatagagagggatatggttatataactttaaagtctgccttagagaatgatcaacagaacataaaatattaaagtaaaaacactccatctatcattagttcatatgagaaagaaaagatacatactcttgcaattcagaagtttttcctgtaaggaaaaagaaaacttatgagtcttgaaatcaattcacatctgagtcactgaacttcctctgtttgattccaagacagaaatcctacccacctcagccattaagagaatcccatctcttactaataatcattccaaaagaaaaactctgtgaaacatgtttttccctgagataatcagataataaggatttaaatagtttcttggaggaaaaaatataatagaattcaggagagatccaattattcctagaaattatagactagtttataagtagaaagaaagaaatctcataaggccgttttcacattacttcatatgaccattatactttcttccgaccactgcctaagtttataattttagtaaatgttcctttaatttgcaccctaaggtattaatatggccacctgagtatctcattcagttgtatggatg

SEQ ID NO: 220854 - DNA, 841 bp, Homo sapiens
attccggattgcccacgaggcgagtggtggtcatatgtgataggcacgtgttcacacaccctcctgtgtacccccccagggtcaccgaagtccccacacgctggctctccacacctctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtggaggttgcagtgagctgaggcctgtgggaacctggggcgacagagtgcctgcagagaggcggacacacagggacatgacaggggaagctggagggtgagcaagagccaggccatatttatattttcgtaattttatcctgggaagccaccaaaggatgctaagcacagactttaagcatggcaacatttatatttttataacttttcctcaggtagcagtttgttgaaagaatggaatggggaggatggtgcactgggtcacccggaggcaaggagccctttcagccaactcagaatgaaggggagccacagctctggataaatgggcaaagagcaggctcacaagaaatgggtgcttatttcacaaacctcacatgtcccagcagggtcctgttcaagcagtctccatccaattagatgaaattcctcaaggacacaactgtatgttctaaatagctcatgtcttctttactgcagt

SEQ ID NO: 220855 - DNA, 370 bp, Homo sapiens
ggtgtgatggtgcatgcctgtagtcccaactacttgggaggctgaggcacgagaatctcctgaatccaggaggctgaggttgcagtgagccaagatcgtgccactgcccttcagcctgggtgacagagtgagactctgtctcaaaaacaacaacaacaacaacagcaaaaatgaacataggtcaaagcccttggctctgcccatggcaggaagatgaaataaaatctttgtatttagtagagaccattctctttcagggcctatgccattacagtaaaggtacattggaagtaaaactgtttccctttccccaccactagggaccacagggagatttgccttggggctaagcagagcagaagattaaaaa

SEQ ID NO: 220856 - DNA, 166 bp, Homo sapiens
taggaagtgaaacgcagctggataggtaggtaggcttaatccctgaaggattctctttcgactatcccgattaaacaggcaagataatcagctaaatgtgaagactggataggaaatgtagctttgaggggaaaagacctgggtaccggctcgattcgtatatgtc

SEQ ID NO: 220857 - DNA, 367 bp, Homo sapiens
aaagggttcctaaaagatgggagctattagcaaaataatgagttatctaataaaagaaagaaattttgaagtaatgagagtgaagaacaacttgagagacaaagttcttgagaaggtgaaaagggatcagattcacagtacaagtacaagcattggccttagaggccactgtagttaagaaaacagatagaggataggaagtgaaacgcagctggataggtaggtaggcttaatccctgaaggattctctttcgactatcccgattaaacaggcaagataatcagctaaatgtgaagactggataggaaatgtagctttgaggggaaagtataaaacaattttgttaggatgtggaaataaccctgg

SEQ ID NO: 220858 - DNA, 437 bp, Homo sapiens
agatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttt

SEQ ID NO: 220859 - DNA, 557 bp, Homo sapiens
actgcgcctggccggaactgaatttttaattgtatttagttttaattaatttaagtgtaaaactaaaaataattttaaaaagaattgttgaaatgatagtattttggatatattggggtaaataaaaagtagtattagaattatcttcaccttttcctttttcctttttaaatgtggctactagaaaagttaaaataatatatgcagttcatattatatttctattggacagcactgttgtagaaagatatacaataagcagagaacagtgttcctctggggattgagatggaggagattgggaagaggaaagcctttggtcttttgttttataatgagtgtatgtaatcattattacttttaaaaatgtttgatggaaaatgtaaaaaggaagaaaggactgacaacatactacaatgaattttaaaaaggagcaacaaagggaccaagacaaaacacaaatcacttacgttactttaaaaggttgagtattttaaattactgttctctttttttcaaataaatgggcagtggaaaggaaagttgtcatttctata

SEQ ID NO: 220860 - DNA, 465 bp, Homo sapiens
tgggagacagagcaagactcctccaaaaaaacaaagttcaaggaaaaaaaccatatatatatgtatatatagatatagatatagtatatagatatgtattatgtagaatgggatatatatgtgggtttggtattatttgtggttggcatcttagaatgtatcccccatgaataaagtggaagggggctactgtagttgaaaaagagagcctttgtagttaaaacaaacctgagttaaaagttatgctttttactagctgtgtgatcttaatatctttcagcatcagtttctatacttgtaaaataggggcagtaatatttgccacgcaaggtggttgtgaggatttaacatattcatgttaatttcctttctcccattttagacaggtaagagcctgttttggtaatttagactggaaatggcaatggtaattcagaaaaagaaataaattttaattattggtgg

SEQ ID NO: 220861 - DNA, 450 bp, Homo sapiens
tctgggggcagggcggggtggctcacacctgtaataccaactactcgggaggcagaggtgggaggatcacgtgagcccaggagttggagaccaccctgggcaacagagcgagacccagacactacaaaaaaatataaaaattagctgggcgattgtagtcccaagtactcggcaagctgaggcgggagggtttgagcccaagaggtcgaggctgcattgagcccagatggcgccactgcacaccagcctgggagacaaagcaagaccctgtctcaaaaagaaaaagaaaaacaaaaaccagtatgggatgttcctgttaggcaactaagggtgaaaaatcagagcacgacgcatagcttctcacagattctggtgtgcgtgccacaccagagaataaggaactccatagcctgaaagggaactgaataaaaataaacataaaagagaata

SEQ ID NO: 220862 - DNA, 381 bp, Homo sapiens
tgagccaacatgctcgactaaacacagctgacttctagctgtgcacatagctcatagtggcagaaatggtgaagggcaacgtataaagtggcataatggcatgaggctttatgtttcagaagcatccatcagtgtgtttcatatgggaatgcagtgtgcttactctaccaagcaagttgattaatagagtattgctcttgcatactgacatgaggaatttctaaattatactctatatatttgagtactaactgtgctccaggcagcatgctaagtgtgggagattagaatgaatggaaagcctggggatggatctggctcacagacctattttgtttgacctgtgcagtatttaaaaattttgacttcatggctttcagc

SEQ ID NO: 220863 - DNA, 489 bp, Homo sapiens
cctaggctggaatgcagtggcagatcaaggcttactgcagccttggccttcctgggcttagctaatcctcccacctcagccttccaagtagctgggatcacagctgcatgccaccacaccccactaatttttgtatttttctgtagagaccgggttttgccatgttgcccagtctggcctcaaccccctaggctcaagggatccacttgcctcagccttccaaagtattcctgggattacaggcatgaggcatcacgcccagatcatatgaaagtttttaatgttaatgtttagatgtatttatctttctttttaaaattagttgattatttttagagatagggtcttgctgtgttacccaggctggactcctcagctcaagagatcctttgacctcagcattctgtgtagctgggtctacaggcacatgccactgtgcccggctagatctttcctttttgatagctttttttttttttcatagcttaa

SEQ ID NO: 220864 - DNA, 382 bp, Homo sapiens
ttccgggagtatgaagtaaatgaatgaaggccaaacttgagctggttcttgaaaaccctctctcccctcttcctctgggtcttttcaaggaaggaccaaactggcacggtggctcatgcctgtaatcccagcactttgggaggctgaggtgggtggatcgcccgaggtcaggagttcgagaccaccttggctaacatagtgaaaccctgtttctactaaaaatacaaaaaattagctgggcgtgttgatgggcacctgtaatcccagctactctggaggctgaggcaggagaatcgcttgaacccaggagttggaggttgcagtgagctgaaatcacaccattgcactccagcgtgggcaacaagagcaaaactccatctca

SEQ ID NO: 220865 - DNA, 627 bp, Homo sapiens
gtttgggtttttgtcctgttaattatgaacaatgcttggcagatgataaaaaaactcacatatttattgaattaaatggccatggcaattgtagaatacacatgaatttcagccatagctgttatgtttctcccttggcccatctgtccctggtttaaatacatctcacctgacaagaaagttctcttaaaagtagccacaactgcttacagtgcattactctaagcaaatcacccatgtctggctattagcaggccgtgtgggagaaggaaatactgtctgtataccaacgtgatcagcagtaggctgcatatacaacagtggttctataagattataatgaagctgaaaaattcctattgcctaatgatgtcataccccgttgtaatgctcatgatattgtggcagaacactttactttgtctatgttaagatacacaaataccattgtgttacagttgtctactgtattcagtacagtaacatgtacaagtttatagcctaggcccagtacactctaccatatagcctaggtttatattaggctataccatctaggtttgtgtaagaggctataccatctaggtttgtgttagtacactcttaggatgtttgcaccatgacaga

SEQ ID NO: 220866 - DNA, 494 bp, Homo sapiens
gctatttttaaattccatagtcatatactaacaatttaacactaaaatattctttgtatttcttaaactaggtatacagtatgtaatacactgaagtgtagtaagatggtttattacgcacaagactgtgagtgcaaactatctctaatctacttctcactacatgtatgacctgaagcaagtaacataccttctcttccccattttcccatagggctgtggtgagaattaaatgcactaatgtatgtcaagtgcttagaacagtgcctggcacttaataagcacaccataaatgtcatctactttaattatgtaattattatttttatgagaaatgacatcccagctcagacaactcagtacaaatcctgataatattaaaatttcaatttactttaccagtgagctcaaacatttaggaaagctgggctaatagcccaggttttacactaaacagtctcagtgtttacactatatctaccccattcacgaat

SEQ ID NO: 220867 - DNA, 158 bp, Homo sapiens
agtgaggtatttggggtttttcagacttacttgattacagatctggagtatctcaaaacagttgttttgtggaaaacactctggcaaactctgagtcttagtcattaaaaatagtttttgggtaaacaacagtgtaatagaaatggaaattactggtt

SEQ ID NO: 220868 - DNA, 308 bp, Homo sapiens
acttttgagacatgttctctccacagcttccacccacgccccgccacacacacacgcatacacacacatacccccgcagagggagaccctcactgagtgagcagccagttctgtaaaaagcagccggatggggcgaaccttccctgggccatctgaaaaagagctttgccagtctttcctctcttttcttgcttcattgctcccagcctcttcctttcaaacaaaaatcctacaggatttaagttggctagatgctatgaacatagctacaagcttgaaatgtttattgtcactagttattttaagtc

SEQ ID NO: 220869 - DNA, 288 bp, Homo sapiens
tatgctcaggtttctggttttaaaatgagaggataatcttttatggaaaaatttaaacacattgaattaattactgagacatgaggtaaagaggtatatatttttttgcttcagtgtattttgttctgctaaaaatatacataaccatttggtctgttttttgccccagttttacctctgtttttgaaactgatagaaaaaaactcattcccctccaaaatttccatatgagacaaataattggcagatgtttatgctactcaaaaataaagtgatcgatcgcatctg

SEQ ID NO: 220870 - DNA, 412 bp, Homo sapiens
gatggtggtgcacccctgtagtcctagctactcaggaggctgaggtgagtggatgacttgaacacaggagtttgaggctgcagcaagctaggatcacaccactgcattccagcttggttgacagagtataaccctgtctcttaaaaaaaaaaaaaattggtgcagtagttcaggtagggagacctttgtatgtgttgacgctatctatctcatgtaaggcagtttaatatttattcagtgatactaatcaaaataaagaattcagtaagtctatacattgtctaaattgtgttaaacttaataattcccaggttgtaacataaattaggctttaatataatgcgttttggtttctaaaatgagatgagaacatataatttgcactctctgtagtcacagcatgagactgctt

SEQ ID NO: 220871 - DNA, 381 bp, Homo sapiens
cagagacaggatctcactctgttgcccagggcagagtgcagtggtgtggtcacgattcactgcagcctcagtttcatgggctcaagccatcctcaatcctcccacctcagccttccgagtccgagctgggactgcagtgtgcgccaccacacctggctaattttctttttactttttgtagagacagggtctcgccatgttgctcaggctggtcttgaactcctgggctcaagtgatctggccgccttgacttcccaaagtgctgagattacaggcatgagccaccacaccctgcctgccttccacttttatgttagcacatgtgctgtgtgtatacagcagcttttcttcctttttgcttttctcttctgtcccctgcta

SEQ ID NO: 220872 - DNA, 482 bp, Homo sapiens
tttggtttagggttctccagccccccaaacgctagcctcttccatccacaccatcaggtcctggcaacacctcatctacgagcaggtataaggtgacggtaccacagcccaggtagaaggcccaggaaaacttgacctctgtgaaacggtgatatggttagggtttgtgtccctacccaaatcgcaccttgaattgtgtccccataatcctcacgtgtctaggtagagaccaggtggaggtaattgaatcatggggccggcttcccccatgctgttcttgtgatagtgagtgagttttcacaagatatggtgtttttttaaggggctcttcctgccttcgcttggccttcttcctgccactctgtgaagacagtggcttgcttccccttcaccttccaccatgattgtaagtttcctgaggcctccccagccatgctgaactgtgaatcaaataaacctctttcctttataaattacccagt

SEQ ID NO: 220873 - DNA, 524 bp, Homo sapiens
tcagtggtttgggcggtggtttagtacttgcctctgtcacagattctacaactcccacccatggaaccttcaacaccaagtcggggcttcctggaagaggtcctggcaacacctcatctacgagcaggtataaggtgacggtaccacagcccaggtagaaggcccaggaaaacttgacctctgtgaaacggtgatatggttagggtttgtgtccctacccaaatcgcaccttgaattgtgtccccataatcctcacgtgtctaggtagagaccaggtggaggtaattgaatcatggggccggcttcccccatgctgttcttgtgatagtgagtgagttttcacaagatatggtgtttttttaaggggctcttcctgccttcgcttggccttcttcctgccactctgtgaagacagtggcttgcttccccttcaccttccaccatgattgtaagtttcctgaggcctccccagccatgctgaactgtgaatcaaataaacctctttcctttataaattacccagt

SEQ ID NO: 220874 - DNA, 184 bp, Homo sapiens
gggagaacactacagggacatgcaacaaatggtacatgtgagcttttcaagtgaactactttttttctaatgaaccataaagctgccatggaaaagtatgtatgtcacaaccagacaaaatgcagatcaaaaatggaaataattactctgatgacagaatgttgggagggagttgtgtaaatag

SEQ ID NO: 220875 - DNA, 177 bp, Homo sapiens
aatccacctctgtccaatcctaaacaaactcttgactctgtgactgaccctcctgtgtccctcttcaatccaccatgctctgtgggtgttcagtctgccagtatctgcttttccctctggactctccaggcagctggcacctttgcaactctgtggtgcttcaggtagggaccctca

SEQ ID NO: 220876 - DNA, 284 bp, Homo sapiens
acatcaggcaaatctcaaatgagggacattctacaacatacctgacaaagactcctccaaatgctcaaagttaccaaaacaaggaaattttgagagactatcacggccaagaggcgcctaaggagacatgatgactaagtgcaatgtggcatcctgggacaaaaaaggacatcaaggaaaagtgacagaaatctgaaaggagtatggactttagtgagtaagaatgtaccagtattggttcactaattgcaagaaatgtgccatactaatgtaatgttaataat

SEQ ID NO: 220877 - DNA, 394 bp, Homo sapiens
aagcatttgctaattttaagaaattgtatgtaaaacagaatggttcttgtgtttcagtctcagtcttatgtgagacttctgagaatacttacctggaattttaaaacttggaacctctgatgacttcataaaacaaaagccctggtgttatcctgggacagttagtgatttatgtcctctaaggattgtgacagtggagatcagtggcagagatgccatcaatgaaccatagatttacctcaaacagaatttgtcactggtttgacaatattattcccaccagtgtcaacttaatatcttttcagtataatttctgatcgttacaagtgaggtacaaagtgcagtgggcatttaaaggagggcgagattatataccctgtttaaggggattggt

SEQ ID NO: 220878 - DNA, 505 bp, Homo sapiens
atgagcatagacattactgatttttgaccctatcaagtgacgcctgcttgaggcaccctgcagtacctgccagtgccttcagacctggagcccccatggaaaatttctgtcttatttcctgctaccaccacgatccttttcttacttctcaaacccatctaagccatattgataatattttgtaccatcaaatactttttgtagaaaagcactttttataaacaaagcacaactaaactcagggcaagagatggctgaactcatcacctgataacccttcttttccacctcctgcctcctcctgcctctaccatgttgccttttccacctctgtggctcatgaccacacaggatgccaggcgaggtcaaatacaaggttgctaggaaaaatcagacaagaaaattaagcaatggccaattcttgccagaaaacactgtgatacccctttgggttttcattgcaggggtcttgagggccacccacacaggtgacttaaatctttca

SEQ ID NO: 220879 - DNA, 204 bp, Homo sapiens
tctcctgtctcccgccgctcccagagacaatgaccatgtttgaaaatgtcacccgggccctggccagacagctaaaccctcgaggggacctgacaccacttgacagcctcatcgacttcaagcgcttccatcccttctgcctggtgctgaggaagaggaagagcacgctcttctggggggcccggtacgtccgcaccgactaca

SEQ ID NO: 220880 - DNA, 315 bp, Homo sapiens
tcatgaagaaaggcagccacatggctctagccataggccggtaatgaaggaaagaaagggtaggcaagcttccaacttttaggataaaaagaagggcagaaaaatcccagcataacttcccttttatatctgcaaataaattggaaaccaaagactagaatataagactgttaagtatttgttaagattctagaaaccatgtaacatctcctgtatttttgttgtccctttgtggttcagtacaccagcatagagtcagtttcattaaaacctttaagacaaaaagggtttgcatgcttttccttggccaaaata

SEQ ID NO: 220881 - DNA, 573 bp, Homo sapiens
cagagttaaaaattgtatgtatataattttttatagatattgccaaattgtcttccataaaagttgaaccaattcttctctacttttattttgcattctgagtgtggcagaggcaaagctatgtgcataccatagctttttctccccctgaaaacacaactaaactacattgttttcctggcctctcatgcatttaggttggggtcatattacttccctccaagaaaaacaacagttggtatgcctcctccacacttcccacaactgtggaagccagtgatccagatagcatagctattaatacaagatgggtgaaagctgctcaaccgcatcagacagcatgagtggtaagattttattgtgtcaaacgactgcattagttgtgttttgttattatggcagcatagcctagcttagccctaactaattcaataaataaagttgagcattatttgtacatttaaaagcgttttttatgtttgctttacagtggctttccacttttctatcagagaatcccccctcccttatgtaccatgctatattaataaattggaaggagctgctagctca

SEQ ID NO: 220882 - DNA, 468 bp, Homo sapiens
tagatattgccaaattgtcttccataaaagttgaaccaattttcactaccaccagcaaagtaggagaggacttgtttatccacaccctctttaatgtatgtaatcaaattttgggatatctgccagtctgttagggggaaatgatactcttctctacttttattttgcattctgagtgtggcagaggcaaagctatgtgcataccatagctttttctccccctgaaaacacaactaaactacattgttttcctggcctctcatgcatttaggttgggggccagtgatccagatagcatagctattaatacaagatgggtgaaagctgctcaaccgcatcagacagcatgagtggtaagattttattgtgtcaaacgactgcattagttgtgttttgttattatggcagcatagcctagcttagccctaactaattcaataaataaagttgagcattatttgtacattt

SEQ ID NO: 220883 - DNA, 412 bp, Homo sapiens
tttagactagggcatggaggccttttccaggtctagccatctacagacctgtgaggagttaaatataccttgcatttctagaacatccttatttaattctcttcaagttctttccaagccctttgattgaagtgagctgccttgatcctatctgggagtctgcagccagcaaagccgctctgcaggccccctgccattgtcaagtccatatttaagaatggcagtggccgtggtgcccaggctgaaatttgctgtacacatttggcaacatagagtgcaatgtaactacacattactgatctaaacccatcggacttatcagtgggctctgacaggtacttgttggctgccttcccaggctgggaaggtatcccggagccagccaatgtgatgccctcccctcccttttgat

SEQ ID NO: 220884 - DNA, 413 bp, Homo sapiens
tcttttatttccaatctatcccttgcaagattaccgtaaatttctgtcatttttaagtaggattatattatctcattttacttatagctatcatagtccctgaaagcattttatccctattgcactgaagacattgtttcctgggggacaaaaaactgagatgtacgagaaatttacagtcagaacttctatagttgagtcacagtttcatatcctactgacgtgctgacttttggagtaactttctaatcattattggttaactttctttatattttaaagggagaaagtgatagcatgcttcagatgtaacagtgtttggtaaacataagtatatatcagtttttgtcattggggaaatattcatagatcaaaaaatggtcgacgcggccgcgaatttagtagtagtaggc

SEQ ID NO: 220885 - DNA, 595 bp, Homo sapiens
agagaggaagggtcagtattctcgagctaataagtccatattataccaaggaagaggaaagagctcaccagagttgtggataagaatcaaccttcaagaaggaggagaaatagcttggtctcatcttgtctcttttctgttctctcttgcttttttctttgttctatcctctacaatattgaaaagtgtaaaatacaaacactataggattggccatctagagtcctgggttttagacttggtctggtctgctataatcaacagtgtgatcttagacaagccacttggcctcctgggaccccagtctcctcatttggaaataagaaggcaaattatcttaagagtcctttcttaggctgattcttggaatcacctaaacaatccacaaatactaggacttcctggaataaaattaggaatccagatggtctaatactaatgcttagacccactccttcaccaaggcactagataccccaaatgaaacacctggacctccccaggaaccaaggtcctctggatcctctggcctgacagtcacaggaggatggtctgagataagtctgtctggtcctaaagtaatgcatacttgaca

SEQ ID NO: 220886 - DNA, 558 bp, Homo sapiens
acataattaaaattaatgtttagagaattacatgtctttaaattgctttcactttttcagactatttaaaatgtaaagatgcttattttaccttggtttaaagaggacactccattctatcatacaatgaacattataattttaagtaaaattccacttttataaccagttgggtttcttcacagcttagtgacttataaataaacagcaactttaaactcttccagtattcccccaaattcaccaatacatgagtgaatacaggtgtatgttttaaaatataaaatgattttgtatataaatgtaaaatagtcctaaaagcaataatataaaccttattaagaccagaaagcaaataaatggcctgtaaccctaaaaatggaaacatcagaacctacagcaaattttgaacactggagacgtgacacagaatgtggttcttcccagccttaacactgccactacccagctaggaaacaccagagaagcccttggtcctctctggacctcagtttcttcacccaaaaataaggcagtaggcatattaggatcctctac

SEQ ID NO: 220887 - DNA, 375 bp, Homo sapiens
gacagagcaagactccgtctcaaaacaaacaaacaaacaaacaaacaaaaaactggcttgatctaagtaggatcgagtggaaagggaatagatcatcttatgtggctgaactagacccacttatgtggtgtagctcttgtagaaagcagctgtcagcctgaggtagggaagaactcttgtactgttggaacaatggtcagaggctgaagtgggccacctgtctgggttctaagttctctgtcactgaagggttctgagagaaactgtcttgtcttgtcttgtaaagaaaattgcagtaagaagagtttgatgcttataagagagagcacctagtaggtgccaggcaacccctttgtgtgctatcatttctaattt

SEQ ID NO: 220888 - DNA, 201 bp, Homo sapiens
gagcttttagacataaaaaatttaattttttggaaatacagaccccatgatatcacaaaatttcttcactggcttaacttttgtccagtcaatttcaacagtcagaactaagttatttgatcactggacaaaaggttaagtaagctacgcatatttaattgacttttttttaaattattggtggcccttctgtttttactc

SEQ ID NO: 220889 - DNA, 421 bp, Homo sapiens
ccgtctcaaatatatacaattgtatgtaatattttcagaccatggttgacagcaggtaactgaaaccatggaaagtgaaaccttggataagggagggctactataatgtggagagaaatgttctaatatctatcaaaatgttgaatgtatatatcctctgatacaactattcattttctaggaatttatcctatagataatatgcacacacatcccaaataacatatgcaaatgcttatatattgcagcattgtctgtaataacaaaatattagattttggcatatccatgtaatagaatactaatatgcaggcataaaacataaataaggagacttttttcttacaataacataaaaggactactgtttcttgggggaaaaaagtacagaatgttaagtatagtgtacacaattttgtga

SEQ ID NO: 220890 - DNA, 365 bp, Homo sapiens
cacggggaataactgtctactattgaaaaaaatgtagtatttatcagtttcttgtgcttgtatgatccattttatgcaacgtaaaataaacgtttttgaggaaaggactcatggttgaaaatgcttatcttcagagatttaatcttttgaaaaaaaaatttatcttcagaggaaaccattgtgttttgtagtccaccaaatccgaaacagtttgtcatccaacactgctatgagcatttggacaatttgctatataactttatgttactatattaggtaaagctttcctcactaaaaattaatagagatgtttgaaatctaaagatttttagagtacaatttttttaaagaagttggtggtagga

SEQ ID NO: 220891 - DNA, 574 bp, Homo sapiens
tgaacattaaaatgatgttgaatttaaccacaccatagagatgataaagtgcagtttccatgctacaggaaataaatccacataataggatttccaggagagaaaatcaatacagaaataatagaagaaaactttttgagttaaagaaagatttgagttgcccaattatagggaaaaagggaatcaggcaaaattagggaagagctccttcttggacattcctagggacaaagaataaagagcctggtggccctcagagtaagtgacagcatttaacgacagaagtcccagagcaatatctgaaggttttaagagggaaaaggttgtaacccagggatccttcactcatccaagccactggccgtatgatataaccacagaaagacattctcagccttgcaaggattcagacatttgccacccatgtatctttcctgaaaaaattatttgtagaaatagtcccaccaattaagaagggaatctaaatgccagaaattaaagatgtaatgtcaaagaaataatgataaggtataaagccaataaaatatagagttttacaataaataattgctaa

SEQ ID NO: 220892 - DNA, 500 bp, Homo sapiens
tctgctcttgaggatccccgtacatgtcgaggctgtgacaaatgctgtcaataaacagaatggcataaaaactaaaaagccatgaccttgagtaagttacgagagtagagtgaagattataaagcctgattaggaagagtttaagagatgacgggaagagagaatatacaaacagagagacaactctttcaagaagtcttagtataggctgggcgtgctggctcatgcctgtaatcccagcacttggggaggctgaggcaggtggatcacttcaggtcaggagttcgagaccagcctggccaacgtggtgaaaccctgtctctactaaaaatacaaaaattagctaggcatggtggcacatgcctggaatccaaactgtgggcccaattactcaggaggctgaggcaggagaatcacttgaacccgggaggcggagcttgcagtaagctgagatcgcgccactgcactccagtctgggcgactgagcaagactccatctc

SEQ ID NO: 220893 - DNA, 838 bp, Homo sapiens
gtgggattcagtttggaacatattgcctttgaatgcttatcaaattaccaaagtggagatgtcaaataggcttccactgtatgattctgaagtttagaggacagttctaggctaaagatataaatttgagaatcccaagaatatggggattatttaagacttcaaattggatgaaaccagcttgagaatgtaagtggagaagttatgaagactcagaactgacctttggggcatcccaatgtttaaagggcaattagatagaatcagcaaaggagactgagaaagaggagcctgtgaagttgaatgagaatcacaggaagttatttcccagaaggcaactaaagaaagtattccaagtaggaaggcgtgactgtgacaaatgctgtcaataaacagaatggcataaaaactaaaaagccatgaccttgagtaagttacgagagtagagtgaagattataaagcctgattaggaagagtttaagagatgacgggaagagagaatatacaaacagagagacaactctttcaagaagtcttagtataggctgggcgtgctggctcatgcctgtaatcccagcacttggggaggctgaggcaggtggatcacttcaggtcaggagttcgagaccagcctggccaacgtggtgaaaccctgtctctactaaaaatacaaaaattagctaggcatggtggcacatgcctggaatccaaactgtgggcccaattactcaggaggctgaggcaggagaatcacttgaacccgggaggcggagcttgcagtaagctgagatcgcgccactgcactccagtctgggcgactgagcaagactccatctc

SEQ ID NO: 220894 - DNA, 269 bp, Homo sapiens
agcagctagtaaaggggtcattaggccctcagtgatgacacagtccaacagatctaacttttcttcatggatcatttgtgagactggtgacaattaagggccattgttctttttgattaagcagaacttgggcattcataccaaacaaaagattttgtagaaatagatataaatgggccctaaaataggaatgcaggtgcaaacacacaatgcagctgcaaacacacaatgcggctgcaaacacacaatgcagctgcaaacacacaatg

SEQ ID NO: 220895 - DNA, 434 bp, Homo sapiens
taaattcactggaagttagtaaaataaagattacatttttattcctatgtaagttcactgaacccttaaattctattggtgggtcctgggttaagaagcagaagcaggattgtaagcggagtactaaatgaggaaatacattaattagaaagacaggaggaaggaaaagactccctttctccaagactaagtggaaagaaaactggggctgttcgagtggaattaattttagagccaaatatactcttgctccacagaacaaaataaaatgctattttaaaaaaataagttaaaatagatttcaagcagactgcctcatgaaagtctttgaaaacagaatgtgctgaattttgaagtgattgacaggatgaagtgttttttaaaatttctaatgtatatttcatcataaaaaagtgagtgaaagttcaaaaaaa

SEQ ID NO: 220896 - DNA, 2131 bp, Homo sapiens
gtgataggatgttaaccaccatgataaaaacttacaaaagaataaaaatcactaggaaatcagatgagaacgagaaagaaataaaatcttatcattacaaaaaccaccaaactgcaaagatagacactaagagaggaagaaaggaaaaaaggatatacaaaatgacaacaaaataaaaatcatatcaagtatcttctcagaccacagtgaaactagaaattaataccaagaataactttggaaactatacaaactcctggacacatataacttaccaagactgaaccaagaagaaatacaaaacatgaacggaccattaatgagtaacgagattgaatgagtaataaaaagtcccccaacaaagaaaagaccaggactgcatggcttcacagctgaattctaccaatctttaaaaagaaaaaatactaactcttctcaaactattccagaaacttgaaggcggggggtgtgggagtggaatttgtccaaactcattctatgaggccagaattaccctgacaccaaaaccagacaaggacacaactaaaagagaaaactataggccaatatccctggtgaaaatagatgtaaaaattctcaacaaaatactaacaaaccaaatccaacagcatatcaaaaagattatacaccatgatcaagtgggatttatttcaggaatgcaaggatggttcaatacatgaaaatcaataaatgtggtacatcacaacagcagaatggacaaaaaccatatgatcatcttaggagatgcagaaaaagcatttaatcaaatcaacatcccttcatgataaaaattcttaacaaattaggtatataaggaatgtacctcaatacaaaaaaaaggccatatatgacaaacccacagccaaaatcatactgattgggggaaaagtagaaagctttttctttaagaactggaacaagacaaggatgtctacttttaacactcttattcaacatagtactgaaggttctagccagaacagttagacaaaagaaataaaagccatccaaattggaaatgaggaagtcgagttgtccctgtttccagatgacataattttatatatagaaaaaccttaagactccacccaaaacttttagtactgataaatatattcagtaaagttgcagaatacaaaatcaacaaacacaaatccatagcatttctatgcaacaataacaaactacctaaaaaagaaattaagaaagcattcccattcacaatagctacaaacctccacccccaggaataaatttaaccaaggaggtaaaggatctctacaatgaaaactacaaaacactgatgtaagaaattgaacatgacacaaaagaaagaaaagacatcctatgttcatgaattggaagaattaatattgtccaaataaccatattatccacacaatctgtagattcaatgcaattcctatcaaaatataaattacattcttcactgaaatagaaaaaagattcctaaaattcctatgaaaccacaaagactctgaatagctaaagcaatcctgaccaaaaagagcaaagttggaggaatcacactacctgggttcaaaacatactacaaagctatagtaaccaaaacagcatggtactggtatgaaaacagacacacagggcagttgaacaaaatgcagaacccataaacaaatccacattagccctaactgacttttgacaaaagtgccaagaacacacttggggaaagtacaccctcttcaataaatggtgctgggaaaactggatattcatatgcagaaaataaaactaggcctctatctttcaccatataaaaatcaactcaaaatggattaaagacttaaatgtaagatccaaactataatactaccagaagaaaatataggggaaatgagtcaggacattggtttgggcaaagattttatgaacaaaacttcagaagcactggtaatgaaagcaaaaatggacaaatgggcatatatcaatctaaaattgctctgcacagcacaggaaacaaatgacaaggtaacaaccaacagaatgggagaaaatattcacaaattatccatctgaccaggagtgaataatcagaatatataaggaattcaaacaattgaatagc

SEQ ID NO: 220897 - DNA, 464 bp, Homo sapiens
aaatgattcgtatcagtgtttggcacatatggtgtgctttgaagatgattgttgttgataaaccaagtcccaggagtgtatgattttgcagaagtttatacatagctctggactgtcagaactgtgatttaaccaaggttctcttctctctcccctgcccctcttgaactgcactgcctaagaaatgttggttgcatggagacatatttttaattaaatgtaatggttcagtctttaagaaaaaattatagatcgagaccatcctggctaacatggtgaaaccccgtctctactaaaaatacaaaaaattagccgggcgaggtggcgggcacctgtagtcccagctactcaaaaggctgaggcaggagaatggcgtgaaccccggggggcggagcctgcagtgagccgagatcgcgccactgcactccaacctgggcgacagggagactccgtctcaaaaaaaa

SEQ ID NO: 220898 - DNA, 873 bp, Homo sapiens
cagtcttaaaaatcaaactttcctttctactcaccaccaaatttttttttttccaattgggggctttctcatacctactatataatgaaatacagtttcacagtctccctactctccctacctcccaccactccaatcaaaagataacataaaataatcctaaagggaggtgagaggccatttcagtctcctaagggatttaattgttagacagcaagtaaaaataccagttgtccctggggtatgttaagactgtaaacagagggagggcctgacctttctattgttgggtctaggtttacagccacatcttcatctttattcccagtaagcccaccttggtactgtaaatctccttcttcttctcttacctcagctgacatgtctggggaacgtgttcctttccccaaagatggtgtcttcctcaggcaatctgcccttcactctgaatctacccatctttccccaacagttgctagaagcacaaagaaaagactgttggtgccaagtctctggttgtgtagaggactgaagtgagatttttctgtatttcagagtagtagtgtattcattatatattcttcctgtattctccaccattaaaaaaaactgtgagaattctgtgaggaatagggtagagatttcaagtggaggttatgtgaagacataggctagagctggcttgctaccaggtatcaaataatagaaagcacttaaggtagaagctaatatcctccttcgttggattttagagtagaactaaaagagtttgatggattgatgtaatcgttcagatttaacagggatgaagtttaggattaagtttaggattaaaaagcccaattgcgtagactatgtaatggaggaagttgg

SEQ ID NO: 220899 - DNA, 611 bp, Homo sapiens
caattttgggtcctttcttttggcagctgcgatgcctgggccatctgctgtcaccatctcctgggagagatgatctcgaagagaagagcccagagaaagttcatccaaaggaagaaagttctttgttgctcccaccaaaacctcactcttcccctagacttgggctcctatcacagccttggctttgatccctgagagcctctttcctggacagtacagtgcggggagatggtgcaagcccatttcgacttcacacgcatgtgaagctgccaatgtgtgcttctgtgggaagagcagttaagagccggggttcaaatgcaagcactaccatttacaagctatgcattgaaaaactaacctcccggggctgcagtttcctactatgtaaaatggaaatcaatataaatataaatataaatgtatcatagtcatggagagcctggagtgcctgtcacattctcagtgacattcacaagtgttatccactgttactagactttgatcaaatttttaaaggggtgcccccacttccaaattcagaactctcaccacttagaggttgaaagatatcacccctgacaggtgccacagaacacccccagatgctcaga

SEQ ID NO: 220900 - DNA, 751 bp, Homo sapiens
gtattttcagtagagacgaacgaggtttcgacatgttggccaggctggtcttgaactcttggcctcaagtgatcctcccacctcggcctcccaaagtgctgggattacaggcaacttagtataatgtttctatttgttgtttttatcagtacttcgttcctttttgtggcccggtaatactctgttgtatggatatactacattttgtttatccattcatcaattaatggacacatatttctagtttttggctattatgaaggaaggagattttgatggcaggatagatggcatgagaaccagctgctgtggggaatgggaggggtgaaaggattacaaaactgctgagtttagaaacatgaattggattggtgacagtcggcacagttgtgttcttttctggagcagtactcagcagcctgcatgtaggaatgtagaaggtaagtggttggattgatcctagttctgctattatatagagaaaaccaaggctgaggtcattttagtgacttcacaaatgtagagaagtcagctgggcagggtaactcaccctgtaatccaagcactttgggaggctgaggcagaaggattgcttgagcccagcagttcgagaccagtctgagcaacatagtgagactctgtctctactaaaaataaaaataaaaaaaatagctgggcatggtggcatgcaggctactcaggaagctgaggcgggagaatcccttgattctgggagatagaggctgcagtg

SEQ ID NO: 220901 - DNA, 676 bp, Homo sapiens
gtattttcagtagagacgaacgaggtttcgacatgttggccaggctggtcttgaactcttggcctcaagtgatcctcccacctcggcctcccaaagtgctgggattacaggcaacttagtataatgtttctatttgttgtttttatcagtacttcgttcctttttgtggcccggtaatactctgttgtatggatatactacattttgtttatccattcatcaattaatggacacatatttctagtttttggctattatgaaggaaggagattttgatggcaggatagatggcatgagaaccagctgctgtggggaatgggaggggtgaaaggattacaaaactgctgagtttagaaacatgaattggattggtgacagtcggcacagttgtgttcttttctggagcagtactcagcagcctgcatgtaggaatgtagaaggtaagtggttggattgatcctagttctgctattatatagagaaaaccaaggctgaggtcattttagtgacttcacaaatgtagagaagtcagctgggattacaggcaacttagtataatgtttctatttgttgtttttatcagtacttcgttcctttttgtggcccggtaatactctgttgtatggatatactacattttgtttatccattcatcaattgatgagacagcatatac

SEQ ID NO: 220902 - DNA, 421 bp, Homo sapiens
tgtggcccctcctctagaaaatggagggcttttgttagatgtcccacccaattttatttgttgtgtgcacttgatgtcttaatttctcagtgttcattaaacaagccatttcaatatgtcaaccccatggcggcttctgtggcccctcagttgtcactggagacctgacaaattagttttcttattctgcaaagaaaatggggtaatgtcatgaaagatatcttttttttttttcagtaaagaaatacccctgatgaagttaagggaggaaaaaaaacacttctgccaagtgacagctgtggaagttctgggttgaggtgtgcttttttagaggctgtgagaaagtatggttgtttgcatgattatgccaaggttttcaaggtttctatagtgttggattttctacttcaagactacaggt

SEQ ID NO: 220903 - DNA, 360 bp, Homo sapiens
tatttttagatgataccattcaaatttttgttttgcgtgtggttgcataaacagctttagaaaggaagagaacattttaatagaatctgacttttgttccccatttcccctaggacatttagctcatttagaagttattcagtatctagttttcactggtttgaagcttttgaataaaattgtatatcccaaagagagaggaaagattagacacaaatcctgcatttagaacggtgcttaaatataattctgtgtcacttgacatttagtttgctgaagggtaagactttgtcttcatctttctgaaaatagatactgtgttctactgtttctgtttttaaataaaattgtggttctaca

SEQ ID NO: 220904 - DNA, 433 bp, Homo sapiens
atactgcttctgtgaacacacaggacaacagactgtcttccgcagtcatacactcagtcatattctcaaataggtatacagttcaaatgtataaatcagtagtcttacatgttacagagtgggtggatgttcctttgccaggggattaaaaaaaaaaaaatcccaagtcttaatactgctttctcccacacgaatagtctatgatggtgtatttttggattttgtacatgtttatagtttttttcttttcacaattttgaataaactgttgactagcttgagtatggtaagcctctacttaaaatgtaaattttgctatttttggtgcatttaatattttaatatttgtcttaattgtgttaattttcagagctgtgtttatcaccagatttagtatgttaacttttcaatgttcccacttattaaaaaaaat

SEQ ID NO: 220905 - DNA, 547 bp, Homo sapiens
gtcatcaggaatgccacatccttttcaccaattaggcttgtcatactgatgaataagtcttttatgacgttggagatcctgaaagctttgatgtaactttaaaacatgcctgtgaatgtgcaaaaagttaggatccatgaagtttctgtttgctaaagacaggtatgtcaaagacagcagctgtataagctattaagctgatttcgtagtgaaagggaaagaccacctacttacagcagtgagaagacaattaattctttttatagattttcagatactgtaaatcttagttttaaatgggtgaataccaatttgttacttttttcagcccgtcagacattgaagtggcacttaagggcggctatttgaaagagacgatttttgatgttttctcagtaatttttagctcagttggatcagagttaccagttgatctactgtgggcaatttcacttggaacacagaaacaacaaacaggtacaaccttgtgtattaataaccaggacaatgggataactgctatcctttaccagagttgggagtacag

SEQ ID NO: 220906 - DNA, 612 bp, Homo sapiens
aactgtgtgtcaaatgctgttgcaactctcttttccttaaagtttgttagcaggaatttcatttctcttagttatagcttaaccttctagtcatcataggaatttgacatgatcttgggacagcaggctgtgaataaggtggcccctaaaagcttttctacagcttgtaattaccctggacttactgaaactataggagttcttttagggcttttgtagggatttaaaaatggtaataaaggaattgttgaacttgtgtgtaacactgagctcatggttcaaaacagcaaattgtgaacctttaggttgcaaggccagagctaagaacacaaatctctagagttagggaaattatgtactgattgagatacagggtccaaacttgaaggcaagcctcacagttgagtaacacttctttctggccctaccaccttcttaattggcttctaacaggaagcttaacctctgcttaaagagccacttcactgcccaactccaggaggagacagtgtggtttgagagtggtccccactgaagttgccgtgcacagccttgggccatttgtagcagccctgctagtattcagcttgcttctctactgaaccctggcat

SEQ ID NO: 220907 - DNA, 455 bp, Homo sapiens
ccaaaaaagagttatctgggcctgactatcaacagtgctttacacaaaggagttagggtgctctatcatacaactatctgatgattcttttgcttaaactgattctaccccatttcttatggctgcgtgccacactcacctttagtagatcagaattccttgcctagagcggctggctgctcttgactttgtgttgctgtttctagctttttcatgttttgctcagtggtagggacaggcaggccaatttagtagagcttgacaaagtgaagcctggtatcttctatgaggctataaacgttgtctaaagacgcaatttctggttctgataaggctcctggtaattcctggactggaagacttggctgtcattgttttgctgttaagtaccccttccactcaaatgcaaaagtaaaacacacacatgccaccatccttcccaaccaaaccaaaac

SEQ ID NO: 220908 - DNA, 437 bp, Homo sapiens
atctttttgaagaacattcagaggaatattttgaagccaattgaggcctgcagtggaaaaccaaatatcttatcataaaaacttgaaagaagttatctctgaaaatgctttgtgatgtgttcattcgtctgacagagataaacctttattttgattcagcaggttggaaacactctttttgtagaatctgggaaggaacatttctgagcccattgaggcctatagagaaaaatctaatatcctgtgataaaatctagaaacaaaatatctgtgaaaatgttttatgatgtgggaattcatctatcagagataaaactttttttgattcagcaggttggaaaaactctttgtagaatctataaagggatatttcagaacccattgaggcctactgtggaaaattgaatattctgcaataaaatctagaaacaagctat

SEQ ID NO: 220909 - DNA, 429 bp, Homo sapiens
ctcacctgattatgtgattgagtcctgggaccagtggggccagtgaccaacctcacagcatatgactgtccacccaccagtctctgctgccttctgagagccacagcaaccctgggggaaaggcaaactcatcaccctggggcccagagacctttgccttgtctgttttggatgggcagctggtcatcctctcaagcatagtgcggtatcagaaagaaaagtgaagtgataaagaatttatttcccaggtaaaatcaccaggcttctggctacatgtcaatatatttcaaaatccaaactaactcattggaagggtgggggaaaagagaggttgagagaggtttggcatattttggaatattcctttggaattttggaacatattttatttctgaataaagcaaactgtagtcttccaaaaacacatat

SEQ ID NO: 220910 - DNA, 328 bp, Homo sapiens
tgagaaggaggcaagtcagtgacgtggggaattattatgcacagttcatttccttataatttaactctcagagtaacaaaagcataatgtatagcctagttttcgggtctgatttacaacagtttaaactaaaagatgatttctgcctcacccaccccccttctaatcacttctgctatcagcaacggagaattttgtatttcatcacgcgctgcgtcctcctagggacacagatctgagaagaggaaattttaaaacagggttcctgcagcagagatggatgcaaattttcactttctgcttcaaatttcattatggccttgctagt

SEQ ID NO: 220911 - DNA, 219 bp, Homo sapiens
ttattattatatgatacctaatgtttaactgatattttaagccatgtaaacaaagaatacttctgaatgtttcactaaatttcttgagtttttttttttaacttaacctcactaggcctcaatattcagaatgtgaaacaggggagttggattggtgattgctgatatttttttccagctgtaaaataaaggcaatgggtccatttaacctttacgatt

SEQ ID NO: 220912 - DNA, 351 bp, Homo sapiens
atgtacctgtgacaatatagtttcttgaccacatttatttatcgtgagttattatgtagtgacagatattaacttaaggaatgacatgcttaatatgtttgccacaattccatacattgatgaggatgctgcttttctgactaaggagaatttttgttcatctaagaacatctcccctggagagtgagagcccaagtcggctctgccttaaattcatgatctgattttatgagggtcacccagaacccactgtgcccttaacactgaagcctaggagaagcctgggctccttcaaggggaagaaagatgggcctgaccatcctatggtgggtgataacaataaagtgctca

SEQ ID NO: 220913 - DNA, 508 bp, Homo sapiens
tgaggtcagacgggcccttgggctcccgggcaggagcacccggcctcccagctccagaagctgcgcctcctccagctcgcctgcccccacgctgcccagtgactctcaggaggagaggagctgatgttcctgcacccatgatgaggaaatcaagactcggaatgtcctggtccctttccacaaggcctcgccttatccgctcccacaaagggcttacctcttcaggaggatctggccccatggtcagagaagtgagtgaatatcagctgtggggcacccagagcagttgccatcttctgctctgtctagcctgggagtcctggaaggagactgcagcctgagtgcctcccgagccagctcctctccaggacatcaccttggcccctgggtgtcccaacagacagtcagcacacaaaggttacctgatgcccaggtaggaactgcagctatttttaaactgagatttcctacaaattaaaattgctttgagtatgtgtgaaaaaaaaaa

SEQ ID NO: 220914 - DNA, 439 bp, Homo sapiens
gataccagccagcatgcttgtagtcccagctactctggaggctgaagtgggaggattgcttgagcccaggaatttaaggctgccgtgagctattatcgcacctgtgcatagccactgcgctccagcttgggtagcagagcgagaccttgtttaaaaaaaatgataataatgagatatcatacattctttgattttgtactaagtcattgaaatccagtctgtatttacattcacggaatgaatgaataactcatttctcgaatcgtttttgtatgttagccgaataggaaatttggcttgattaaaaagttgttatcatggcaaaatgatcccttctccctttaatacttaaccacagacctgacccatgtaaagaggagcagcccgcgcacacagctgttcagctctcagttttcttctccccctctaacctcaagtt

SEQ ID NO: 220915 - DNA, 127 bp, Homo sapiens
gagagagatgaaataggtcaagttgaaacgtcacacagctgtctattcttacctagatttgatcctttttcttaaacaaatgctcttcaaattgttggaggctgtattagtctgttctcccattgct

SEQ ID NO: 220916 - DNA, 512 bp, Homo sapiens
gggctgaggttggttactatggcaacattctcaaaactgcaacaatcccattacggatgctaaaactatagtcatttcagtgggagggtagcatggggagtgggtggtagtctttttatttttattttattttttttaaaaaaacctctcccacttccaaatcttttgcattcatttattttaagctttgcagcttagggtactaaaatgagaaacaaaaagtaaaaaagagtgtcatgtctctctccattaaatttctgtagtcctttatcagctccctttgtggggatacccagttttctacctactcttttattcatttatgctttcagttattccccaaactttcattgagacctgtgttatgggtgaataagagaatccttgttcttgtttctccttttaaattataaattctttgaagccattaattcacttcactgtaattcatttaaacaaatacttattgagcaatttgctttgtatcaagaatcatacttgcataagaagac

SEQ ID NO: 220917 - DNA, 463 bp, Homo sapiens
acgtagaaagtattagtgtgttaacatgtactgaggggtcgctgaattccagacactgcagaatgccttctccacattagtttacttcactcttcacaaccctctatgaggtatttcactcctatttgacagatgagaaaactgaggctcagagaggttaataatctgcctaagaccacacagcaaggaaatggcagaatccagacttaaatccaggtccatctggttcaagagttcatgcgtttagccagtatcctgtggaggtcacatcagcctttagtttctaattgttcaataactcccctgagtctccaaaaaggactgcaaactctgtggcctggcatcaaagtcctcctcgtattttctgctacaatttcccacaaatgtccttcggccgcctagattcctgccatggtgaaggactaatttgtcctgaaaacatcgtacactttctctcctctga

SEQ ID NO: 220918 - DNA, 450 bp, Homo sapiens
caaaactgttaaatcaactttgccgatttcccttgggaatccctggaggccactctaagtggtaatcccaagtttaagaaggaaatggggaaattttgctgagagtaaagatgtcgccgaactttttgaagggatttgcttcattcattcatttagtcattcaacagacacctgttgaacccgactgggtgcagaggggccagtcacaggacttattccagatgaacttttcttttgaaattagaatgcccttgtggaagccaaaggaggagcagaggcctaaaataatgtcaagtgtcaaagcaaaaagaagtgccattggctactacagtgtgtgatgataacaagagaggtgcgaattaggaattaaaaacgtttgaaaaactacaggccatatgctttgaaaccagccactttttccatctttcatctccctctcccctccggttt

SEQ ID NO: 220919 - DNA, 782 bp, Homo sapiens
cgcgtggcccaggcagcagccctggctcacagcagccgggtggttaattttctccatcatgcttctggtctgatggttctttcctccctatactaactcggatgagctggaaactgctgttgaggaacctggggagactttactagaagagtacctggcactggggtttcccaggcgcccttcatagcacctcccacagtctgggctttcatggggctgcgtgtctgcagctcctcagggcggggcagcctgctctgccccgcgccggccccctggcagctgtactgtgggtgcaggcaccccacgtctagcatcatgcctggtattggggagggtgctacgtaaatctatactcaagggctcctcagagttacaaagtgagcaggtctctgtggggaatgggtggtggatgctggaagaggctggagagcttggagcctgctgccctccaggggccagggggagatgcggtggtgggggaagactgtgaatggccacagctggatagactcggtgaaaagctgtgtgattccactcataggagggccctggaggtgtcagattcatagaggcagaaagcagaatggcggaggccaggggctgggggaggaaagaggagtgcatgttttgtggggacagagtttcagtctgggaagatggcgtcgctctggggtgagtggtgatggttgcacggcagtctaagtgcgctcaccgcccctgagctgtgcgctcacagggattaaaaaggtcaattcgatgttgtgtatatttgatcacaataa

SEQ ID NO: 220920 - DNA, 1260 bp, Homo sapiens
ggttcaagcaattctcgtgcttcagcctcctgagtagctgagattacagccatgcatcaccacggccaggtaatttttgtatttttagtaaagacagggtttcaccatgttgaccaggctggtcttgaactgcttgactcaagcaatctgcccgcctcagcctcccaaagtgctgggattacaggcctgaatcaccacgcctggcctatctttctctttttaaaattactttggtgcctgatacatggcagcactcagaagtctgcagaaggactgacttgctggacaactgaccgccagccctgtgaagagcagtaacagcagccacctgggcagtgtccattgaaagttcaaggaaggttcccttgccattcgcacatacacacactcacaaactcacacacttcttttatatgcttaacaatttaaaatctctcaatgggccaagatttttttctacaactactgagagcgctgatggtgcaaatatccaagggagaggtatcacactaccaccgaagttagagaaactcttttccctccttctagacccttacccttcaatctatcataatttggcttcaggctctaataatccactgaaattgatctggcgaaggccactgttttggacttcttgaattttgtaccatgtgtaagtattatgtattcaaaaagagttgcatttaaaagttctgaagagaaagtgctctgggcagtcaggtggttctgccatgacttgctgggtagctgtctgtgcctcagttttcttctctctaaaaaatgagacggctcaagatcaccatttgagatcacatccagctctgaaaaaagttatgttctgtgtcttctgtttaagaaaatagaaaatgcaaataaaaaaagaatgacgtatacacggctcagtatgcatcttaaagaatctgctcttccccaagggagacctccgagattgggcggggccaaagcccttttcgccatgaaaatagtgaactggaaaccgatttggtgtgaaatattttgaaaaggccgggtgtgatggctcacacctgtaatcccagcactttgcgaggctgagacaggcggatcatttgaggtcaggagttcgagaccagcctggtcaacatggtgaaaccctgtctctactaaaaatacaaaaattggctgggcatggtggtgggagcctgtaatcctagcttctcgggaggctgaggcaggagaattgcttgaacccaggaggcagaggttgcagtgagctga

SEQ ID NO: 220921 - DNA, 327 bp, Homo sapiens
tgcatttccgaggcttgaacaagttaaggcaatgggaaaggtcacacaatgagaaaatgcagggccaggatttaacccgtctgagatgttctgactgtgctatgctgcctccccggacatgagctctgcgataatgctgtccccaggctgtaatcattccctctttcatccctgcctcctctatccctggggtcagagggacttgtagttgaatctctcactcactcattggtgtggtctctccctaaagcagggtggagtttgtcttagcgttatcactgcatccagcctggcgaaagagtgagactccatctcatataaataaat

SEQ ID NO: 220922 - DNA, 506 bp, Homo sapiens
gatccccagactgtcgacaggttggctccgtggccgcacactcctggaagatgggacattcaaggttcgagtggcgacccgaaaccctaggaagaaggcagcaaatggctgaggtggggctggggctgagaacctgatccctgagaggccatttattgtaagaacaggcaacatggcagggaagtgaccaggaactaggacaggcagtaagtgggagagaatgacggcaagcctggagctgtcccagaggtgactgacggatgctgtacaaggtggaatattttgataatgtgagattccaagcttgaggctttagggaggaggaaggagaagcagtctacaggtgactgtgaggagtcggggagagcgcagccctcattggaaagggcagcagggagcgggttgtctggggcggggcagtgggacatggtgtcctccgaagtgcctgcctagctcagtgccaggcacacagcaggcacacagacaaccaaactgcaaggaacaca

SEQ ID NO: 220923 - DNA, 604 bp, Homo sapiens
tgtctgttttgttttccccccatcaacctcttctgaccagacttacccagaaaacatctttcccctgtgtggagccagttggtacagaaatttcattatcagtcccttatcaggttgaccgtgagccccaccccagggtggcactgtgagtcacctgggaagaaaggcctccgggcaggagggcaggtggttattcctgcttctccaggaaccaacccaaaggcagcaaggtccagtcctacgacataaagcaattcctctattaaagcggggaacgagaccatgtacaaagtctaggttaagagcgaaggacacttctcagggccttagtttgctcatctataaaatgaaggtgttggaaggttctccaaacccctggcagggctgcagccctgattctctggattttaaaggctctgtggccagactgggggaggggaggacctctctgtgcccgaggcctgagcccagtctgatgctatgagatcatctctgacagcccgttaggcacggctggccacttctccaatatgaaggctgccccactttcagcttcactatttgagtttcactatttggaatgcttacctagagccagaaaatg

SEQ ID NO: 220924 - DNA, 560 bp, Homo sapiens
cggagaagatcttttttatattcagccatgccaattgacctactaccctctccatagccaaaggaatgcccaaatttccacagaaaggcatttttatatgaagaagctcatccctgtggacctttctcttgaatgcctactatgagtcactcagcaagagaggcacccagctccctcaaggtctgcagtgcctcggaggcccacttccctccatgaaacagtctctgaacatattattcctcacggatgatcaccttcttaactccatccagatgtgtgcctctgtctcactatttagcgtcgtcctagaaaatactgagtaattgtttcatgcgtatacatcatgtttcctcaagtagaatctacctttatacaatcaaaagtgtcagattgatggatgagtagcaggtaaatttctgataaagagaattaaattaagtgttaattgtagaatctagtgatgggtttatgggtcttaactgtaaaaatctttcatcttttctgtatgtttgataactttcatataaaaataataaaaactttagtttatcttcatgtaa

SEQ ID NO: 220925 - DNA, 359 bp, Homo sapiens
  misc_feature (55)..(55): n is a, c, g, or t
  misc_feature (101)..(101): n is a, c, g, or t
gctttcatcccccaggctcctgtgcacacaaaggattagagctgcctctacttanagtcaattagagataaggagaagctgacatttcgacaaccctaccntatccactgctgaaaacagctcagattaaaataatccagtgaggatttgatctccatcagccagagggaatcacatctcgccatggatatgatgacttctgccctgccaaagccaaggttgatctcaggtctctcgtcctccaccctgcactcaggcaacaaaagcattcgatcagatgctgtgttacacagctctgatgtgccgggctggtcctgggtgccaaggatacatctatctgtcaataaacaagggaggca

SEQ ID NO: 220926 - DNA, 452 bp, Homo sapiens
cggagaagatcttttttatattcagccatgccaattgacctactaccctctccatagccaaaggaatgcccaaatttccacagaaaggcatttttatatgaagaagctcatccctgtggacctttctcttgaatgcctactatgagtcactcagcaagagaggcacccagctccctcaaggtctgcagtgcctcggaggtattcatactgagctttcatcccccagaatccagtgaggatttgatctccatcagccagagggaatcacatctcgccatggatatgatgacttctgccctgccaaagccaaggttgatctcaggtctctcgtcctccaccctgcactcaggcaacaaaagcattcgatcagatgctgtgttacacagctctgatgtgccgggctggtcctgggtgccaaggatacatctatctgtcaataaacaagggaggca

SEQ ID NO: 220927 - DNA, 1085 bp, Homo sapiens
ggacctgggtgttggcggctgcagcctctgggatgaccctgctcgcttcatcgtggtgcccgcggcctatgccttggcactgggcctggggctgccagccaacgtggcggccctggcaatgttcatccgcagcggcgggcgcctgggccaggccctgcttctctacctgttcaacctggctctggttgatgagttcttcacgctcacgctgcagctgtggctcacctactacctgggcctggcccggaggccgcctgccacgcggccggggccacctactacgtgtccacctatgcggcggtggtcttcgccgcgctcatcagcgtgtgccgctgcggcttcgtacgcggtcccgggcccagggcggctgcccgcctggcccggtgcctacggcgccccgcgcgcgctgcctgcgccttcgcctggctggcgggcctggcccctccctgcctggagcaccgctgggcaagctcggggctggcctccgccacggtggccttcgcggccgccttcctgctggtgctcgcggccaacgtgagcctggcgcgggcgctcaaggcgccctctggcccgggcccgggccctgcaaccgccggcgcgcaccggcgcgcggccaagaccatggtcctggggttcctgctggtcttcgccctcagtctggcgcccaaccacctgctgctggcgccctaggtggctgggggggaagacaacggagaccggtgtcgcgccgcctccacgctcgacatcctgcacaccctcagcctggcgctgctgagcctcaacagctgcctggacccactcatctgctgcttcttcgtgcgcctcttccaccaggactgctgctgggcactgagctgccgcctggtgaagggggcgcccagggcgcatggggcctccttggcctcctcttggagagtctcctggcctcccctcctgtctcacccccctgtcaccctcccagtggcatccagggtggagaaagctctttggaaagacctagattctaatcctgacgcaaccacatactacccctgtagctgtgaacctccgggctcatctgtaccaaggacatagaacattctttg

SEQ ID NO: 220928 - DNA, 448 bp, Homo sapiens
gcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatccggccagacacagtagcacacgcctgtaatcccagcactctgggaggctgatgtgggtggatcacttgagcctaggagtttgaaatcagcctgggcaacgtggcgaaaccccgtctctacaaaaaatgcaaaagtttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaa

SEQ ID NO: 220929 - DNA, 505 bp, Homo sapiens
  misc_feature (6)..(6): n is a, c, g, or t
caacgntggtctcagctatgggattcccacgtactacacaatagtaggtgggaatcccataggtgaggtcatcagagaaggctcctccagggaggtggggctgaaggtgtttgatgggcagggagatgtccatcttcgctagatggagtagcgttcatgaaggtcctaaggctgggaacgcttggcatgttgagggacttaaagaaggccgaccttgcaacagtgcaaagtgcccagcaaggaggagatgggcacaaggtagggttatggggattactgagactcagagcatgtgggtcactaaagaccatggaaaagagtttgcattttgttactccaggcctaagagaaagccattaaagacgacttcttaaaagacaaccctgacccaggctggagtgcagtggtgcaatcatggctcactgcagtcttaaagtcttgggctcaagtgatcctcctgcctcagcctcccaagaagctgggactacaggcacacaatcatact

SEQ ID NO: 220930 - DNA, 963 bp, Homo sapiens
tcggtacccacctcctaccccacgcaaacaaggctcttattttttttttttttttcatactgagtctcactctatcgcccaggctggagtgcaatggtgtgatcttggctcactgcaaactccgcctccctggtttaagcgattctcctgcctcagcctcccgagtagctggattacaggcatgagctatgaggcctggcaaatttttgtatttttggtagagacagggtttcaccgtgttggccaggctggactcaaactcctgatctcaagtgatccgcggcctcggcctcccgaagtgttgggattacaggcgtgagacaccgtgtttggcctagatacagacttaactgctgtttgagcagctactgtgtgctggacactggatacgaagtacccagtggtgaataaagattctccgccctctgggactttctttgttgggtggagatgagatttagtgttctgaaggaaccaggaacccacaggtactacacaatagtaggtgggaatcccataggtgaggtcatcagagaaggctcctccagggaggtggggctgaaggtgtttgatgggcagggagatgtccatcttcgctagatggagtagcgttcatgaaggtcctaaggctgggaacgcttggcatgttgagggacttaaagaaggccgaccttgcaacagtgcaaagtgcccagcaaggaggagatgggcacaaggtagggttatggggattactgagactcagagcatgtgggtcactaaagaccatggaaaagagtttgcattttgttactccaggcctaagagaaagccattaaagacgacttcttaaaagacaaccctgacccaggctggagtgcagtggtgcaatcatggctcactgcagtcttaaagtcttgggctcaagtgatcctcctgcctcagcctcccaagaagctgggactacaggcacacaatcatact

SEQ ID NO: 220931 - DNA, 346 bp, Homo sapiens
tgggaggtcaaggctgcagtaagccgagatagtgccagtgcactccagcctgggtgatagggtgagactgtgtctcacaaaaaaaaaaacaaaaacaaaaaactttgatataaagtaaattgctgccacacataaacacaatagaaagacactgtcaaatatgcaaggattcaggaaaaatattataaaaatgctccttaaaaaaatctactcacaatccacttaactaaagattttttttttcaaaactatacaaataaggaggctaaactattaaaatgcagtcaataagtactgaatccacagaaaaacagaccaaagactaaaaactgtggtaattacaatt

SEQ ID NO: 220932 - DNA, 370 bp, Homo sapiens
gcggagacaggtggatcatttcaggtcaggagttcgagaccagcctggccaacatggtgaaaccccgtctctactaaaaatacaaaaattagccagctggtagtggtgcatgcctataatcccagctactcggaaggctgaggcagaagaattgcttgagcctgggagatggaggttgcagtgagccaagatcatgccactgcactccagactgggcgacagagtcagaccctgtctcaatcaatcactcaatcaatggaatttcacacctgctagatgtgaaataggatggcgatcatgagaaagacaggcaatgcaaaactattcacaatagccaataggtggatgcaacccaagtattcatcaacag

SEQ ID NO: 220933 - DNA, 433 bp, Homo sapiens
tgaaaacagaattggggaaatggaaagtgaagaaatcctagctgtcaggaacaagagaagaatgacaggaaacctgctactgagatatggaggtattcctcttgagttttcacatatggcattctctcatgcccaggaacctgctcttcactaaaccacacaccttcctctaactcagtcacaactaagcttctatctgcacactgctaatgctgtaactgttttgttgttggttctgattagttgccctctcaaccataagcagcctgtcaacaagacctggctccatccttgtcacttccccatagcacttaattcagtattttttccccaaggtagatagttgtgaggcagcatccctcaaaatatctagtaacataatgacatccagtaaatgttcccttaattatttactgcccttaagctttatgca

SEQ ID NO: 220934 - DNA, 185 bp, Homo sapiens
aaatgtcgaggctaatctagtacaacaggcttcccagtgcactagtgtggcagaatttttttcgtgtgtatacagagtctggctttgtcacccaggctgaagtgcagtggcatgatctcagctcactgcaacctccaccacccaggttcaagcgattctcctgcctcagtctcctgagtagctgg

SEQ ID NO: 220935 - DNA, 610 bp, Homo sapiens
aggaactccaatgaggcatataaagttggtagaatgttgaatctctatttaaaagtgtgaagaacttttccaatgataacaactaatcttattggggcacaggaaaagatcgtttgtccaatcagtaatcacagttaccaactgccatcctatgatcttaccatagttgttcctccacattctaggctgttgatactgtgcagtcccagctcttccattcactcaatctgtgagttaggacatgctatttcatctctctgagtctcatttcatcatcaagaaaatagaaacaataacctgacaggtttgctttgaagattacagcattcattctgagaatgaaataatatgtgaaagtgctctgtcaatgtagagtgacactctaactttatgttaacactgatattaattgttcatgatgtgagttttaaattaggatgctgttttcagttctcaatgagacagatgttctacatgggttacagtgataaatcctggatttttgcacactaagccagtatacatgccaaatttcatattagtgcttaccttgggaggtttccttaatgatgggaaaaaaaaaattcagcagcagggatacagagggttg

SEQ ID NO: 220936 - DNA, 331 bp, Homo sapiens
atcacgccactgcactccagcctgggagaaaaagcaagaccccgtctcaataaataaatcaaataaagaaattaagaacaaaaacaacaaaatataattctaagccaaaaccataaatgtatattgttacacattccacagaaatatgaactcttctcatttttacatttaaaaaaaagtgacaggtaacattgtatgtatttaccatgtgcaacataatgttttgaagtatacgtacattgtgggataaattaaatgtagctaattagcaaatgcgtgacctcaaatagttatcatttttgtggagaatgcatttgtccactcagcattt

SEQ ID NO: 220937 - DNA, 251 bp, Homo sapiens
tgtgggcagagttgggctattttggtaatccttgagtaggcagatggaatttgaggccatcttcttgggtacatagatcactaggaagctataggtctagcaactgtggattagggctgggctgagaattgtttcatgttttttgtgactgtatagctagagactctcttgtttgcagagagacactctgaactccccctggccgtcaagggaaagactgccttcaccctcctgagctgaccttacactga

SEQ ID NO: 220938 - DNA, 322 bp, Homo sapiens
attctgttactgatttgctgtaattctttaagagatttcttattgctagaatttagattgttgataatttttgcctatttgtaaacagcactgtgttgcattctatactctatacaaactctatacaaacttcttttgtatagaggatttttgtgagtttagtgtcattggcctatactttctgaagcattcttttgagattaatttagtaaattaactaatttcataaattgcagaccaaaaataatttggaatactagggcaaaaatcttttcagttgttaactcttttaaaaatctgaattaaaagtcatattaattta

SEQ ID NO: 220939 - DNA, 419 bp, Homo sapiens
attacacttgcctatttcatatccctttttcatgccttgtctgaactatttctagcagctctgttacaattttcctttttcagtgttttcttctgccaatatcagagttatccttagaaaattacctcttcatggccaggcatggtggctcacgcttgtaatcccagcactttgggaggccgaggcaggtggatctcctgaggtcaggagttcgagaccagcctggccaacatggcgaaaccccatctctactaaaaatatacaaataaaattagctgggtgtggtggcagtcgactgtagtcccagcagctcaggaggctgaggcaggagaacccaggaggcagaggttgcagtgagctgagattgtgccattgcattccagcctgggcaacaagagtgaaactccttctcaaaagaa

SEQ ID NO: 220940 - DNA, 388 bp, Homo sapiens
tccctgagcatggtagacaccaaatataggatggctgaaaggattgggctggtttgctgttgaacccttagaggatcaatataggttgagtatcctttatctgaaatggttgggaatttggattttgaattttttcagattttgaattgtgtttttttttaatttttattttttgattttggaatataagtatcccaaatctgaaatgctccaataaacattcatcatgttggcactcaaaaagtttcagattttggagcatttcggactttggatttggggatttgggatgctcaacctgccctgtattaaactgaagatgctgaatcaatttattattcaagtgcttgtttgtctaagaagctgctaagaggaagccaaagacaaa

SEQ ID NO: 220941 - DNA, 535 bp, Homo sapiens
aaacatgtcgagctcacctgaggaagtgatgtgcaatacaagactcctgcggggtcactgcccgtcacctctgagacagcattcccggctgtcataatgcattgccggtgaccatctcattaaagctgcatggttggctggcatggtggctcatgccttgtaatctcggcctcccagggtgctgggattacaggtgtgagccaccaggcctgggcaggaaagccacttaaaaaactcaagagaggcaggttcacatttagaggcaacacatagtacaatttaatgcaatgacttaacgcaggtggattagatcatatagtaagagtaaatgcttcttccaaggcaaccttaggagaaaaaaatttaacatagtccccctgccaaggtagcgaaggaagaagggtgagatctctgcaagaaatgctgatgaatccacgtcagggcatttttagtcagaaatggtatcctctggtatgacatcagaagagtttaagactccataatctgtatgtcagcaaaccagtcattagtcaga

SEQ ID NO: 220942 - DNA, 532 bp, Homo sapiens
ttccttgctctttgaagtgtttgttttgagagctgttacttacctaaggcataacttgtagctcttggtctcttgcctgattactattatatcaagttaacatttttgagagagctctagccctctcagatacctttatcttgttgccatttagtgagacattccagtgtgttgtgtgtcttacattttatctaggttactctaagcactgcattagtgcttgtttatgaggaagcagctaacaccttccagatggctgttagctcagacttgattcaattcttcaggaaattgtcattatggctttaattcagtagactgcgctgtagctttgaacttatgaattcctatacacacacacacacacacccaagtagctgggactatgggtgcacatcaccatgcctggctgatttttgtattttttgtggagacggggtctcactttgttgtctgggctgaggtaggaggatcacttaagtgcaggagttccagaccaacctgggcaacatagtgagactgtctgtttttt

SEQ ID NO: 220943 - DNA, 594 bp, Homo sapiens
tatgggtcatgcctttgaaggttgtgaaatcaaattagcaggttgtgaccaggaactgctttaaataattaaaatgcatggaatggaatggaatggaagacattaacgtgtatcatacatggtaagagtgagtatttgagaaattggtttcaataatgtgtgtgtgtgtgtgtgtgtgtgtactgcgacacaaagaaacatattttggactgtgagttgtggtcaaaatagccttaaaataattgaactaagccagaggcattcctatctcctttatcagacactcactttcccagcctttcttgcagttagagtaaccacagttgtgcaaatagtaaaaactgaagtgtacagacaggttctgctcagtgagactttcagggaaagttttccttccagaatacaaagacagagtttctccagaaagacagtcttttgctcctgcttccagttttgaatacagttgagatgactagagctgtggcagccattttgcaaccacgggacaacaaacctgaggctgaaaagcccaccagcagaggatggttgatgggagctgacaaaaagaccgtgttcttttttttcttttgagac

SEQ ID NO: 220944 - DNA, 444 bp, Homo sapiens
tggaaacaattctgctgagatacaatcttgtctcagcttcactttctctgctatttattatgaagtgctatgtgctcaaaaataggggctgagttttaaagtcacaggccaagctctgggctctgaaccgaggagacagcttgggcccggttatctgccctagagaggaagggtcttaagcaaagcggctcatctgtgactcgggatacctcattcttccaactcctgggacgtaggccccagtcatccctgaaagcctttgtacagtgaatgacctctgtaccagaggggtccccaaggctggagcagagaaaagccccaaaggagagactctccaggtctctccaggttgctgagtgagcctcctcccttgacttgctttctctgtttctctgtgactttctcttccttttactcctgccccatgccctgtgtggtgctatc

SEQ ID NO: 220945 - DNA, 371 bp, Homo sapiens
gcaaaaagcccggggtcggggacgccagccaaacgcaacctccacgcagagcccaagacttgcggagctctgctcccctcctcccgcctccctccctccctccgcttttctgttgttgctgctgtggcagacaaatgtgatgtggggcgcagggaattgccactgtcacaggcggcgtctgcgtctccctcgcccgccctcgctcactctcgaggaaggcgacgcatttatctgcagggcggccgggcgtccgccggggagcaggagcgccgcgcgctgtgcgccgagagcgcccgcatcaggccggctccggcgcacgctcgcgccaggggcgccgcggccggtcgggagggaggcggctgcgcggccgc

SEQ ID NO: 220946 - DNA, 430 bp, Homo sapiens
gctcaggctggtcttgaacttctgggctcaagggatccttccactgcagcctcccaaagtgctggcattataggtgtgagccaccatgcctgcccacaaatgattatttatggcttttaactcagaagacattcatagaacaaggtgacattgctgttacaaaactcttgttcccatcttcctatttatgtgaactttttttgtgcttaaatctctacaaatgaaaaatagaaatataattgatgtggatccctgtcttgtttagcaataattaatattattttacatcggggggaaagcctcatctcattaaagaggtacttccaataacattttactgtttatttttaataattgtaggaagttgcaatgtatttatgttgttttcatccattataatgattgctcaatccagatgattaaaaaaaaa

SEQ ID NO: 220947 - DNA, 450 bp, Homo sapiens
cagctctgtaggccttgggaaaacattttatggtcatatggggctctttggcatgaagatgggcccctggtcatgttggcaaggatactgacaaataccctcccacttctctgtaggtagcaggcatgtctaaaggccctacaaacaagttttaaaaccaagtttaagtagtgacttgccaattcttgtctatttagggacaatgatctattttgctgattaagaagagtgcttttccttctattctgtttgtcagcctttggaccaattgctgctctgtggcaacagtcccaagggcaggcaggaaggaagattttaaggcgacgctgggcattctagaagcacctaactctgctttgtctgagcatctgaccgcagggttctccaaaatgcagaaggccttcttgccttagagccccttaggtccacccagatggcaaaaaaaaaaaa

SEQ ID NO: 220948 - DNA, 431 bp, Homo sapiens
agtaggtgagtggtggccaggggctgcgggaggcaggaaggagggcatgactgctactgggtacaaggtttttttttagagtaataagaatgttctcccagcctgggcaacatggtcaaaccctgtctctactgaaaatacaaaaattagccaggcgtggtggtgggtgcctgtaatcccagctacccaagaggttgaggcaggagaatcacttgaacctgggaggcagaggttgcaatgagccaagattgtgccactgcactccagcctggacaacagagcgagaccttgtctcaaaaacaaacaaaaaaaaaaagaatgttctggagttaggtaatggttgtacaactctgaatatactaaaaatcactaaattatatactttaaaagaacaagttttatggtatgtgaattatatcccaattatattt

SEQ ID NO: 220949 - DNA, 448 bp, Homo sapiens
accccaaaaaaacccccattttcttaggggcttttgattataaaagagcccgtgagagatcccccccaaaagagaatataaaggtaactgaacctgaaatctgtctttgatgagtttataataccagaatacattgcaattatacaacatagaaagcaagtcatgcagaaacatgattgcattatgtgctagatcagaaaagagaagaatctcttctagccatagtgatcaggaatgtctttatggggaattatattgaggaaagacaaatatgggacatgtagggctagagggactaccactgatgttctctcaagaagacaaggctgcaaagctgagtttcaggagatgaggtttgtgagtctacaaatatgatcagaaacatgatttaaaactagatgaatgccaggcacggtggatcactcttgtaattccagcactttgggag

SEQ ID NO: 220950 - DNA, 613 bp, Homo sapiens
gataccacatatttggtcatgattgtcatagtctgcctaatctactagagaagatgtatttataattttactgtaaaaggaaggcttaaatattttagtcaaattgtgtgctacaaagtagattcctttgttggtataatatcacaggataatctggacattaattttatgactcagaattataagtattatggattcactagtgattgctgctgaattgtgagcttcttaaggggctgcgtatgtattttatgaatactttcttttgtagagaataagctctaagttactagataagtgaatgcagttggcaagaatcatctaagtgtatgtaatttattttattgtgtgttagtgtctatattaatttttaaaggttggggtgcagcttgcttacttgtctcactggagttcatgtgccagagaatgtacataaagaactgatgatccaatgagaagggaacaggtttattaaagggggggctggacttcaacatgcagcgtttccatttcttccaccccaaatgtaaacttggagattggccaggaggaaagctggtctgagctcatctccttgggctgccatggggatgaaatgcaggcctgcctcccc

SEQ ID NO: 220951 - DNA, 475 bp, Homo sapiens
taaaagactcttttccagaaaccagaatgtttttatattttcagtaagcaagatctgttttgcttaaaagagtggttgttagtgctctgccgtaaaaaggtccagttctccttatggaaatctgagatggatgtattttcctgccttacttgaagtcagaggcagccatgtgtctcatattggcaataggatgtcagcggaagtgatgtttgtcatttcttttcttttttttttttttttgagacggagtcttgctcttttgcccaggccagagtgcagtggtggtgctatcttggctcactgcaagctccacctcccgggttcatgccattctcctgcctcagcctcccaagtagctgggactacaggcgcccgccaccacgcccagctaattttttgtatttttagtagagatggggtttcaccgtgttcgccaggatggtctcgatctcctgacctcgtgatctgcccgcct

SEQ ID NO: 220952 - DNA, 396 bp, Homo sapiens
attgagtgcatattgtatgccatacaattttctaggcacttgagatatttatcagtgggaaaaaaagacaaagatccctgcttggataggttatattatattcagggatacagatggtatgtgatgaacactataaataggtaaattataatatacattagaaattgatagcattatggaataaatatttaaaaaaaacagaaagggaatgtggtgccaagatcgtaaatagcaatgttatggataatgtgtaaagtcacatgagacaggccctctttcaatagaatagatttatttagcaacttttagcaatggttgtatttgtagactgtatggtggctctgtctacatccagtactccccaaacctgatggattttaatatctgggaaactac

SEQ ID NO: 220953 - DNA, 446 bp, Homo sapiens
aaaaatctagaatgagaagagttctttgcaatttttttttttaccaaatagaatataggaaagatagctgcaaatatacctgacacacttatctgtgagtatggtggtagcctttttattttattttattttgagagagggtctcactttgtcacccaagatggagtgcagtcatgtgatcagagctcactgaagtcttcacatactgtgctcaagcgattctcccacctcagtctcctgagtagcagggactgcaagtgcatgacaccatactagctaatttttgtaaagatagggtttcaccatgttgccctggctgatctccatctcctggactcaagagatccagcactttgggaggccgaggcggcagatcacgaggtcaggagatcgagaccatcctggctaacacagtgaaaccccgtctctactaaaaatacaaaaaa

SEQ ID NO: 220954 - DNA, 439 bp, Homo sapiens
atagtgtcccttgaagcatcatcacatgcaaataaaatgacggtgcagttaacctctactataacaaggtatgttaggctttttctgtatatgttctcatgtgaaatgttagagttgaacattttctgtaaaattgtttaatatacagtcatgtgccacataatgacattttggtcaatgatagactgtataaacaatgttggtttcataacattataatgaagctgaaaaatatctattccctagtgatatagctgtcataattttaaagtgtattacatgactcatggggttgtgttgatgtttgtgtaaacaaactttctgcactgccagttgtataaaagtataagtacagttatgtacagtacacagtacttgacaatgacagtaaacaactgttactggtttatgtatttagtatatgataacttttattatc

SEQ ID NO: 220955 - DNA, 377 bp, Homo sapiens
tcctccaggtcagcttggggtttccacagagccagggctggggtccccacgtgcgtgtccttatggataggggagggcttgggtgacctcaggacccctgtcagcatcctgatttccctcattgttgcccacccattccagcatcggggtcatgagagaggccatgccagactcacccaaccctaccatggaggctgaagcaagcccctttgggcaaagaaggtttgaggaagagaaacccttcaggccaggctccctgagctgccttcaagaggagaggcccccaggctgctgctgagaccaaggagctgccattcctgggtggggtaagtgggggttccccgggctcctaggcctctagggcaccctctcttaca

SEQ ID NO: 220956 - DNA, 627 bp, Homo sapiens
ctctcctccctgggcctctctctagcacagctcataagacactactacattcaggtgtctgttacccagtggtcactcctaccaaactgtgctcctagaaggtcaagaccttggctcaggcaccttcaaatttccagaggcgagaaccagtttggtacataacagacaatcaaaagtttgccggagtaaataggtaacatgcactcttggtggaagttagtcactctgagtcagatcaacttcagggcatctcatgctacaggtcacaccttgaaccctaataaatgatccagtaacaccttgcagatagctgctcatccttcttccagatgtaacaggacttcatcatcaaccccttttaaaaactaacaaagcagccagacgcatgcaaatcacattgtttcatgtaatcattttatcagaaaataaaataggctcattgtgactggaaaatataatttgtgctatattagtagcagaaagtataaaattgctgcttgggcttaagtgattctgaatgatcatgttacctcgtgtttagtctgggcaaggggttgaagggaggggtcaaatggccttactctgaaagagtacaaaacctggtacagagaaggctgggtaaatgca

SEQ ID NO: 220957 - DNA, 479 bp, Homo sapiens
aagagaacaaaggctgggttgcacaaagccttcaatcggaagagagttaatgcagtttgggaatctaccatgtaccaggctctgtctcaggagacttcacacactatattatcgatttaatcctctcaggcactgagaagtggctgtcatctacaccctcctactgagcaagctgggactcaaggtggttgagtgaatcaaccggtcatacaagtaggaggtggagcttggactcaaacactctctgagtgtacaatgtatttttttaccctgaggccactaagaatcaaaatgcacaaggctacaatgttacatttgaggggtgagccaggacctacacagttagtatgatgtcaccactggaaagaagttttgagatcctccaccaagaaccataatctaggcacgatgatattataatcactctgggcctggcatggtggcttatgccggtaatctcagcactttgggaggctgag

SEQ ID NO: 220958 - DNA, 340 bp, Homo sapiens
gtagtttttcggggggtggaaccttgctttgtgattccttgaggttcgaggaactgataactgggcgcgatctgcaaccttagtgttaaaccccaagtgctgttataacaactactcgagatcaacaaataattggcaaaggctgtggaggttttttgaaaagcaaaagcttatgcgtagttgtagggccaaagaggtggctagaagatgtttggaaaaacgtgaaaagtcctgtaatactagttaacacagctttcgttctgtaatctaaacgtgctaaaagaacttagcttaagttaatggaaatgaataaaattaatcataaatgattacgttattc

SEQ ID NO: 220959 - DNA, 564 bp, Homo sapiens
agaacttccactactgaccaaggtggctgaatttacccggaaataacccaaatagcagccacaacaaaaacgacaacatacacgaaacaatttttaaaacactgggcaccaagcaacaaaggacagtaaactcggagaagtgacagacaaaggaagtgagccctacagtaccctagctgatctccttgagagagcttccacgccatggcacagggaggggagccacgtggactcccagggttgtgggtgtggagctgagaatctggagagaccaatgtggctagagtttataggacagagtaccagagaggagagagcaacacagagagagaccctggggtctgcagagggtccccttgatcagcacacgtgtgtgaggaaactctctgtggctggggaaagaactgtctgaaaagatcagaagatacagtccctgctacttagagcaagattataatttactggtagaacattcaggaacagcatgcttcagtagtgggaaattccaggtgtatgggtttgtgagggctaccataacaaagtaacacagaccaggtgacttaa

SEQ ID NO: 220960 - DNA, 176 bp, Homo sapiens
tcatcagtaaaatggtgcagaaaacagggcttcatgtcctggagggtgtgaattcaccagggccctaaatcacccagaccctactgtgtccttgcagggacatggcactcctgcgtttgcttcattccattaaagagaaaaaacacagacacagccactggttgtagagctcgtgg

SEQ ID NO: 220961 - DNA, 376 bp, Homo sapiens
gagtgggaagctgctggagacatctatttttgtatgggctgtgtgctaagaatagtttttacatttttaaaagtaaaacataaaaaggactattagcctttcagaaagaccacacgctcaaagagttgaggaaatttcctcttggcccacaaagcctacattattagtactggccctttacagaaacaaattgggctacctttgacagaggtgagttagtgagtgaatgggctaaaactctatgtagagcaggacatgccaggcatcgaagagcactgggcagcagcttgacagaatatcaatctacttcatcctcacacaagtactacaagttaaatattaataacccaattttagatgagctaattgtttctca

SEQ ID NO: 220962 - DNA, 463 bp, Homo sapiens
aggctggtttttttcttttatgctttatggttttccaaattttctgcacttagcacatatgaaagtaatttttaaagtatatatttttcttttgacataactttagaagttaactttttatgtagtagactcataaagattatcaattaaattatttaaagagagataggccgggcatggtggctcacgcctgtaatcccagaactttgggaggccgaggcaggcggatcatgaggtcaggagatcaaggctatcctggctaacacggtgagaccccgtctctactaaaaatattaaaaaaaaaaaaaattagccaggcgcggtggtgggcgcccttagtcccagcttctcaggaggctgaggcaggagaatcacttgaacctgggaggtggaggttgcagtgagccgagatcgtaccactgcactccagcctgggcgacagagcaagactccgtctaaaaaa

SEQ ID NO: 220963 - DNA, 475 bp, Homo sapiens
gatgagttcatgtcctttgcagggacatggatgaagctggaaaccatcattctcagcaaactatcacaagatcagaaaaccaaacatcgcatgttctcactcataagtaggagttgagcaatgagaacacatggacacgggaaggggaacattacacaccgttgcagggtggggggctgagggagggatagcattaggagaaatacctaatgtaaatgatgagttgatgggagcagcaaaccaacatggcacatgtatacctatgtaacaaacctgcacattgtgcgcaggtaccctagaacttaaagtataataataaataaataattttttttaaaaaagagagcctttaagaccttccactttaaatggttgataaatgtccagtttacaaaacccgaatcacatcctttcttgtatagtttggaatcatcttctacctagaaacttgtttgaggagttaaagctttgaata

SEQ ID NO: 220964 - DNA, 369 bp, Homo sapiens
tatttagagaactttttcaaatcgcatttctagggcaggtttaaggtgactaaatcccttcgtcttccttatcctgagatggtctttatttctccttcattcctgaaggataattccactgggtttagaattatgagttgataatttttctttcagcacttgaaaaatattgtgccactttattctgggtttcattgtttctcaggagaaacacgctgtccttctaattgatttttcctgtgtcattttttttctcactttcaagaatttttcttgaatatagttttcagaagtttaattataatgcatcttagtgtaaacttttttgtgtttattctgtttggggtttcctcagcttcttgaatctgt

SEQ ID NO: 220965 - DNA, 254 bp, Homo sapiens
aagccagatttttagtttgcatagggctttggttgatgccatttggcttgataaatattcattgaatgtatgaattatagaaaataggaggacctgtaaattctcatccaactgtgttatatatataaattgacattttagaaagattaatcagatttactgccattttagtggggaaaacagaactgcaattctgttaaaatccagaatttgtaattccttggccagtagggagaggaaaaaggtactttaaa

SEQ ID NO: 220966 - DNA, 336 bp, Homo sapiens
aattgcaggtgtcatggtgatgtttctttcaaagcatttgctcatcattataaacacttggggaaagaaaggaagagcccattccctgatgtttgctgtagaacagtgtctttgctgtggtgttcacaaaataaaatagaataatattttcttcagttactttgtgctcaacaactttcatttaaatgtctttacttgacacctattactgttacattgtgttcaagtaacttaatgttgaaattactactataaaagatgttcagaattcttgtatatttttgtcatttatcctcatctactaataaacaatttaattcttgttagaaaatacta

SEQ ID NO: 220967 - DNA, 452 bp, Homo sapiens
agttattttcaaagcagggcatctggagtccgatcagcattgccacagatggacccagagcctgagtgctgcctgccacaaacaaacacacgccaattcagatggtttaagtgggaaagtaccttctggctaagctgtggacacattgaaaaaaaagaaaaacacgcagattctgctccatcaatgtgttgtgaggctcctgaaaatgttttcctcccaggaatgtattcatttatcctttcaacaagctggtatcgatagtgctcctgctctgcactaaacaacagttggaagatacactggcctgcgggccctctctgtccaaggaacttagagtctagtgctggcattcttcatctggaacatttattcaaaacgctagtatttaaagcatggccccaaacacaagtcaaatccttgacagcttagaaataaaggctttgagacactct

SEQ ID NO: 220968 - DNA, 318 bp, Homo sapiens
tggctctggcatttattgtgaaatggctgaactgaggctgaaccagcaaagtccctggcagggattggagaaagagtgccaaccaaggcactgcccaggtgtctgtgtttgaacccacttctcagtgctcagcatgcaactacctgcctagtttctctccttagcagggcaacaaagtagagaaagagatccacagggccgcttcttctttcccttccagaaggccatgcctctgacagtgtcacttccctgtccccaaaattgtaaaccaaaaactgtgaagggcccaaaattttaccccacttgcaatcttgcaag

SEQ ID NO: 220969 - DNA, 475 bp, Homo sapiens
tgaatggagtactcaagaaaggcctttcacagagtgacatttgagttgggaccagagaagaaaccagccttccatcctgggcaacatagtgagaccccatctcaattaaaaaaaaattagccatgtatagtggtgtatacatgtggtcccagctacttgggaggcagaaccaggaggatcccttgcctgaaaggtcaaggctgcagtgagccatgatagcaccgctgtgctccagcctgggtgacagagcaagactgtctcaaaagaaagaaaccccatcctggctaacacagtgaaaccctgtctctactaaaaatacaaaaagttagccggggatgttggtgggcacctgtagtcccagttactcgggaggctgaggcagaagaatggcgtgaacctgggaggtggagcttgcagtgagctgagattgcactactgcagtccagcctgggcaacagagccagactccatctca

SEQ ID NO: 220970 - DNA, 630 bp, Homo sapiens
caagtagcactaggatccaaaaattaaaagttattatgttccacaggccaccttgaaaagttaggggaaaaaaaaaacttgaccttcatgtgttgttgctgtttttaagtggctcagcactttgaaataacatttggaggaaagcattgcaatggaagcagcgctgtgtgggattgatcctggagacctgggctcaggcgctggagcacaatgtccaggaagccaaggcctgtttggattccttacgccatgacatggaggcaaagctcctcttggctgccaacccaagagcccacagtcctgtgagcttcacccttcctagggctgtttgtggtctgggccctcgaggttgtgggagaccagtttgattgctaagggaaaatcccagaatggctcttcttgtccttaccgaatcactacccttcaccttcctgcgtcctgccccagcctggagggcctacctaggcctgctattacttccaacccagaagtgtagcgaattggggccatgaccacaaggtttacacttggttacttggtggaatatgaactcttgggcaagttacctaatattgccaagccacatctgtaaagtggatatgagaatagaatctacttcatgggtctgat

SEQ ID NO: 220971 - DNA, 418 bp, Homo sapiens
gattaaatcattagccgttggtgattaaacttaatctccatcccttctcccctccttggaagtcaaagaggtgaggctgaaaattccagccctctaaccatatggctggtttcccttataatcagtccccagtcttagggctttccaaaagtcacctccttaacataagctcaggtgtgattgaaggagcttgctacgaataacaaaaaatgctcctttcacctttgtctcccctatcacttaggaaatcttgagggttttaggagctgtgtgccagtacctgggacaaagaccaaatatagtcgccttctctctgtataactgtgttcctcatccatggattcaaccaacctcagaaaaaataaataaataaataaataaataaataaataaataaataaataatacacctgaactg

SEQ ID NO: 220972 - DNA, 601 bp, Homo sapiens
gcacgaggcaaccaagacagggtcaaaattttcattaagtcttatcgttttctttaaaatttatgcaaccctttgcattcaacctgatggtatatttatgtttgttgtaatacaagataatattttgattacttaaagcattttctctaagtatttttagtaaaactgacagatcaatatgcactgtttttactctgtggcttcatgtaagtccaatatgcctcgtctgatagggaagcaggaatagacaaaaatttgctttttctttcactctgcccagctagtacactgaattttcatggctaacctacttgattttcttcccagtcgtatacacacctacttttcccctcacaccagaatgagctgactttttacctgacatataaaagcttcctttattgttttccaatatttgattattttcccctaatggctatgtattttaaacatttttgcatagctcctctagatgtttttgattaacaacttaaagagaacaaaggctttagtctgttccataatttacagtgtgtcttgaacagctgatgtataaaaagatgcttaataaatgcattttgatgatgactttttaattcat

SEQ ID NO: 220973 - DNA, 326 bp, Homo sapiens
tgattattgaaggctaaaatgttatcagtgcctccaccctttatcctccatttaacttcacatttaaagaaagaaatcataatccctttccattagtgaggccctttctactttatggagcactttcacccttcttactttatgtgatccttacaaaatgatcctatgagctattttgtccccattttgcagatgaagacactgagatcacacaggttaagtgtaagtccaaggtggtgaggccaggactggttctcagttctagttaatttttttttaagttgaaaaatcaaactggatttattaaaatatatataaataaccct

SEQ ID NO: 220974 - DNA, 443 bp, Homo sapiens
aagggagcctgaagagctggtccttatacagctttctgaaatccctgagatctgtcaatgaatcgcgcatctttcactccacaagtatttgttgaacgtcattgtgatcatgctggctgctgtgtggagaaaagaccgaggggaagtaaaagaacaaagaacaaaagagaacatgatggcttggatcaagcctggttcttgactatcccctaaaattgtcagtcagtagaagctcactgagtatcatctgaatttaaatcaccattagctcccttctgatgaagcaggagttgactcagctgggctttcagctggacacggaaagcggaggtagatgaattgtcatgatcaagtgggtgtcatcaagtacttagaaaggtttcattttgttcctactgtctttccaacttactaataaaaatattgaaatctatttcaaaaat

SEQ ID NO: 220975 - DNA, 575 bp, Homo sapiens
agtgaggttttctagtttagtattgtggcatagttgggtatttctcttcactatatagcagttaagctttgcatccctactttcctagaaagtctataaattgcctgatactgtataattaatcactttctgctttaaattagttacaggagattctgttttctgcaataagaagcctagtaataggtacggcaggatggtgaataaagaggtatatatatatagatttttttaaaaaggttccagcatgaaacctgtagtatatttattacagatgggctctctaatctttttagatagattctctaatctttttagatagattcatacatacttctgaaatagttctggaaggacttgttagctgaggtacttttgttcattgtttttagcttaaaaattagggctctgccaaatttcttgttttaaaataaactttttttgttagaggggagacaccgattcttggaaagcttttctttatctactaattgtgggtgtattatgtcacctttcctcaaatacatatgcttccctaatgtatctttatcatcacttaagcagtggccgtttac

SEQ ID NO: 220976 - DNA, 647 bp, Homo sapiens
caaagtcctaaattctgagggataatgttttcaagagaaaataaattattgtacatttggatagatactccagacaacgtgtgtgggctagagaaatacttgtggtccttagggtggtaagcaggagctcaaggttctaagaaggaacacctgagacagggccctgctggaggaaatcccagcgtcctagcaggggaggtgaagataaccgccaactgctctcaatgggtttggagatgaagtggaaggtactagcagacagggaaatgacagagcttggccaagttagggaggcaatggatacagtgcaaacaccaaccccctccgccggtcattaagtaggctgcatggcctcaagcaagttactaacctctctgagcctccatgtccttccccattctgtaaaagagttgtttggagaataataggagataatacataaaacacaagaaaaagtaaatagctagctggatagagaattcctgaagacacttgatgaaggatatctattatgactgaaaagtaggtgggggggtatcattatcaccttcagagtttctctttgaataggtcattcccaaatctgcattaaaaaatcatgttctaatttccccatcaaaagggtcaaagtatattagaaagaaaat

SEQ ID NO: 220977 - DNA, 450 bp, Homo sapiens
ataatgatggggaatgcaaagtgtggttggttttgctggggaaaagagcagggaagtagagacctaggcaggtgatgtcacctctctgatgaactccaaggtctctgtcaacaccggtgcctttgtcctgacattgcggggtttgtggcatgattggagagaccttgcgtgctctctgggcagcccttgttagtgccccccaactagctgggagatccagagtttcatgagaaccctccctccgtgacaaaatccgccttcctcgctgtcaggctcaggttgtcctgtgcccccactgagcctgctcattattgattaatgaacttgtaaaatgagaagtattgttttaccggaagctacatgtttatgtggttggtaaaaatgagaagagttgcttgagaactggttctcctttccatgagtatatacaaggttcaaatctgggctttg

SEQ ID NO: 220978 - DNA, 430 bp, Homo sapiens
tttcatcatgttggccagactggtctcgaactcctgacctcaggtaatcctcctcctcggcctcccaaagtgttgggattacaggtgtgagccaccactcctggcctgggctttaatttctaatattggtactagcctctcctattagcactgtgcctttgggcaaatcattgtgccttactaagctccatttcctagttcttaggctaattgatttagctttgggcagttcacttagacacaagcaaacaaactttacgcctcagtttatatgtaaaatgaacagaatgaccaggtggcctggttttccctgtactaccctggtttgttatgtcctcctttctatcttctaggtagctttctttggcccataaatgacacagtaattttgaggatatttttagtatctggttaaaatcagattttgttg

SEQ ID NO: 220979 - DNA, 523 bp, Homo sapiens
cctgagtggaaaacatgactgttcaaaagtcctatatgtccagggctgttgtatgattggcttgtcttcccccagggacagcagagcaaccttggaaaagcagagggaagcttctcccttggcacacactggggtggctgtaccatgcctgcagatgctcccaaatagaggcactccaagcactttgtttcttagcgtgattgaggctggatatgtgatttgatctttctctggaacattctttctaatcatctttgtgttcattccctgaaaatgaagagtgtggacacagctttaaaatccccaaggtagcaactaggtcatagttccttacacacggatagatgaaaaacagatcagactgggaagtggcccttgaccttttttcttctgtagataagagcattgatgttattacgggaagaagcctttgaggcttttatgtattccacctcggtctggaatttgtttctgtaaggctaacagttgcaatatactagggtaatctgagtgagctggaatt

SEQ ID NO: 220980 - DNA, 434 bp, Homo sapiens
caaagcaactaatggggggtggaaagaggcgagactagacagcactttggagataattaaattaaactcagattaggcaattaccccaaagattcccaaacctggctgaacaccagaatcacctgaggagcattcttggagtggggggagattccgggcctcaccccagacctgcttaagtgggatttccaggggaaggccaggaatctgagtttttaaaaaagctgccagattagtgattgccagggttttggagggatggagggagggcttgactaccaaggggcagtacaagggaattttttgggttgatgggactgttctgtatactgattatagcagtggatacatacatatatatgcatataacttgtggacccatacaccaaaaactgtcaattgtactgtgtaaataaaaataaatatgctgccca

SEQ ID NO: 220981 - DNA, 294 bp, Homo sapiens
gaccctatgtctatttaaaaaaaaagaagttgacacaatgagattcatagccagctgcagtgatatgcatctgtgttcccagctactcaagaggctgaggcaaaaggatcgattgagcccaggagttcgagtccattctgggcaacatagtgagactcccatctgtaaaaataaataaataggctgggcatggtggcttatgcctgtaatccttacactttgggaggcttgcttgaacccaggagtgtgagaccagcctgggcaacatagggagaacctgcccctcccaaaaaa

SEQ ID NO: 220982 - DNA, 560 bp, Homo sapiens
ataattttacaattaaacattaaacaataattttccattccttcctccacctaactaacccctggtaaccactagtctacatgtctatgaatttgaccgtgcataatacctcatgtaagtggaattgtgtattatccttttgtgtctggcttgtttgacttaacgtagtgtattattcaaggttcatccatgttgtagcatgtgtcagaatttcctttttatgactgaataatattccattatatggatataccacattctaatccatttgcctcttggtggacactgggttgcttccctctttggactgtagtaaataatgctgctgtgaacatgggtatacgaatgtctgttccagtcactgctttcagctctttggggtatatacccagaagtggaattactggattactggtaattctatgtttaattttttaaggaggccaagcgtggtggctcatgcctgtaatcccagcactttgggaggctgaggcagcagattgcttgagcccaggagtttgagaccagcctgggcaacatagtgaaactgcatctctaca

SEQ ID NO: 220983 - DNA, 490 bp, Homo sapiens
gaaatgggggcgcaggaccccatgcattgccagcaggcggaagctgaaggagggaaagatccatcccaacaagctcagagcagcactcgttttgaggggccaggcaccctacccaggaagtggggcctggggtgcatgtgagtggctcccacatgccctctagtggcccaggaggcagttgcagccctgcccacctccaggctcagggccggcccagcccctggagcattgttaggatgcgctgcagcccagctagggggcagggacaggcacctgtgtccatgctacctccaaacaactctgagcaggcctgacgcactggtggctcatttcgtccctttgccaaagtgacatcaccagcagagactcaaagcagttgcaccaccttgtaaaggcacttaatgccactgaattgttcccgtaaaaatcgttaagttggccaatattgtggtatagctattttaccacaataaaaaatacagacctccga

SEQ ID NO: 220984 - DNA, 471 bp, Homo sapiens
tgtcagagtagggctgtggattttgtgccttgcttgggaagctctcagggatggcaggatggcaggctcctaagtgacagcaggggggaagcttgaggcacagtgggtggtccttactctccatcccctgcctgagaaccaggaagcctcattcagagattagcccctttactgcaggtggtagcccaggtgcagccaacctgcttcagggtctcagggcctgctgtggacccccatggtcctgggagagactccttagaaacagcagaatcacgaacatggtgaaacccatctctactaaaaaacagaaaaattagccaggtgtggtggtgggctcctataatcccacctacttgggaggctgaggtgggaggttcatctgaaccctaggaagtcaaggctgcagtgagccgtgattgtgccactgtactccagcctaggcaacaggagtgagaccctgtttcaaaaaaa

SEQ ID NO: 220985 - DNA, 597 bp, Homo sapiens
atataattatttcacacaatttgtcagcaattaaacatattctctattggtaaatttgactttataaaggacatagttgctatggagagtgtaaactggaaaacaatttctggaagataattaggtgatatgtatcaaatattttaaaagatttatacccttggacattttaatcccatttcagaaatttatgccatgaaaataattattattaatcgcacaaaaatttgtgtaaaagaataattactatctaataactctgaaattccaacaataaagcctaagttgaaaaaaaaatagaagacaaaggtaatattccaattccataacccttataagcacattcatccatcaaatgtatacacaaagaaaaaagactagaaggaaatattccaggacgtgcaatacttacatgaactacgactgacttttattttcttctttacacatctatgtgttccaatttttctataacgtaccacttttataagcagaaataataaacattataaaaatagaaatgcacatatttttaaagggtctgacaatcatgggacaagacctaaccggtgaggaatgcatatggatttttatctg

SEQ ID NO: 220986 - DNA, 170 bp, Homo sapiens
agttaaatttcaatagtttggttgtggtataaatatctgccttaaatatttttgcctaaagtttttaatctttttaaaaatcaagtaacaaaattataatagctaagttcatttttagcactatatgttgacttcctgtcataacaagtgaaaacttagcttcctcactc

SEQ ID NO: 220987 - DNA, 839 bp, Homo sapiens
cagaaatgaaagatccatgatgaaaatctagcagagaggcttttttgtagttgacaatattgagtgatgcatgaggtaggtgttcagagtaatattcttctgcattatagtgagagaaaatctgttttagtagtaaattgttttaccaattatacatttatgtaataagatacagtaaattttaaaattattttaagattatgtgggaacataattttttaactaaacaaaatttttaacgtgttgaaataattgttgcttgaatgaagtgtcattatgccaccaacttaaacctatcccaccttactcaatggtgtaggtaaaagatggtaacaatggtaacatagttgaatgacatttttagtattctctttttccagtggctttaaatagcaaatacattgaagaatatcattcccatatgttgtattttcactcttgttattttccgaaatttttgtgggtacatagtatgcatatttatctatggcatatatgggttattttcttatacaggcatacaacatgtaatataccagagtaaatgagttattcatcacctcaagcattcatcctttgtattacacacaatccaattatacactttaattatttctaaatgtacaattatgattgtagtattatatcagtataattataattcatacatttatgcatcctgaatacttctaaaaaatgttttacatttctctttgaacatgtggcatcttttcctgcaaacttatacaaactttagttccatttacatgaagttaagtatgtaaatgtgttgctgtaaagataaaccttaggtgtaagaaaattatagagcaagcaat

SEQ ID NO: 220988 - DNA, 557 bp, Homo sapiens
ctatgaatgggggtaccaatactgaacttgcaaggttgttctgagaattaaaatgagataatgcactaaaaatgcttaccacaacatctggcatatggcaatggctcaataaatggtagctattagtatccaaaaggcccacccagaagacccataagtggagtgtcctaagaagccacttggacaccttctccaggagacctcttgttcctccaagtaacttttgttctgtctttgctatctctccatttatgtctcctgcactcctccactagctacatccactggacttcagctcttttcccctccaatataggcagagttttcagtatcagttaagctgggagcattggtgtttcagggagagaaagtcatgtatgtgtttagattataaatgggttgcacaacacagattttctttaatcctagaatcaaattggatgagaagacagctctgattagtcaattatctactgaacttcctcctacttaggactttgcctcttggtgatttgatttgagttccataaataaaataatgtctggtgctgtttaaa

SEQ ID NO: 220989 - DNA, 906 bp, Homo sapiens
ctttaatgagacatatataacaagtcaaaaggcagtttcatgattattggtgaaacagcagaagcactcccgtgaaagtttcaggaaaaagacaatgttgtcctctgataccagtaacatttgagagactgttctgcaagtactggccaaggcaattagaaaagaaaacaaattacaaggtgtaatgaaaaaaaaaaaacaaaaaacaaaaaacaaaaagaagatgtaatggtgaggtaaaaattattatttggaaagagaggtgactaattctggggatcttaaaataaaataaaaatcattaggaacaaaataattcagtcgatatctagtttaaaaatggacatataaaaatcaacaggtttgctatagacaaggggtctgaaaactatggcctgtggttcaaatccaaccccttgtctgtttctgcaaagatttactggaacacaacaacgctcattcatttatgtattgtctatggctgctttcatgctataacggtgaagttgagtagctgcgacagaagccataaagtccacaaaacctaaaatatttactatttgaccccttacagaaaaagtttgccaacccctgctatagattaaaaagaaaatcagttaggaaaataaattgaaaaaaataaaagccccaattttggtttttagagaaagggtctccctccgtaacccaggctggtgtgcagtggtgcaatcgtgactcgaacggcagcctcaaactccttggcttaagtgatcttcccgccttggcttcttgagtagctgggactacaggcacatgccactgtgccccactcatgtttaaaaaaatttttttctttgtaggaacggagtcttgctatgtttcccaggccggtctcaaactcctggcttcaagcaatcctccccc

SEQ ID NO: 220990 - DNA, 416 bp, Homo sapiens
gtctttggaagggcaaagccacttgggcaggactagaggctttggggtgctcccttatccagctccaccacacagtaaacaccgggaacaagaaaaccaaaactccgctgtaatcagcagaagaaattgccacgacttgctctccttaagcgtcccaactaaactactgtaatagctcatggcggaatttctagatgacaacagggcatattactaactttagttttactacagccaagttgaaaagccccagagatcacagccctagagaaccagaactcccttttgtaggtatgactggttggtcaggcgcatcctgggggccatctctcctctccagacaacttctgctcttgggacttctaccgagccactgtctgaaggcagtgctcaaaccttcagaaattcttatcttc

SEQ ID NO: 220991 - DNA, 519 bp, Homo sapiens
ggttctaatattattttgatttaaagtatcacattctgactgggcacggttgcttacacctgtaatcccaacattttgggaggccaaggcgggcagatcgcatgagctcaggggtttgagaccggcctgggcagcatggtgaaaccctctctctaccaaaaatacaaaaactatccgggcctggtggtacattgtctgtggtcctagctacttgggaggctgaggcaggaggatcacttggaccctagagatggaggttgcagtaagccgagatcatgccactgcactccagcctaggtgacagagggagactccatctcaaaaaataaaataaaatgtcacattcttcggattgttttatgtattattacgcactaaaaaggaacattttcttgagaacatttactgatctccaggcctcttaagtaattatttatgaagaaattttaatatattgaagaaaagctgaatgttgaaacaaaacaaaactctagattaacatctaccgtaatgatgatg

SEQ ID NO: 220992 - DNA, 428 bp, Homo sapiens
ctctggaggcagggaaatgcaggagacaggctcccccaccccacagacgctgcctcttccttcaggcacttagcagtggtgtttggggtaaagattcttttcccctttgacattaagtttctcaggtgcattagttttgaggcactgtgaggtttgagggtttgttgattctcattgctaggttccttgcagaggctgtttagtaatctttgtctactgacagattgaagataaatgggctggcctgctaagggcaaggacagcctgggaatgatgtgccatttggttattagtcatattcccatttcttgttcctgtttgttgaaatttgcacggatctctgcctcatccacagagtaagctgtagctgctttcggagtcaggaccttgtcttgtgcttcttcatgttcctgggattttatggacat

SEQ ID NO: 220993 - DNA, 306 bp, Homo sapiens
ctaaatatttatttaatataatttcaatcatagtacactattttagaccctgaaatttttattattttgtgcattttactacataactctgaaaaaattattctttgatatccatgtaaaattccatctatgaattactaccatttaaacattttcccactttagtttataatttttaaatgaataaagtttaagatacagttaaacaggatgtttgtcaaggcttttaagcacaattaaagggattttggctggtacaatatagtggattatcagaactttatcaacattagtgtcacgaaagtt

SEQ ID NO: 220994 - DNA, 680 bp, Homo sapiens
agtaataattatgctttcaggggctgatgaatgaagaaagacagtggtggtgtaggaaggtgcttgcttggcacgaggcgatctcaaagatgagaccagcaggacaggaaggaagcagccatcccagatctaggtgggggacacccggtacaggcagaggggacccacaagcacaggcgtgaggtggaacttcagtctgcaacaggatgaatcaccaacactgaagaagtcttccaatgctatgctctttctttcgtttgcagtttttataggcaagcatacttttaaacttcagaaatgttaatgtttagcctttaaaactgttgaattgatttcaatgcatattttagaatatacatatctatgtcattgcaatttaaactgtttagaagaagttcttattgtttgccatcttttttttaagagagcaaaatgataaatcagtaaaagaaatatttcctagagaggaaagggaacttgctgttgtatagagctgaagttatttcacatagcattgattaaggttggactctggaaacaccagtttcctttgcatcttagcgtagcaattcaataaacaaacagcattattttattttaaatagaccagatagcatccattcctattatagattcttaaaaaatgctgggaaactggagaagggaaggaaaggattcct

SEQ ID NO: 220995 - DNA, 412 bp, Homo sapiens
tgtacacagatgaaagcaccattatcaagtcagaagagcacaagtcaaaccactgtatgttgaggactctctgtactttcttaaatgtttgatagaattcacctaagaaagcatgtagcctgtaattatagaaatctttttaaattaaaaaaattcttcaatacatagagaagctattactttttctatttcattttgcatcagttttaagaattagttttacaaataatttcccatgttattttaattgtcaaatgtattggcctaaagttttcataattatattgatgtctgtaggttctgtagttacatcctctatttaattcccattatctacattatgtagcttctgtaatttttttcgagataaatcttgctagccattgtttattaaaaaatttttttcaaagaa

SEQ ID NO: 220996 - DNA, 970 bp, Homo sapiens
taaagattatttttccctcagagtttggcatagtaaatatctcaaagagaataaaggacatctggttttcctgtgtagtgggatgaaaggtttccataagccaggccacttggccagtccacgtggtccagctggactagcggttaaaacagtgaaacacttctatacggccttcagggtgcacctgccagcctggctgcccgtccttgttacccccgccttttccaacagtgatgtaacggaaggactaattcatggcacaagagggatcttcaggacgccgggccagtgtcacactcagtgactgttctgagttcagttcttgagtggagctggttgtcaaatactttaaatatcaccctagcataactctctcagctgccacacattatatgcccaataaaatgaacctttgagttgttgcttcagtaacttctactgtgttttgtgttctcttgggcatcttcttgtgatatgtttctatggtaacattgaagaccaagctagtccacagttcctctatcccaacaagtttccgtgtcccctgaggcagaggacaagagatcaacacacactcctggccagtttctcaatatattttagcctcagggaagacttagcacccatattgttttctcatcaccacaactgagttggtgtcaagtaggttaaagaaagaatagctgcaagtttctagttacttcaccatctcatctttgtatttttagtctaagttcatgtcttagggcatactaaaatcattactctttccctttattgaagagtttgataactgagtagattagagaacagagagaagaaaagctaaaatctaagatactgatttaagggatctagtgacccttaactcattgtagattaactaaccatctgaagagctgaattaagatgcaaaaacaccactggccatttttctttggtgtttgtcctgttattgaaaaacaaaaac

SEQ ID NO: 220997 - DNA, 292 bp, Homo sapiens
accaatggtatctcatccattggtttttaagtagtattgctcagtgattttccttcctctttggaatttttttttttctcttaactttctttatctagccaccaactttggagttctttgaggcttgggcctagtcctacttcttattctgtactctcccattagacatttatatttcacttacctgttaatgcacacacaacttacaaacttatatttccagaccagatgcctcctctgagcagcgcatccaaatgctatcaaatctacatacaaaggccagagtgatctt

SEQ ID NO: 220998 - DNA, 440 bp, Homo sapiens
tctttcactataggtgagatttcctaatccttctaaggacaatgaagctagactaaaaagaaaaacatatttgaaatacttaggaaaggaatttctagtcacatttaaacagcttaagtaatcgataagagaccaatttctgtttaggctgggcatggtggctcatgcctagcatgatcccagcaatttgggacgctaaggcaggaggatcacttgagcccaggagtttgagatctgcctgggcaagatggcaagaccccatctctacaaaaaaatacaaaaattagccaggcttggcggtgtgtacttgtagtctcagcctcttgggaggctgaggtgggaggatcacctgagccctggaggtcgaggctccagtgagccatgatcacaccactacactgggcaacagagcaggattccatctctaagaaaaaaaaaat

SEQ ID NO: 220999 - DNA, 430 bp, Homo sapiens
cgaaagtgggatcggcttttccgttctctccagtacttctctcgaccactgttttgtgattattatccaagagctttgctggtgttggactccatatagcactgtttctaacactttcttgctttcctgagtgaccccagcatctggctcacagccttccctttccttgctaaagtccgagcgactccgacatcaaaattgatcatcttcccaactgtgtactcaggcagtgttcaagttccacttcccgagggagttctgtcttgcttccatggagctgtccacctggttgtctcatttttaaacagctttattaagaaatcatcgacatacaaaaatgtatacatttaagatgtgcaacttgatgttttagtatacgttattaaattatcaccacaatcaagctaattaaacatatccattacctctg

SEQ ID NO: 221000 - DNA, 233 bp, Homo sapiens
agctgatgtaaaatgcaatcagaaagcagccagaaacagtgacagaccaacagcaaagttcaaatacttattccctggagctcatgctgcatacacatattccgtgcacagtcgcattaggtactgtctccataggctcacctgtttcaggttacacatgctcctctcggtctggttgccctggtttgcccactccacacattcacaaatgactcaagtctcacctgcccccg

SEQ ID NO: 221001 - DNA, 439 bp, Homo sapiens
tgtcgtggctaatctgacagaggtggaggtcaggtggtaatgcaagcagtggggagcatctgtaaatacagatgaagctgctttcactcgcccgccactcacctcctgcagtgcatcctggtttctaacaggccacggaccagtaccagtctgtggcccaggggtttgggacccctgctgtactttttggaatagtttgagtaagatggatatcagttcttctttaaatatttggtaagatttagcagtgaagttgtcaggtgctgggcttttctttactgaaagcctttttattactgcttcaatcttgttacttgttattggtctgttcaggttttggattactttatggttcagtgttggtaggttgtatgtgtctgggaatttatccatttcttctaggttttccaatttattggcatatagtagccatgttgct

SEQ ID NO: 221002 - DNA, 416 bp, Homo sapiens
tccttggtccagtgagatgctccttactggtctttctacctctctggtcccatcctttccacccggccttcatactgctgccagcgttacctacctgatcatctgattctcccacttgaaattcttcagaggctcatctatagacaagcagtattttttcaaactatggcttaagatgtaaaatcaatttaggtctcaactaatatttctttaacaaaacagaatggaaactatataaaatacatagtaaaaaatattatttcatgaaacttttttttagttgttttttgttgttgttgttgttgttgttgttttgagacagagtcttgctgtcgcccagactggaatgcagtgatctctgctcactgcagcctctgcctcctgggttcaagcaattctcacgtctcagcctctgg

SEQ ID NO: 221003 - DNA, 556 bp, Homo sapiens
aaaaattgacttttgatgtatttgtttttaagaacctactctgtatattcaccaaaatgagggaataaatcaagaaagaggaaactgtggggtatagaaaacaaaagatacaacccaaaggagaagcaaaggaaatctttaggattaccactgtgcaatgagtttaaaaaggtaactagtacagactaaagcaacatgactcaagaagcaggcgttttgaggtctgtcttcacaatgttgtctgctgtgtcttccttttaacctaaaggaactactggaaaatatgcttcaccaacacaagaaaatataccaagaaagaggaaggcctgagtctcaggatataaggaatacatgccaggagaatggtaaaggcaattccaaatttgagagcaagaggagtccaaggataacactacagcaagtccagaaagcaccagccccatagagaagtccccaggagagagggctcaaaggaaaacatttagaatggctagattacccagtatgggtggtctatgggaaaatgtactgagacactattatgggaagacatggg

SEQ ID NO: 221004 - DNA, 347 bp, Homo sapiens
tccggtgatctcttcacagctactcgggaggctgcggcagaagactgcttgaacctgggaagatggatgttgcagtgagccaagattgcaccactgcactccagcctaggagacaggtggagactccatctcaaaaacaaacaaacaaaaaaacaacacacacacacacacactttatcaactgccttcaggcccttcttgaccatccggccgttgtcaccactgattttctagttttgctgattctatccttacctcctcttatttatcaccacactgtttccagaatattattttgtaaatcactacaggatcctgtcaactccatggtttaatcctttagtagc

SEQ ID NO: 221005 - DNA, 244 bp, Homo sapiens
tctctctcacacacacatgcgtgcacacgagcacacacacacacacacacacacacacacacacacacactttatcaactgccttcaggcccttcttgaccatccggccgttgtcaccactgattttctagttttgctgattctatccttacctcctcttatttatcaccacactgtttccagaatattattttgtaaatcactacaggatcctgtcaactccatggtttaatcctttagtagc

SEQ ID NO: 221006 - DNA, 503 bp, Homo sapiens
ttcatctgttcacagacatttcagctatttccagttttgggctattacaaataaaattgctgtgaatattctggatataaatcctttatcagatatatgctttgcaaacattttctcctcatctgtgatttttcattctcttaaaaatgtcttttaaagagcagactgttaattttggtgaagcccaattatcaatttgttctttgaagaatgatcctggccgggcacggtggctcatgcctgtaatcccagcactttgggaggccaagacaggcggattgcctgaggtcaggagttcgtgaccagcctggccaacaaatttaaaccccatctctaccaaaaaataagaaaattagctgggcgtggtggcgggcgcctataatcccagctacttgggaggctgaggcaggagaattgcttgaacccaggaggtggaggttgcagtgagctgagattgcgccattgtactccaacctgggtgacaagaaactctgtctcaaaaa

SEQ ID NO: 221007 - DNA, 375 bp, Homo sapiens
aatgtacatgcctatatttttaaatctatttcatttaaaaatgctgattttgttccctaaagtaaaagtaagaatattatttacaaaataacatggccctttggaactcagatttaagaaagttccttgaggacattttataatgactagaatatacctattgtatgtgctctatgtttcagtccatcctttcacttatcacacatccactatatgctaggaactagtaacacagaagagatttttaagggagatctaactgagatatggaggcatgggtgaagaaagaatctctgagaaaatatttgagacttaataaattagtgagagtaagatgggtgagtaacactgaacatgatgtaaaaataggtcaag

SEQ ID NO: 221008 - DNA, 577 bp, Homo sapiens
ttttaaactcattaatatatatctagaatccctccttttttccttgttggtaaaacaaatcaatatttaccttactctagtcttccagcctaactctccttctccatcatttcttaatgagtagtaatgttgacttcatcaacatgcatgcattttattaatacattctgtgccctgagatgtaattattctggtcccgggaatttgaattcatttaaagcatattaaacgttctcttattattatcttctatctttagggaagtgtcctcttcaagatagcttttctaccatttatagttaggaattgttccctttggcagtaaagcaaagtaggaattgagtcgtttatttttcttccttttaagttttaacattctaacatttgcccaaagacgtgtgccttcctttgtttgttggtggtgttatttacaactttgtcagcctctgctcttccaagcaacattcttttgggttcatgtaattctttgttggtttttctttttggctatgaatcccatcgtattctttacaaatgcttaaagaacagaatttaggagacactctttggggtcact

SEQ ID NO: 221009 - DNA, 424 bp, Homo sapiens
aataagtaactagtgagggaaatattccctcatactcaagagaaccctttatacatttttaaatattttagggccaggcttatgcctgtaatcccaagtactcgggaggctgagatgggaggatcacaggagcccaggagttcaaggctgcagtgagctatgatgatgacagtgcacttcagtctgggtgacagagtaagactgtctctaaaagtaaaatatcttaatactgtacctgacatctgactagatgtacccagcaaccactatgtgccataatctctggataaattctatgaacattcacttagaaatagctgcaagtccctgaagacagtatgacaaatactgaggcccacagtttttgggtgatcagttgcataaaatgctaaaatagatggttcctgttttgaatgtcactttc

SEQ ID NO: 221010 - DNA, 95 bp, Homo sapiens
cctccccagtcccccaccagacccaccctctccctgaatctacccacatcccccttccctgtctgtgtctcaataaatggtgcaactgcagctag

SEQ ID NO: 221011 - DNA, 404 bp, Homo sapiens
agtagaatctgctaaagagcctataaatttctaataggctagaaaatttagagagataaatttctaatcattgcctcattacattaactccaaaccataggccaggcgcagtggctcacacctgtaatctgcaatcactttgggaggctgaggtgggcagattgcttgagctcaggagttcaagaccagcctaggcaacatggcaaaaccctgtctctactgaaaattcaaaaataatccgagcacagtggtgcacgcctgtggtcccagctactcaggaggctgaagtgggaggattgcttgagcccaggaggcagaggttgcagtgagccgagatcacgccactgcatcccagcctgggcagcagagccagaccctgtctccaaaaaggaaaaaacacacca

SEQ ID NO: 221012 - DNA, 567 bp, Homo sapiens
tgagcaggtgtggcttggaggaagaggagaggccaggactaacacgtatcaagtctgttcatcttctgagttcccagagaaaagagccccacactcacggagctgacaagcaagccagaaagtagggaaatttcaggttgggataagccctagaagaaaataaacagaaagtaagatgaagcaaaaccaggcgggggatttagagaaggtggttgcagagggcctctctgaggaggtgacattggaaatgaggtggagaatggaatgagaaggaaacattccaggtagagaagggcaggtgcaaaggcagggacgcaagaaaggactgagaatgttcaaggaggggcagggacgttgatgtgggtgagatgtggagagcaacaggagacaggaggcaggcaaggctttgcaggcctggtgaggaatccgggttaaatatgagcattatccccatttagtagatgagaaaaccaaagctcagaggttaagtaacttgcccagggtcgcatagctggtgagtagccaagctgagattccatcatatagtctggtaacaaagtccatgtt

SEQ ID NO: 221013 - DNA, 489 bp, Homo sapiens
ctgcgtacccaacaggctgacctgaccactggacactgacagggtggagacacaggtggcataaagctgtgagagtgaaatgcacactgcacaatccaagacagcgggagaaaatgcaaactagccagtagcaacttctacgttgagtacgtgtcgaaatggtatttcagatataccgggcgaaatgagctatatattaaattgtcattccctttaaatgtggccactcgaaaatttaaaatgacacatgtggcaggcatgtttctcttgggctatgctggtctccgttgagaactcaaaagaatctagggacaaaccaaggaaacagagtgggagcgctctcatgacaggcatcagaaattagggatggctgctgcttggggagccaactgcgatctgtgtctcctgggtcttttctgtctctgcactaaacctgcacctcaggactggtgtttcccctcacccaaagcctcccgcccctctacacgg

SEQ ID NO: 221014 - DNA, 533 bp, Homo sapiens
tatcagatgggaccaggatcaatgaaaatccaccactcacagcccttctacattttccaaaaccgcagtccctggtcctggtcgtcttctgtgggtctcagaactcagggaacacaacctcccatctcggccctcccaggccccctgtcattgaggccttggtgcctttctggccccactgcctgtgcggggcacttctagaaatggagaaataggaagttccacaggcaaggacctcccctctctccctggaaagcagcgtctggtccagccgaggaagggcagggtcagcacccgtatgggcctgggagctgtgtggtgaggggccgacgtgctggagaagcaagaggtgcgggggacaaggatttgagagcccctggcacatgaagctgtattctcctctgctgttgaaacttgggatttcagctctacccagagcacaaaggacatttgttttcaaacaaaaatatccttgtttgtgccagggaaagatggaaaattttagtttatattaaacacgcctttgaagactc

SEQ ID NO: 221015 - DNA, 494 bp, Homo sapiens
tgcacctagcaaaagggcttctgtgccctttacacactagcccctcaaagctccaggagtggactgaacctgggccttggtaagtgtttgtgactgatctcaaatctcccctgtttccatgagagagcactcgtctcccctgtttcagtcaatggtaagtctgaaacatctccttccttgcaggggaggacatcgcattgccgctccctgacctcgggtcacaggtctccctcactcacctcacctgggccttgcctagcacttgggatcagcagtgactgtgcatggcgccttgggtttaggcgtcagtttgcatggttttccactagggagaggacggtaaatcacagggctgccaaccatcagtagtgcactgcaggcttatcaacagccgccaggaaagtctcgggaatgcatttattccctaaatacactgagaatttagaaaatgaaaagatcccagagagcctctctactctcaaaaaggtattccc

SEQ ID NO: 221016 - DNA, 496 bp, Homo sapiens
aggtagcccagagaacctgaactcaaatcctgagtctgccactctctgcaagattttttttgagtctgcactccagcctgggcaactgagtgagaccctgtctcaaaaacaaaatgcttttaagccaagtatggcacacagccggcggtcccggctacttcatttttgttgttgttgttgttttgagacagagtttcactcttgttgcccaggctggagtgcaatggtgtgatctctcctcaccacaacctctgcctcctgggttcaagtgattctcctgcctcagcctcccaagtagctgggattgaaggcacctgccgccacgcccagctaattagtagagatggggttttgccatgtatggccgcgcctggccatcccggctactttggaggctgaagccggaggatgccttgagtgcaggaagtccaggctgcagtgagctatgatggcaccctgcactccagcctgggcaacaaagtaagactgcacctct

SEQ ID NO: 221017 - DNA, 507 bp, Homo sapiens
acagctctacgggcatcctctctaagcctcatagcaccctgccaagtagctctcatttccttgccttgtagactagaagaagtgacttgcccaaggtcttataagcagtaagcaaagttgccgggagtggaacctgatgggaccaggtctgcctggctccagagctggtatccttcccgctcgcttaggtggctcccatggcaggaatgctgagtctgatggggcctctttgagatggcttaactgcggctcttctgggttcggggtcaagggaatgaggggtttggatagtggcatctgatcactgcttaatgaatacagtggaggcctctgaaacattagagtaaccagcagtggagctatgcaccaagggaaataatggggggtttggaatttgctggtttcctacctgctgggccacataaaagctgagtgactgtataaattcctgaactgttttgagccgctgtttctctataaaatggaatccctcagtttctctataaa

SEQ ID NO: 221018 - DNA, 474 bp, Homo sapiens
ttttgagacagagtctcactctgtcaccaggctggagtgcagtggcacgatcttggctcactgcaacctccacctccctagttcaagcaattctgcctcagccccctgagtagctgggactacagatgcatgccatcatgctcagctaatttttgtatttttagtacagacagggtttcactatgttagccagaatggtctccatctcttgacctcgtgatctgctcacctcggcctcccaaagtgctgggattacaggtgtaagccactgcgcccagcctaattggttcttattaaacggttattctctaccttacctccaatctgattgacctccttttgcctactggtaagcatttcaggcctgaatctgtaaaaagtaatgaattgtttctagaaatcatctagcttgccttgggttgggacttttggttttgccagagaaagcacctaagcaccttgcacaagggctac

SEQ ID NO: 221019 - DNA, 797 bp, Homo sapiens
atgaaaattttttttaagactttaaaagggtcaaagggataagatattgactctaatggaatattggagaattctggaccaaggttagggagggaacaaatgcacagaacaagcttttgaagccagttttacagtggaaatatagaccaggaagaaagtggctaagaggtacagctgtgcttttcatggaaagtggacaagatcggcaccatgtccgagtctggcactacctcccactctggactgaaaccctaaagtgctgtaccttggattgggggtatagtttgcagcagcaatgggtgatttagaaaacctcaagcctctgttcgggactgccagtgcccacaagtgcccagcggaagcaaacaaaaatttctctgaaataagataatggcatcctagtcctcaaattatttttataaattttcaagtacaacctaagtagaaaaataaaaaaaaagataatgaggcacataaagagacataacaacagaagccaaaaccagcaaaaacaagaaaaacagacacactgaaaccctggatataccgtaaatgctatgaaacaaatatgcttattatgtttatagagataaaagccaatcttgaaaacttaagacaagtaccactaaattctagaattgaaaaatgtagtagtctataagaactgagtgagctgggtgtagtggctcatgcctgtaatcccagcactttgcgagaccaaggtggaagaattgcttgagcccaggagtttgagaccagccctggcaacgtagtgagacccccatctctataaaatt

SEQ ID NO: 221020 - DNA, 444 bp, Homo sapiens
cctaattgctgtctcccagcagatcagtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaaaaaaaaaa

SEQ ID NO: 221021 - DNA, 482 bp, Homo sapiens
gatgacaaacatttctgtaggtagatttaccttagaacgaatgtttagtgagaacatctctgcaacctcttgaaaattctgggtttgtattagaaattataatgcgggtatgatttagtttatttaaaggaaataaatattgataaagcatacatttttaaaatgagtgccgaagattggctcaggaatgtaatgggtgctataagctagatattctccatttttttcacgtctttgttctttagattttcttaattaagtggtagtttgatttcatacttgcaaactctgacccctttattgaggagccctcagatgtacacagtttactatctcttttcatgaccataaattgaggtattaagaattattctgaaatcatacctattcagattaatggatcaaaaaatgtgctgtctttggatctgaactaatggttgtctagtgttgacatttctcataatacattacacattgctagc

SEQ ID NO: 221022 - DNA, 651 bp, Homo sapiens
ccagttagctgggcatagtggtgcacatctgtattcccagctgctcaggaggctgaggtgggaggatcacagagcccaggggttcgaggctgcagtgagctatgatcacccctgcacctcagcctggacaacaaagcaagactctctctcaaaaaaaaagtcgcctgcctgcctgcctgaaacaggtatagaaattcctaaggtcactgagaacctgaaccaaagtggctgtgggtcagtgaccggccgtgactcaggcgttaggggaacgacataaagatcccagtccctggcaaagcccaattccagcaggagctgcgcagggcagctcgaggcccagcctggggacctgtggccgcacagacccatggtgccctctgggggccactaggagggggcgcactcccccacaccatcttcctgtgcagtggcccaagacggtggtggagcgggctgtccgtccccagcacttgccattcaaagtggctgcccttcatgggtctgtgtccagcgtccccacaagttcccccatccctgcaggacatgccttggtccgtacccagcctagaaagcaagatctagttgcattctggctccagatgagggatccaccatttcctctcttgagagggtgagtggggggttgagaga

SEQ ID NO: 221023 - DNA, 450 bp, Homo sapiens
tgccaaggctagtctggaactcctaggctcaaaggatccacccaccttggcctcccaaaatgctgggattataggtgtgagccactgtgcctggccgacactttacagcaggagctgcgcagggcagctcgaggcccagcctggggacctgtggccgcacagacccatggtgccctctgggggccactaggagggggcgcactcccccacaccatcttcctgtgcagtggcccaagacggtggtggagcgggctgtccgtccccagcacttgccattcaaagtggctgcccttcatgggtctgtgtccagcgtccccacaagttcccccatccctgcaggacatgccttggtccgtacccagcctagaaagcaagatctagttgcattctggctccagatgagggatccaccatttcctctcttgagagggtgagtggggggttgagaga

SEQ ID NO: 221024 - DNA, 420 bp, Homo sapiens
cactgtaagttctataggggctcagaagaaattagttgggtgggcccacatgacaggggcacttggctgggagaaacatttccctgttgcacagtggcagagaaggactttctccagacctgtgacctttaatgtgctggctgggggtgaggagagggaggaaggaggaatgggcccagagggcagagtgaccttgaagatggcagatgcactgagtgctttctgccaggcactgcgcccccattttacttgtgttatctcccctaatcctcccaatcaccctaggcgggagaagaaggaacatagtgagaaaagacagctacacagcttcccttctatccttcccctgggagctcaggacctgtcgtaggagtgtggctttctgtctttaccctgagtaaatcctccacgattaaaaaa

SEQ ID NO: 221025 - DNA, 438 bp, Homo sapiens
cacacatattacaatcccttttgttagcaaataactgcatttgcacaatctgactttttaaaattctgcttttattttctgtattccttagctagattagagatgattagactttggcatttacttttgtacagttaaggctgttagctagaagggtgaaaagatttacctcaagatgatggagaagcttagactaagttctctaactaacttgagtcaagatattatagtcttgtacttttgtacaagacttctttcttcctttcaatagaatttgtatgattttgagagatatgatgtataaggagcagcacactcaaatcttgtgcttttgaacattttttagggagattagttctttagaatggtggtctgtcaacttttttgatgattcatccccattatatatatttacttataaataattcccatgttcag

SEQ ID NO: 221026 - DNA, 487 bp, Homo sapiens
gtgcctgtgggtcctagacagcttcacagcttgtgaggtgcagtgggtgggggaagtgaggcagaggatgtatccgttaaccctttggaagccctgatctttctgtcctgatcttgctgtgcctcagaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgccaaacttg

SEQ ID NO: 221027 - DNA, 444 bp, Homo sapiens
ggagccaagatgcaatcagtattgatgccctgacatgtctattctgattctgccacccagtacctcttagctgggcactaatctaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgccaaacttg

SEQ ID NO: 221028 - DNA, 402 bp, Homo sapiens
gacatcaagaaggcatttagcctgtgaacctaaaggatcagaggacagtcctggcaatgttctggatctacggctcattctctacagattctctccaggccccacgagttatgctgagtttttcctgaatctttgctggattccttttttcccctgctaacatcctcttttgtaatggcctttccatatctagattgttccttcttccaacattcaatagcgtttggcctccttgcctgtgaggtgaacaaattgtggtgtctttctcccctgcagaggagtgtacgtggatggaaacttgctggagagtaggggcagaagagagctgaagttcaaagtcagggtagggcctgtggtgcatgccgggtgggtggagtgagcagtggtgtggaaagttgctct

SEQ ID NO: 221029 - DNA, 311 bp, Homo sapiens
tcatcactgagggacagaccacctctcatttatcgttttattcacagtggcaaatgttaatatgcaggagaaactcaacaagtggttgatgaatggacaaaaaaggaacacgctgaattgccaacaaaaaagaacatactaaattaaaaattccaacttcattacttaacttcttttttgtttctgagatggagtctcactctgtctgcccaggctggagtgccatggtgcgatctcgattcactgcaacctctgcctcttgggttcaagcaattctcctgtctcagcctcccgagtagctgggactacgt

SEQ ID NO: 221030 - DNA, 396 bp, Homo sapiens
ggagtggattgtgacacctctggaaatgctaactctatgtaacataaccaagtcatgatatactgtaaagatctggttgctcatcatatactataaagtgctaggccagaagcaattgtaactctcctctcattgctttatattaaaactctgaaaaccccaagcttggtgaggccaaggctgggttatggcaaggtgctctgcctgagtatgcaagtgtagtcgagggagaaatttgttgcagggatccatttacttgggacaggctggaagtgcgcattctcctgatccttaagcttttattaattgctgcagccttggctccttctatgctcccagtgtggatttgctggctgagctccatccatcctttatgtgaatgaagataaggatgtg

SEQ ID NO: 221031 - DNA, 1622 bp, Homo sapiens
  misc_feature (249)..(249): n is a, c, g, or t
cccctgggtggctgcggctggaccttcaccacctcttacaagctcaagaggcacctgcagtcgcacgacaaactgcggccctttggctgcccggcagagggctgtggcaagagcttcaccacagtgtacaacctcaaggcgcacatgaagggccatgagcaggagaactcattcaaatgcgaggtgtgcgaggagagcttccccacgcaggccaaactcagcgcccaccagcgcagccacttcgaaccngagaggccttaccagtgcgcgttttctggctgcaagaagacatttatcacagtgagtgctctgttttcccataaccgcgcccatttcagggaacaggaactgttttcctgctcttttcctggctgcagcaaacaatatgacaaggcttgtaggctgaaaattcacctgcggagtcacaccggcgagagacctttcctttgtgactttgatggctgtggctggaacttcactagcatgtccaaactcttaaggcacaaaagaaagcacgacgatgaccggaggttcatgtgccctgtggaaggctgtgggaaatctttcacgagggcggaacatctgaaaggccacagcataacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctctcacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctggactctttggccatgaaaaactccagtccagagcctcaggctttgacacccagcagtaagctaacagtggacacagatgctctgactccttcgagcaccctttgtgaaaacagtgtctcagaactactgacaccaaccaaagcggagtggaacgtacatcctgactctgacttctttggacaggagggagaaacccagtttggattccccaatgcagcaggaaaccatggttctcagaaagaaacagatcttatcactgtgactggcagctcatttttggtatgaaccaactctattcattcctcatcatgtggcttacttttattacagtcaattttgaggatattctggactaaatatttaagtgcagtcatttctttttggtttgcattggaactgacaagttgtgtgaa

SEQ ID NO: 221032 - DNA, 1830 bp, Homo sapiens
  misc_feature (249)..(249): n is a, c, g, or t
cccctgggtggctgcggctggaccttcaccacctcttacaagctcaagaggcacctgcagtcgcacgacaaactgcggccctttggctgcccggcagagggctgtggcaagagcttcaccacagtgtacaacctcaaggcgcacatgaagggccatgagcaggagaactcattcaaatgcgaggtgtgcgaggagagcttccccacgcaggccaaactcagcgcccaccagcgcagccacttcgaaccngagaggccttaccagtgcgcgttttctggctgcaagaagacatttatcacagtgagtgctctgttttcccataaccgcgcccatttcagggaacaggaactgttttcctgctcttttcctggctgcagcaaacaatatgacaaggcttgtaggctgaaaattcacctgcggagtcacaccggcgagagacctttcctttgtgactttgatggctgtggctggaacttcactagcatgtccaaactcttaaggcacaaaagaaagcacgacgatgaccggaggttcatgtgccctgtggaaggctgtgggaaatctttcacgagggcggaacatctgaaaggccacagcataacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctctcacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctggactctttggccatgaaaaactccagtccagagcctcaggctttgacacccagcagtaagctaacagtggacacagatgctctgactccttcgagcaccctttgtgaaaacagtgtctcagaactactgacaccaaccaaagcggagtggaacgtacatcctgactctgacttctttggacaggagggagaaacccagtttggattccccaatgcagcaggaaaccatggttctcagaaagaaacagatcttatcactgtgactggcagctcatttttggtatgaaccaactctattcattcctcatcatgtggcttacttttattacagtcaattttgaggatattctggactaaatatttaagtgcagtcatttctttttggtttgcaaaaagagcacagccctggactacaagtttggagatttaaattctgatcttgagtttggaactgacaagttgtgtgaccctgagcaagtcagttaacctatctgagccttaatttccttatttataaattgaggtggtttgaatagattgcttttaaggtctttctgctctgtgattccttgataatacatttctttccttgacccagccctgacatgttctttttttggca

SEQ ID NO: 221033 - DNA, 648 bp, Homo sapiens
ggaaaccatggttctcagaaagaaacagatcttatcactgtgactggcagctcatttttggtatgaaccaactctattcattcctcatcatgtggcttacttttattacagtcaattttgaggatattctggactaaatatttaagtgcagtcatttctttttggtttgcaaaaagagcacagccctggactacaagtttggagatttaaattctgatcttgagtttggaactgacaagttgtgtgaccctgagcaagtcagttaacctatctgagccttaatttccttatttataaattgaggtggtttgaatagattgcttttaaggtctttctgctctgtgattccttgataatacatttctttccttgaaaaatatgaggacgtttttcagtgatgtggcatgcgtttttttttaactgcccccccagccctgacatgttctttttttggcaaacatacataatgttacatcatactatgatgaacatccatgtacttttcactcaatttcagcaattatgaatccatgaacaatcttttttaacttagcctcactcactccccatgttctagtattattttgtaacaaatagcagacatctgatcattttatccataaatattctttatatatctctgaaagc

SEQ ID NO: 221034 - DNA, 455 bp, Homo sapiens
ctatatagtcatgttaaaatcagtttgtcagtatatgtttttgaaagcctgctaggatttatattataaatacattaaaaagtattgccatttgccactttaacaatattgttttccactccataaacatgctactttccacttatttaattgtctttaattttcctagtcaaagttttattgtttacaatgttcggatcttgcatataatatctaaaatttattcctaagtgtttttgttttttgatgaaactgtacatggaattttttaaaatttcattttccaacgatttatggctattaatcagaaatacaattgatgtttgtatattgactttgaatatcatgactttattaaattcactggttaattagttctagaccttttgttgtagatttcttgtaagtacagtcatgtcacctaaaaataaaagcaagcttgcatctttcttccc

SEQ ID NO: 221035 - DNA, 379 bp, Homo sapiens
tagtattcagtcccgatagttcaatgtgttgcttatttcactgatagaatgtggatgcattttataaacttagagaatttagaaaactcataaataaggaaaattggaagttcttatccatgatcatgaggtacattggagaagagttggctgggcgcaggggctcatgcctataatcccagcactttgggaggccgaggcgggtggatcatttgaggtcagcagtttgagaccagcctgacgaacatggtgaaaccccgtctctactaaaaatacaaaaaattagcccggcttggtggtgggtacttgtaatcccagctactcaggaggctgaggcaggagaagtcaacacgcccgcgaatttagtagtagtaggcgg

SEQ ID NO: 221036 - DNA, 305 bp, Homo sapiens
ccatgctgtctcaggatgggcaagaaatggttcttgagttagacatgtattccgtgaagacgctgtgaatattgttgaaatgacaacaaaggatttagaatattccataaacctagctgataaagcagcagcagggtttgagaggattgactaattttgaaagaagtcccactgttgacaaaatgatatcaaacagcatcacacgctgcagagaaatctttggtgaaagcaagagtccgtccacgtgatatacttcgctgttgtcttaagaaattgccgcagccacccaagttttcagcagccac

SEQ ID NO: 221037 - DNA, 287 bp, Homo sapiens
gtccagcttcggctcggcatcagagggagaccgtggaaagagagggagagggagaccgtggggagagggagagagggagagagggagagagggagagggggagagggggagagaggtagagggagcctcatttgtaaaatgagagaattttactagattaattaaaatgctttccatctataaaatttgcttctggaaaagaccatctatccaacataatagattttttttttctttttgagacagagtctcgctctgtcacccaggcaggagtgcaatggcacaat

SEQ ID NO: 221038 - DNA, 448 bp, Homo sapiens
gcctgccataaattcgtaactctagagaaaattcataattaaaaaactgatggcactaacaatttcttttctttttttagtttaggagataaatttactttttggttaaaggtatactaggaggacttctgaaataacaattataattctataaatttacttgaggctagtgttatgtatatgtgtgtccatgtgtgtacaagatatgtacacatgaactatacataggtatgcactgatatatacatagattgtagtttgtgtgttcaacttactctttatattttggcaattttttagatactataggtgtaaaaattataattttaagttcacagatgaagcatatttacctctttgaataaagcataattttgtaaactttatgattgataggatggatacaggactgaagattcagagaccatgaaagatttatgtcaggttt

SEQ ID NO: 221039 - DNA, 188 bp, Homo sapiens
aactaagtttaaagtcaattgatttttctcctgaatcaaggactagcaaaaaataataataataaaataggccaggctctgtagcacaggcctgtaatcctagcactctgggaggctgaggcaggaggatcgcttgaggccaggagttcaacaccagcctgggcaacatagtgatactgtctctacta

SEQ ID NO: 221040 - DNA, 590 bp, Homo sapiens
  misc_feature (8)..(8): n is a, c, g, or t
  misc_feature (10)..(10): n is a, c, g, or t
  misc_feature (12)..(12): n is a, c, g, or t
ccaaattngncntttggccggggatgggtgtccactaagcctgcaggatagataatgccaggtgtccttcttccaggagaggaattgttccacttgctggaactgtttttttgggcagatatttgtacgtagaacaactgttgtagatgcagcctctttccttagatttataatgctggacccttcttagatggggcagcatcctcccaacaggccgggcaaatctcccctggggccaggctctccaatgaggctttctaaagtgtgactcctggaaactggacatagtttgcaggatacccaagagcctcattcagagcaggaacatgggcaggctcgttgagggcaggaaatttgatggaagagaattgtcccccactctctgctctttaggggcctctgtcttagtaagaaggaggccaaggctctgtcgtctagaggcattgcagttaccacagatcgcatgctcctcttgtgccaggcacctgctgggcgctctatgcacgctaggtcattcagtcctcaccacggctgagaagtgagtagaatgattcccattttactgatgaggcacctgaggctcagggaag

SEQ ID NO: 221041 - DNA, 474 bp, Homo sapiens
tcaatctcggatgttcagagacccctctatgcaaggaggcaggaaagaatttgctctatgacctgggttttgatagcagtgatgatgatggcttctgaccagtccacagttgatttattggtctcagctagaaagagaaattgcaggacatttgggctggccaacagcagaaagtccctgaagcctgccaagtacccagggtcagaggccctgctgaggtggggcaatgagcacgagggcagggaaggtccagcattctgggtaccaggtgctgcccctgacaaggattaagtgcatccttatttattggaatgaaatgtgaaaatggtgctgatgaaaactgaggcagcagcctggttgtggggcatctggagcagggtgcctgtactttggcgaaaggcaggcaggcctccttatggaatactgtgtagcagaagggctctcataaaactgttgcggtggcagcatgactcc

SEQ ID NO: 221042 - DNA, 490 bp, Homo sapiens
ccgtgcaagggaagtgagaagtggaagtgtactgaaactctcatttttgtgcagagttaatagatgctatggctctacaaatcaaaacatagtcgtaaaggaaactaccagaaaaaaactaaaaataataatgtaactaacacatttaggaaatgaagaagggaaaacagaagttggttaaatgtcttttgtaagtcacctataaatcactaggttaatgcatatggtctaaagttgataaatcaaaaatttaaaattataatgtcaattccagaaataataaagggcaatgtgactacttctggggagtaggactaattgaagagaaagtactaaggaagtggtctttacttctaattttatacatttcagtatcttttgatttatccgtgcatatgtacacatggattattttcaaaaattttttaaaagttaagcaatgtaagcgcctattaatactgtctttgatgcctctaaaagattatataac

SEQ ID NO: 221043 - DNA, 201 bp, Homo sapiens
gacacagttgggtgactttagggtttagagagaaaatgctggcaggggactggggaagggagaagggtgaggtgggagggatgagcttctctttctcgtattgctatgcgttgctgaaaggcaagctaatagttacccagccagggtcaagcagctggagagggaagttagagaaattcacagccagggccctgagagcag

SEQ ID NO: 221044 - DNA, 478 bp, Homo sapiens
atagttgatgttctgtaaatacctattgaatattgactgaaacagcctttaaaatagaaattatagataaatttggcaggtgtatcctgatcttccgtgtggctttttgaggtaataagtttatggtacgagtgcactgtctaagtatcatgctctcctaagatacacctttctgtatggctgtaattctaagttagggaacagatagaaataaagggtctgttcatttcatctgtgtagtgttcagtaaagacagggagattgctatgggcaatctattggttaccccacttgttctccagtgtaatcgatatctttctttttacttattttatgactcttctagcttaatatcttttagtccacagacatatatgtgtgagtatatatatgtatataattatatatatatataattgaggaaaagcagtatttgtggtggcatggggtaaacacaagtaagccctcaatgactttg

SEQ ID NO: 221045 - DNA, 413 bp, Homo sapiens
atggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactgtcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcagatcaccttcccagatttttgccaatatcaattaaaaaaattttttagccaa

SEQ ID NO: 221046 - DNA, 438 bp, Homo sapiens
ggaatctgagacagccagaaagggagtgggctgagggttttggggtgggaggtaggggaagggtagatagagttcgtggtcaggtttagggagcagaaggaattggggatgttttccaggaggagtgggacctctcagaaaatttgttcttgggctggacatggtggctcacgcctgtaatcccagcactttgggatgccaaggcggacagatcacgaggtcaggagatcgatcgagaccatcctggccagcatagtgaaactctgtctctactaaaaatacaaaaattagctgggcatggtggcgcgcgcctgtaatcccagctactcaggaagctgaggcaggagaatcgcttgaaccagggagtcggaggttgcagtgagccgggatcgtgccacagtactccaacctggtgacagaacgagactccatctcaaa

SEQ ID NO: 221047 - DNA, 203 bp, Homo sapiens
tctccctagtggagcaaaccagagccaggaaaagaaatccttccagcatcctgccagttcccttacaaaacatcatgctgcttccccaatactgaggccagacttccctgaggaggctttctagtgtggcttagtaggaaggaccaggctcaattcctagctttgtgtgagctccaagtactgttttctctaaaccttttccc

SEQ ID NO: 221048 - DNA, 382 bp, Homo sapiens
acttgtctgtgtattagaatcacctgggaaatctttaaaaattctaaggaccaggtaaattaaattataatctctgggaataggactgatttttgtatttttagtagagacggggttttgccatgttcaccaggctggtctcgaactcctgacctcaggtgatccacccgcctcagcctcccaaagtgttgggattacaggtgtgagccaccacatccagcccagactaatttttctgatgacaaatgctgcttgttgatgtgaattctgatatggcacacacttgagcctcactttgttagctattaatttgtgttactgaatttacaggcctggaatacaatttgtgcttctttttaaataaatttcatacttttttttt

SEQ ID NO: 221049 - DNA, 506 bp, Homo sapiens
tggagacctgatagcagtgtgaggtatgggtttggacagaatgggatttgaaatagaatgtaagaataattagtttgacagacgatatcaactaaaatagtggcagtagggatgcagagaaagagaggtatttatgaaatcaaattgagaggacctttatgtgaaagcacattttatgtgaaagctaaatatagtaataggaaatctgagttgatcctcaacttgctaggtgggcaagtgatgatgccattaatcaagatcaggaatacagaggtgtcatgggggtgatcaggggtggtgataaatagggataaatatgttatgaccatgttgagattgagattttttttgcaggatgatttagtaaaatccagtaaaacacacaaaataagccatctagagctcaggaaagattatgaagctggatacactggtttaaaatttagcaaagtatacatatttagctgaagcaatgattatgggtaaaattgctcagtaataagaga

SEQ ID NO: 221050 - DNA, 205 bp, Homo sapiens
gatctaagaagactatggaaacctcttataagcatttgagatctgtaatgatggcaagaggttgggaaaaagaaagatgaacagtaatagaggaatacaggagaatgtgctgtgtgcttagcattgggctgtggaaacccatgctgaaagtgttggagaacccaacactggagacaccagaaacagataataaagggttactttt

SEQ ID NO: 221051 - DNA, 218 bp, Homo sapiens
caaacaaaaatttcttgctcaaagaaagaaaaaaaaaaacaccaggaaccataaagttgtccctcagaaatgaaggagagataaggactttcccagacaaataagaactgaggaagttcactagacttgccttataagaaatgcaaaagggaattctttaagctgaaagaaaaggatggtaattggtaatatgaaaacatataaatgtaaaaaattca

SEQ ID NO: 221052 - DNA, 330 bp, Homo sapiens
ctgtagatgatgttgaacaatgtggtactataatcccaacctgttgtatctttgtttactctcaaaagcaacaattgggctgggcatggtggctcatgcctgtaatcgcagcactttgggaggctaaggtgggagggttgcttgaagttagttcctttttttttttttttttaaaaaaaagacaagatctcgctctgtcaccccggctggaatgcagtggcatgatcatagctcactgcagccttgaccacgtgggctcaaggaatgaaccattgtgccaggagttcaacaccagcctggataacatagcgagaccctgtctctacagga

SEQ ID NO: 221053 - DNA, 492 bp, Homo sapiens
acactgaagacattctcacaatttaaaacaagttgtaaactacaggaaacagttggcatcccaggagagttgttgcctgaggaactagatggtggtatgttattctggcatatagggaacagaataagacatgagggtaggaagaggtttttaaaagcaaagttaggcattcaatgatgacttcataaatgtgcctgggctggcctttaatggaaggctttaatttagggaacttaaagaatttcataatattggagtataaactgctggaaataaggatgctatttaatagactctcttagatttttcataaaatgctaatagaatcccaaaggaagtgtgtattctaaaatgttattgtgtatgttataaaagctttgtaaaataaagtgatgttaagctactattgtaaagttaaaaattttttcagtcatctgtaatctcattacccaagtaaaactgttttcatttttccattatcccttttagttg

SEQ ID NO: 221054 - DNA, 531 bp, Homo sapiens
caacacaaacatgtctaaatattagtctagcaatcctttatcttagacttttatcacattattccaaagcaaatgactcagatctataacaaagtggggaaagagagagactactcttaacaaaacattttaaattactggctgacacctgacacaggaggatcacttgaggccttaagtttaagaccaggctgggcaatatcgtgagaccctgtctcttaccaaaaaaaaaattttttttaattatccaggcatggtggctcacccctgcagtcctacctctctggaggctgaggcaggaggatcgcttgagcccaggagttagaggatgcagtgagctatgatagcaccactgccctctagcctagacagggtgaaaccccatctctttaaaaaaaaaaaaaggggggggattttaaattatttatattgtgtaaaacatggaaagtgaaaacccttaggcaaatattcagtgaattgttcctagacctagattcaccctgctggaaaatgctaatggacactacctag

SEQ ID NO: 221055 - DNA, 111 bp, Homo sapiens
tagacccaagaagattctgtatctgggctcttgagccactgcggctcagtccactcccacactgtggagtgtactttcattttcaataaatccctgctttcgttcttaaaa

SEQ ID NO: 221056 - DNA, 494 bp, Homo sapiens
catgagctatagattcttatgacccaataaagggaaagaactaggattatctgttttccattccccttaagcagagaatatttaagtatgtgtagttgcccccaaatgcaatgtatttttttctttattttttaaataatttaactttttgaaataatatgtgcatatgatgcataattcaaaatctctgaaagggtaaccatgtgaaatcatatttggccctgtcacccagccatcccattaacccctttcctggaggcaaccatttttaccagtttctggggtttcctactagaggtattcagtgcacagaaacatatctattatgtgtgtgttccatacatacatatttatgtaaaattttttctactgttctgtatcttggtttttaaacgtaatatatctttgagctaatttcatttaagcaagcatagagctcccccatatcccgtgacagccccaccgaggacctcctggggctccctagtcaaaca

SEQ ID NO: 221057 - DNA, 382 bp, Homo sapiens
cgcggccaggcctgttattcagctctccgctccgctgggacccgcacagcgccagtggctcgggggtcggccctcgcctcctccccggcccgggcctagagccacccctaaccagaggccggagacagctggagcggctgccgcatcccggcccagcctcccctaccatccctcccccttccactggacatctggaccctaggcccccgcaccgacagggttccggaaaccctccccgcccagcccggcggccgggccccgcgcctctctctctctagagcccccagccctcctcaagactagacttccgcctacccctggacacctcctcccggtcccctccctccccccctcccacagcctggaccggggtaggagggag

SEQ ID NO: 221058 - DNA, 1450 bp, Homo sapiens
agaatacattaatcaacactactttttttgacaaagcactttatgtttgattcgcctgatgtttacctctcacttcagtatgccacagttcaattctagttcatgattagagtgctagatcagcgcctacaagaattcagtttagttgagaatacaatacacaaaattaatagcagctgtttacatgctgaattgataaattctgcaggtaatgataatgtttgtgaaatgcatcctgtggaacccaaactctaccaaaagaggctggctggacagtttcctctcagagattcaatctgcatgtcagcaaagaaaaagctctgagaaggcttaaattaactaaactcacctgttttacacagttgaacctggagttcttcaggcttatctgacccccaggactttgttatgatctcaagaatcgtgtagtgactggcagccatggaccatacaggatgaggagggtgtcttgcttagcttttgtgagccaggggaaggcagtgtgccacgcactgtcttttctgtggctgcttgcttcctgctgtgtgctgacatccccaccttactcgtgaggaaaatgaggctcatggctgtcagtggcttttcctgcaccgcactggggtgaggaacagaatctggggttgagcccagccttcccagcttccagccaaccttatatgcaaatacaggaattactgtcctagggaaagtgctgcatagacgatcctttttgttcttctactgcattatattattcacacagttataattcttttagctcaaaatataaaatgaaaagtgattgacattttaggctggatgagtaaattaaaaaaaaaaaagaaagaaagggggctttcgtggtaggcagagtgtgtaatgcccaaatcctacaagtaacaaaagaacagcaacttgggacttagggcattaggtgtgcagcctctgtgtgtgaaaactggctgtgggatgtgctgttagctctagcagtggttttagagttacgaagtggttccaagctcattaattagccaagccttaaggctgacctattccctgtggacaacacgacctcctttcagcagtgttttgcactgtactacagtcatccaactgaaaactcactgagttaaaataggtgttaggaatatgattctctctgggagatactgtggcattcccctgctttaataaaaataactgccccatattcagggacctaggaacggaatttacctgcgtgagcttattaatccctcatagccacccaacagttgcttcatcatggagcagagtaaacccctggggcctcaggagttggctgaggtcgtatagtgaggacccaggtttgtgcagtcttctcggggcatgctgtgtgcagtgggtacttacaagttaactggtaaatgtaattctcatgagctgggtgaactgggggcaacttcgagcc

SEQ ID NO: 221059 - DNA, 407 bp, Homo sapiens
cttcatctaggctgtagtcatctaatgaattgcttggatgttgtagtaaaggaaattgtataaaattgttttaaaaagatgtataaaatttaaaagtacgaaaagaaatacaggaacaagaatagatgtagtgaaaacttggcactatttctgacaaagtatttttttcaaagtttattcctaaatgtgagcaaagcagtcataaatgaatgtcagaagcagttgtaaagatggggcatggttagttgtggccagctgttttataaaaaatagattctgtttatacttgcagaaagattctgttaatgagcatttcattgtagctgacaaagtagttgggctaggaggccagtcactatgactttgcacatattacaactgctctaggcctcagttttatcacccat

SEQ ID NO: 221060 - DNA, 565 bp, Homo sapiens
ctgcctcacatgactaccactaggtagaatggaatctggtttgatgagtatttttaagtggacacatttacttcctaaacaaaaccaatattctattaataaaaaagaaggaagattcttgtaaggcaactaatatttctgtcacacagagaaaaacaaattgataatgcagtacaaggttgatattttaaggtagagatttttagcttgagcatttagcatccatttgttcttttaatgtaaatgtcaaacaaaatataaaaatcatatgtataattaccaaaaactatttaaaagtaaatttataattcactcaatagagtaatatagattaaataatttttgtaaaatttaacgtgtttttgctttcaaaaaatacaaaagataaaaaagaatatacagttaaacagtctatatgaaaaaaaccataaaagtgtcaaaagtaagattatggcttatgaaaattacatgtttacatttatggatgttacctgaatgtaaatgtaagtaaattgtaagtgtattataaatgaatgtaaaaactgaaataaagttgtttattggc

SEQ ID NO: 221061 - DNA, 366 bp, Homo sapiens
agtatcagaaaaaggggtgaggcaggaacaacatctgaataaataatggccgaaagtttagtaaatttgaatattatgtatacaaagatcttaaaagctcaacaaatttaagagaataccaaaacaaacaaaagtcaaaaaagtcaaatcaaataatttataaagagacaatgttaaaaatctaaaaaaatcttaaaagtaaccagagaatattttgtatatgcagagtaaaaatgacaggattttctactaattttgtatcagaattatgcaataaaaagacaatgtgatgatatatttaaatggtgaaagcacaatgaatagaaacacagattctaaattggataaccagtgaaatattttttt

SEQ ID NO: 221062 - DNA, 617 bp, Homo sapiens
ccacttcatatagcatcagccatgcggctcaactgagggctgttggatccacttctaagatgactcactgctggctggctgttaatgctgggttgaggccctggggccttggtttgtctccacattggcctctccattaggcctggacttcctcacaaaatggtggatgagttctaagggtaaacatcgcaagagagaaaaccagacaagagagcaaaacttgccttttgtgacctagcctcagaaatcacatagtgtctattaattgaagcagtcccaaagtcccacctgggttcaaggggaggagatactgactacactgtccttgatgggagggtggtaagattctggaagagagatgggaccagaaatgttgttgcagccattttggggaagtgcaatctaccacaacgcatatgtatgtactcctaggcaatatgctatttaattttgcatgttttacgctttatagaaacatccatactgaatatgtttttctacaactttgttccctcaacatttatgagtcgcttatatttttggagttcatttatttttagaattgtataatatttcattgcaattatttgctacaatttagttctctgttattttgg

SEQ ID NO: 221063 - DNA, 340 bp, Homo sapiens
tttccagcttctaagatggcagagaacgatcaccagcctgagccttatttccaggtaagtagctgaattagagttttgtcttaaaatttttccttaatgaataaaatgtaagattacccaccagctgcttttaatttctccttagcattagaacactcagtaatcatatgaattgtgcatttgtttgttttgcttaactctttctgtttgtttatgtttggggttttattgttgttgtttcgcttttctcccatctcttcctgacttggtcaaatccaaaggaatgttccaaattatggggagcaaggcatctgaaatggctaaaactcctgtggctgca

SEQ ID NO: 221064 - DNA, 631 bp, Homo sapiens
gacaacttgctggcccataccagtctattgtcctatcctggggcctaggagcccctgggccttccctggcttcataaaaacagttttcagcagtatttgcagacagccaagcccagtctggactgggagcccaagtgtgaggtagtggatggctcttgccaaggattgcttcctactcccaatgcctttgcagatagctaatgtcagatggcgtctggctccctcccttctcaccagggacagcatttgtcccccagctgctctgcctgcttcctctctgacttgctccctgtttgccaccttcttcaatgcctataggtgtccaggttgttgattatttgcctggactggaaggtccagtccctacctggtcccctgatacccacatttcagcagtgccccctatttctagtccttgtcccaaccccctcacctgggagagatgatatagttctggtttcacacagttctctactgaggctgagcactgccacttactgtctttgcggtatggacaaattactccaccttacagggcttcagttgccttatttgtaaattggagatgaccataacagagttgttgagattaaatgagctctttcttcttcttcttttttttttttttttt

SEQ ID NO: 221065 - DNA, 562 bp, Homo sapiens
tggcccagagatgggtatcactgccctacacatcgaactccgagccataggaggaagtagaaccaagacccctggacctgggcccaggtggccctcagggcccttgcccgctcaggtatgaagatcggacagattgaggacgtcactcccaacccctctgacagcacccgcaggaaggggggttgccatggtcactgtgcacaggactcctcaaatattttccgttaataaattaccttcctgttaaaaaaaaaaagagagagagagagagatgccttgcacatggagaaatgcacttaaacagagaaataaaaggtaagagtgtatcagcaagtttgatggggaaggatgggaagacccacttttggtgcgaaaggctctggaaaagcagcatctgtgcagggtggaaaaggtagatatagacaggacgggggacaggcatggtacagagaagatgcagatggatagatgctaaggtgtgggggtggaaagcacagttctgttaaagaaacaacatatataagccacttaagctggggagaaaaaaaaagcatgtgttcca

SEQ ID NO: 221066 - DNA, 383 bp, Homo sapiens
ggggtagggacccctcggtcttgccccttcccccaccactttaatccttcctctagtctcaaccttctctaggaaaacaagccctaaaatacaactggaaggaattttgtaagctctggggacgggaggcagaggtcgcccccagccctgtaggcccgaggctaggaaatggggagctggacgcgagtcatttaacgtgctgcgatatagagggcctcaaatgacaccttaactgaaaactattgcgctgaaacctccggatctcttggaaacgtggggaccaacgacttttttcaaaaccaaatttcttccgattttcttcaaacagtgaaacgaggaagtataaagaacttgagtatgaataaatttttaaaaggaaagca

SEQ ID NO: 221067 - DNA, 114 bp, Homo sapiens
tccgccacaaaaaaagaaagagagaaagagagagagagagagagagaacatcacttttggttatacagacaagccattaaaaacatagaaataaaaataattttaaattttttt

SEQ ID NO: 221068 - DNA, 1092 bp, Homo sapiens
aagcagctggtgaacaaagggtggatgcacttttctgaatctagggggagaccaggttagagccatgctaagtgaagctgctagggtaggtgggccaggcaggggaacaggcaaagatacccttggctcccttaaacttgggctagaaaaaacaaagacatggctcaaggagaaccacaaggtgtcactgttcatcctcagttaaacaaacactgatttgggcagggacttgagaaacactgcaaagaactttattttgcagatgaagaaacggaggcccggggaggtaacatgatttgactaagatcacgtaacaacttaatggcagaacaattatgagaaaccaagtctcttaactttcagactggcaggaccactttctcccattgctcctatgagatggcattttgagatgaggagtaagccttctctacaatcattcactcaagacaatggctttcaattagaaatagaacagaaaaaaaacaagagagagagaagaaaagaatgaaaaaagcgcagcattcactctcacatgtgccttattcaaagtgctgggctaagatgccagtgcccacaacgagagagtggcccacagggcctccgtctgtggcaggcttgaatacccgaatagaaaagtatcaggtaaaggatttcattctttttatggctccaacttaaaaagagtctggttcccaaggaaaacaggaagccaagttgctcagcaaagaattggctgaaacctaagtaggacccagataaaaacatttgctggatggaaggatgtgggcaaatttctgggccccgctgcttggggatgggaagctatgaggcagaagaccctttgtgaaacagtgacccgtgcaccaggcatttttgcggatgtctggaaactgcgaggcagtggaggagtcataagttagttggttttttaattccaactaactttactccaccaagtatctcaggagatttcgcctatgctctttggcctgactcccactaggcccttactccttccatggtggcttctactggagcctctttcttagttcccaggttattaaaataataataaattcaaagagcttt

SEQ ID NO: 221069 - DNA, 258 bp, Homo sapiens
agctggaagatccgaagtcttctgtgttcctttcccacagagggaagccggcgatgatggaaaaactcacctggaaaatggggtcatagagttctttcataaagctctcatgaggaccaaataagaagcctgcgggaggggtcatttttgagcttcccgaactttggcttaccctcagcttgagccagcgcacatctcctccttaacagcctctcctgagaataggctggcttcaaggtaaagcattatctgatctac

SEQ ID NO: 221070 - DNA, 405 bp, Homo sapiens
aggaagcaaacagtagaaaatgaagggtggtcctgaagaaataaagaaatcacaaaatcaaggccagtgatatcaatagaagagtgcagtcttaaagcaagatacacagacagatggcagctcaaactcctcatatctcaactgttattgccagaccaggaaacaagtaatttcaaaacgaacagaaaacaaagcgacagaagaaaaggtaatactgattacaaggtacccaaggacaaatacatctgactgaaaatctaaggagcaccaaagcaaagccatgaaaaagaaccaaaggaacaaaaataaataagaagcaaaatggttgatacattggcaaacagtatttatttaacgtatgtataaatggggtccctgaagaataaaaacaaaacaaaacaaaca

SEQ ID NO: 221071 - DNA, 601 bp, Homo sapiens
ctgatcttgaaagccttgaaaataaggaacaaaatgactagggagtgacttctattagatactgttagctgaaaatgagctttctgcagagattcttagactcattagagaaccattataagactaagaaggcagggctagatcccttgtaattcagatatgctggaaaattgcctttgcatgtatttgaattcttattaagctcagatttcttcaaaattagtttttattataataatggtaggtatccatccattaatataaaccacaaaaacagaaaaatctacttacaacttttcaacaaacagatttaccttccactgcctttgtgtcataagtaaattgtttgtggcatcttatgattctcaatataaatttggaggtgcatgttttaaaaatgagtgctagttattaattttatgggcttttgctactaaaatctgtaaccatttcagaaagcctcattttttgactggagatctggatatgtgtagtgttccttcctgcttatcaagggagtaccataattaaagagaaaatgactaaaaccttaataagagagaaaaaagtttcatctatatcttatatagaacatagtgca

SEQ ID NO: 221072 - DNA, 769 bp, Homo sapiens
ccgacatgtgatgtcatgcccagaggcccagctgtaaaattcctctctttatactgctgcctttatttctcagccggccaacacttacggaaaatagaacctacattgaaattcctgtttccactctggctggtgagtcaattgctcaattacttttactacctaatattgttttaaacaaaggagataagacacggggtcctaggatgggctctgacagtgaaaaagccacttattggattaatgtaatttctgaacaacagcccacctgcaccatacacattcaaggaaaaaagtttaagggcctactagatactgggtctgatgtttctattatttcctctaatttatggccttcctcctggcgtaaacatcccactaacatataactagcagggattggaaaagctgatgaagttcaccagagcacatttatcttgccttgcactggccctgagggtcaaaagggtaaaattcagccttatatcatgccaatctccactaatatttggggtagagatttgctgacacagtggggggctgaaattaatattccacataactcttacagtgctcccagtcaaaatataatggaaaacatggggtttgttcccggactcggtctcggtccaagacatgaaggaattactaaacctcttcaagttactgtagaagagggctggtttaggtcatccttttcaatgacagccactgctatgcctccctacaatgaaaatctgaaacacctgtttggattgagcagcggccg

SEQ ID NO: 221073 - DNA, 174 bp, Homo sapiens
tgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgc

SEQ ID NO: 221074 - DNA, 416 bp, Homo sapiens
actcccgatctcaggtgatctgcccaccttggcctcccagagtgctgggattacaggtgtgagccaccacgcccggccatatttttattttaatatttcctgaaacttctgtgggtacagaaaccacaaactgatcggctgacaaaagggggaagaggcaaggcaactggaaaccttcggggaccagttccctccacgcccaggtctcttctccccagcacagctcagtccatagcctggacgtgccagcagggaccctcaccctacatgcttcgggatacagccttaaccccttcccccacagcctggtggcccagttctgtgaaggaaccaaggcaaggggggaatatccctgctgccacatcccatgacgccactcacagaccctcagttgattggcaacattgaacaggtta

SEQ ID NO: 221075 - DNA, 557 bp, Homo sapiens
accttgtctctaagaataaaaaaaaaaattaaaaagaaagtctcaagatgagtagagaacagatatgtaataaagcaagcacagcaaaaggttaataggtacacaggtgttcactgcaaatttttttgacctttactgtatatttgaaattttcataacaaaatgttgggtggggtacagagacctaacctaacaatcaaatgcagttatgtcgcctaatttggatcctgactctaataactaattgtaaaacgtaattgttagatttttgtaaggtgtaataatggtacagtggctatattttcaaaaagagttcttattgctaggtgtggtggctcatgcctgaaatctcaacactttgggaggccgaggtaggagaatagcttaagcccaggagttcaagaccaacttgggcaacatagcaagaccccatctctacaaaaaaatttgaaaattagctgggtttgctgacgtgtgcctgaggtatgttgcctgggctgatctcgaactcctggcctcaagtgatcctcccgtcttggcctcccaaacagctggga

SEQ ID NO: 221076 - DNA, 602 bp, Homo sapiens
gcttctaagaaaccagtacacaactacagccctcagaaatactcatcctcatcttctttcttcctctcctttcagaatagggtgctagcaagtcttatctgcagatgaggccaggcaaggtggctcatgtttgtagtcccagcactttgggaggctgaggtgggtggatcacttgaggccgggagtttgagaccggcctggtcaacatggtgaaaccctgtctccactaaaactacaaaaattagccaggcatggtggtgcacgcctgtaatcgcagctactcaggaggctgagcaaggagaatcgcttgaacctgggaggtggagtttgtagcgagctgagattgtgccactgccctccagcctgggcaacagagtgagattccatctcaaatgaataaacaaacaaacaaacaaaataactgcagatgaagtaggaggtcaccttaagcatgttactcaaattctctgagcatgggtcctcatctgtatctatctcatgggtttgaggtgggaggtaaatgagatcattcattcagttcttagtatagtactaccttgataaatatcatcatttcagcagctgaaggccattctcaggta

SEQ ID NO: 221077 - DNA, 309 bp, Homo sapiens
gtaacttagtagctttctcagttatcagattgtcttgggattgcagtgcctgtgtccaagttatccttattcggtttaataatggtcccaaagcacgagcgtggtatattgttataattgttctattttattgttatttttgttaatctcttactgtgcctaatttatacatttataaattaaactttatcataggtatgtatgtatatgaaaaaacatagtatatatagggttcagtactatctgaggattcaggcatccactgggcctcttagaacatatccacgttggtggtgaaaccccgtctct

SEQ ID NO: 221078 - DNA, 336 bp, Homo sapiens
agaaggaagccagagagtacctgggttcaactgaagtgccagcctgctccagccagagaagcacaatttgtgagaacagggaaaacgaacccaagctgctggaacccaatcctcttgaattaatggcttcataggtattaaaaaaaaaaaaaaaggccgagcgtggtggctcacacctgtaatcccagcattttgggaggccaaagcaggaggatcgcttgagcccaggagttcaagaccagcctgggcaacatagggagactcatctctacgaaaaataaataaataaatgattttaaaatggcacaaaaaacaaaccagacccctggactgtta

SEQ ID NO: 221079 - DNA, 584 bp, Homo sapiens
ttggaatgctcctccgatttcaaatgacccgggggaacatggtggtttcgtgaaaccaaagtcagctttgaagaaagctaatgtcagcctcaggttcaggcagtactgtagaagaacactgagctctcagtagctggctagctgtgctgccttccccagtctatttcacatccgcttttatatcaaggcagatgacaaggaaacaaactgacgtcagtttattaaaggaaacacttgtgatattgggagtaatccctcaggcaagaggtgctaattgaacctaagagtatttctgaagttactattttcaacagtagagaaggaaattattgatcatctcatccaaaattgataaaaacctaagtgtagcagtctttcaaaattaaatattctcagctgtggaatattctcatgcccaacattgctacttcctcaaccatttctagatgattaaaattacactgtaatgccatgttgctcaatatgcatatttgttgtcatttttgtctgttcatttcttaggaatgtctttgccaccatcgaacagtcatcaggaacttagttgcatgccttttttttttttt

SEQ ID NO: 221080 - DNA, 373 bp, Homo sapiens
gcttccagaggttctcactgtcccagccacgtgcgtggcggacactctttacgttcagtttctgtgtggatgaccagaggctccttagacacacagctagacacagataactgggccaatcctcccacaaagggggtccgtagagcagtggtgacttacacaggtcacacgtgaggtcaaactttaagtccatgtcaggccggtcgcggtggctcatgcctgtaatcccagcactttgggaggccgaggcaggcggatcatgaggtcaggagatcgagaccaccctggctaacatggtgaaaccctgtctctactaaaaatacaaaaaattagccaggcgtgatggcacgcgcctgtaaccccagctactcgg

SEQ ID NO: 221081 - DNA, 588 bp, Homo sapiens
gtaattaggagaaaaccattgaggggggtacttatatttaattggtgagtaattataatcagtttaggattgattatctcagccacagtacttagtacagcaaaagggaatacagatttcatggtataaatatagtctcacattaacatattgacttttttttttgagataagagtctcactctgtcacccaggctggagtgcagtggcacaatctcggctcactgcaatctccagctcccaggttcaagtgattctcctgcctcagcctcccaagtagctgggattacaggcgtgtaccaccacaaccagctaatttttgtatttttagtagagatggtttaaccatgttggccagactggccattttgacttttaaatgaacaaagttcaagaaaaaaatcaaaggacagttgatgttatttcctggatttacatatgggtcttaataagaaaactaaatcagatttttttggatgaagttttataaatcttggacaaattattttattttattttattttatttcattttctgttttatggctttattgaagtataatttatatatcttgacattcatccattta

SEQ ID NO: 221082 - DNA, 230 bp, Homo sapiens
gaaatctgagctactggaaatgactgagaatcagatataaaggcagtcctggtggtccgttctggctgccgttgctgtgtaacgaatctgccaaaacttagtggcttgaaacaacaaagaacattttattatctctcattgtttctgtgggttaggaatttgtgagagccgtgctgggcagttttcgtgcggctgtctcgtggttgcacctacatagttgctagagctac

SEQ ID NO: 221083 - DNA, 510 bp, Homo sapiens
ataaacagagttattcaccaggtcagaatgaatgaaaggaaagagatgaacctgcagttctatgagtggcaacgccacaaggaaaaaatatttcacagccagaagtgaaaggaaaaggacagatttgttagggattttacataatatagtgtgtagactaatactgcgaacataagtaattgatcttttttaaataatgaagttcatgagattgagaagaaaaaaggaatgctgggagtgcaaatcttttcatattgaatgctaagataatttgctttgattcctttctccttttgagattcccttctatgaatgtatctcttgttgatttgtactgaacagctgaattttctctattctaagaatccttttggaaaataactgctctgccaataatggattttcttctctataactacagtgatgccttcctttaagaaaacaatggttagttagctacttactacaactgagtcctgttagcaaaagtctttccttagaataattctt

SEQ ID NO: 221084 - DNA, 462 bp, Homo sapiens
agtatacattttatggatgctaaaaatactctttagcaatgtttctattcagaatgcatcatcattagagaaaagctattaaggttgcagtgtgaatcaccagttggaaaaagagaaaacatatttcatttccagtccggaagcaatccatgcatgcaggcagtattcattttaacagtctggatcagttttttaccatgaacttctgctattagaaaaaatgcctttgtctaatctagctttccttagatgtggtgcaaactcagaactatatgccccggtcaatgttagagaccctaaaaccccagctcatttggcatctgttcattcatattccagctgaatctcagaaatgtgcttaagggaaagcatctgatattagcagtttctcagccaagtcacaggacgggacatcccagagtcatggcctgctgcacttttaaaagggaaattcaggaatca

SEQ ID NO: 221085 - DNA, 473 bp, Homo sapiens
gaggagtctcactctgtcacccaggctggagtgcaatggcacgatctcggctcactgcaacctccacttcccgtgttcaagcaattctcctgcctcagccttccaagtaactgggattacaggtgcatgccaccacacccagctaatttttttgtattttagtgcagatggggtttcactgtgttgcccaggctggtctcaaagtcctgagctcaggcaatccacccaccttggcctcccaaatgcatgagccacagcgcccggctgtatggtggtaatcttaatttggaatcaagtttgtctaattccttagaatactctttctcttttgtgagacaaagggacatattccttctacagtattgttattaaagatagtatgtgccttacttgccttcagaagccacaatcttaagtactctggcacccattgatattactcatgcaagactttctggaggaagatgttgtcg

SEQ ID NO: 221086 - DNA, 456 bp, Homo sapiens
gctcatgttaagttaatgatgtgtatagtatgcaatgtaaatgctcccttgtaattcaggatatccagtagaataggaatcaggagaccctattttaacaaaagttaagaaactgaactccagtttcttaacttttgtccttttatgcatttctcactctttgactaccacatgccaagcactatgccaggccacagaaatgcaaacacagtaggcattgcactacccaaaaagaaatccccacccagccaaggtgacagataatgtgaatgtagtaagcactgtgagagtgcagggaggatggaatgagctgagtcacaggaagttcaggaaccgcttcccaggaggggtcatgcttgcattaaatctggaggtaaccacaaaatcagtataaaagcatatggttagtttaaaatatcaggtgttcattacaccattctttctacatgcttgaaa

SEQ ID NO: 221087 - DNA, 501 bp, Homo sapiens
ccacgcgtccgacttaatgttgtctaggaagatagatgtgtctattcctttttagaaacgttttcatccaagagaattcacttgtttttatttggcattaatggataacccatacttgactagaaaatttatagagcacttcattcttcaatatttctacataaaataggcatcattctagaactacaatcattataatggggagatgtgaaaaaaaatgccagcatctgactgaagtggtaaatgtgatttgaacatttttccaagtgttctttgtggaaaagtcattgctggggaaatggacaacctgccctctacagtaaaatcataccagagttgctttctgggacaacgtttagcatatttagcacgtttaacattgcccagtcatgtgattcacaaaaccattgtatgtacatacatgtgtgcacgtctacatagttccttattgctatgataggcaagtggatgtggataaaacttctctccagtttcactctc

SEQ ID NO: 221088 - DNA, 871 bp, Homo sapiens
tttttctttgtagctgtaaacagtcaataaaagggagtcaaaagtaacattcagcattctgaatcctgttaatataacttgggtagccttccttctctccatttaatttggcggaagagagctgcatgtaaacctttcctatgaattcggtgattccccagatcacttaattctacttttagcagcaaggcttacagatgatgccttcaaatgaggcagatggggatgggtgaatgaaattttttcctaagtgccagttaaaaagcacggtgttttgagaatacaccattaataatgtttatggaatgattgcaaccaaaaaggtagctgaatatttcttaagggaaggaagcattgtgcatgatgtctttctttagaaagcttgattatgtttaaagttctgttgcttttccccactgcagtttgtcagttaaatattattaacactggcagatgttggaaagccaagcaaacaagaattgctattaaaattggcatacctttctctgattaattttagtttacagtgtataattccaaagctctttttgtatgctgtgcaggagattaccctagagctcagttactgagcagattacaaagagactggatttggtcatttcattaaattgcaagcttgcttcatgctgccgtctaagcccaagaattggttcaagtctcaaaatggaaaaattaaaatcatttcaggtttatttcactttaagcaaatctacatacatgctatgatgatggtatgtgtgagcttggttttataactaaatttgaaagttgttcactttctgaggtaaatcaatgtggatttctttaaataatgctctttcccaggtgtctaatgttcgtgtctattacc

SEQ ID NO: 221089 - DNA, 777 bp, Homo sapiens
tttttctttgtagctgtaaacagtcaataaaagggagtcaaaagtaacattcagcattctgaatcctgttaatataacttgggtagccttccttctctccatttaatttggcggaagagagctgcatgtaaacctttcctatgaattcggtgattccccagatcacttaattctacttttagcagcaaggcttacagatgatgccttcaaatgaggcagatggggatgggtgaatgaaattttttcctaagtgccagttaaaaagcacggtgttttgagaatacaccattaataatgtttatggaatgattgcaaccaaaaaggtagctgaatatttcttaagggaaggaagcattgtgcatgatgtctttctttagaaagcttgattatgtttaaagttctgttgcttttccccactgcagtttgtcagttaaatattattaacactggcagatgttggaaagccaagcaaacaagaattgctattaaaattggcatacctttctctgattaattttagtttacagtgtataattccaaagctctttttgtatgctgtgcaggagattaccctagagctcagttactgagcagattacaaagagactggatttggtcatttcattaaattgcaagcttgcttcatgctgccgtctaagcccaagaattggttcaagtctcaaaatggaaaaattaaaatcatttcaggtttatttcactttaagcaaatctaccgtggcagatctaccgtggcaatgtaccgtggcaaattaccgg

SEQ ID NO: 221090 - DNA, 523 bp, Homo sapiens
aaaagcactggagaggccacaaaagaattctctcagcatggaaatggggaaggcatttctaagaatgaccccaaacccaaaagccatgaactaaaactgacacatttaattatacagagatcaaaaaatcctacacagcaaagtgaccataagcagagccaacatagaagcaactagagggaaacatgtgcaactcatatcataggcaaaagcctaaattgcctaatatgtaaagagtgctgccgggcacggtggctcccgcctgtaatcccagcactttgggaggccgaggcgggcggatcacgaggtcaggagatcgagaccatcctggctaacatggtgaaaccccgtctctactaaaaatacaaagaatcagctgggcgtggtggcggttcgcctgtggtcccagctgctcgggaggctgaggcaggagaatggtgtgaacctcgtaggcggagcttgcagtgagcagagatggcgccactgcactccagcctgggcgacagagtgagactctgtctca

SEQ ID NO: 221091 - DNA, 591 bp, Homo sapiens
aagaatggaatgatttcaaagtttgtaggaacttactggtggagccacgtacctgggatttgtgtgtatgaagattcttcactactcattcaaattatgtaatagtttctctacttttgagttgtttttcttgaagtttgtacagtcatctaaatcttatttgcactaaattgtttacaagattatctaacttttttgatgtctatagtatttctagtttccattcttgataaagattgttgacatccctccttttatagctattagatgtttgccaattttaatttttcttttccaaaaaaaatcaacttttggcttctttcaacctattctatgctgtggtgtgctagtgagttagctccaaacataaaatcctggcttgttgatttccatagtgtaaacagtcccatcatggttgacttcaagctacttatttgaattggctccaaacataaaacaaaatcctggcttgtttgttgagttccatagtgtaaacagtcccatcgtgggtgacttcaagctacttatttgatgttattgatcatggagttgccaagaggtgtgcacaattggctctcctatgccagtaca

SEQ ID NO: 221092 - DNA, 358 bp, Homo sapiens
tcgattttttaaaaactcttatctcagtaactggtagtataagtacatgaaaaatcagtctaccatggtgaatgttacatgtgcaattgcaaagaatgtgttttctgaagatactggatgtagtattttataaatgtcaatcaggtcaagttattttacactagtgttcaatccttctatatccttagtgattctctgtctgcttatttttacaatttattttgttaaatcatgctctgtgattggttgcatatgcacttaggatttttatatcttgtaatgaattgacttgtttatcattatgaaatgtctttatttctggtaatatttcttttcctaaaatacactgtctgattta

SEQ ID NO: 221093 - DNA, 580 bp, Homo sapiens
tgaggttaggtacttgttgtggctttagagtgaaacacacctgagcttcaatcctggctccactatgtgtcttctatctgaactaattacttcacagctctgtgcctcagtttgcatatctggaaaacaggaataatagtctacctgctcaattgaaagggaggctaaatgagcctcaagtgcactgtaatgtacatgggacagagcctggcatgtggtggactctcggaaatgttaatgcatctggttatcacagtttccaggagcaaaacagagggaaggagacacagggaaaccaagctgatttgattagaggtcgtggtgagcagtgaaaaacactcagagtggccaaccagggaaaaatctggagaacttcacggcacattatggcttgtaagagctgactaggggctaatgtgcaggataaagggcacctgggttcaggaaggattcgtctgaagggaaatcaagggaaccattgctaatgaaaatgtcagggcccacctgtgataaaatccgggcagaaatcaacaattagatccagaaacaaacatatagacatgagcttgaattcctaggg

SEQ ID NO: 221094 - DNA, 226 bp, Homo sapiens
aatttggctcttaagaataaagctgctaggagcattcttgcacaaggcattttgagaacatattttcatttttcttgaggatatacataggagtaggtttgttgggccatagaaaaggcatatatttaattttataagaaacagtttccaaagtgtttttccaatttactctcccaccaataatatctgaaaattccagttgctccacatctgcagcaacttcacc

SEQ ID NO: 221095 - DNA, 555 bp, Homo sapiens
tgaaggaagaaaatgtgtccctatcaaaactgttcattctttctcaattgctaatgcttccttgaggatttatggattcagcactaataaactgtggattggaagtttaactgaaagactgacctatttcacctctgtactggaaagaaaagcccagattacagtgaaattgagttccagaagttaagcaagaggaacttccacttttgaactctgcagtaggaaggggtagaaattgagaattggttcagacatggaagtttatagaggattcgaaaacatttttatttttttcagagggaggggctttccaggaatgccccaaagcccccaattcaatttaaacacacaaagaaaatctccacagctccatgccacatggcggtatttcactccaacacaagctttttggcatagtgtccagggctaaatgtttacaaatactgcattttgtttgtagggctggatctcagagttcagatctcatactctttagttgcattaactgattccaggaaaagaaactagggaaaagacttaccaaaagcaaagaaa

SEQ ID NO: 221096 - DNA, 523 bp, Homo sapiens
ggctccagcaattactagctgtgtggttctgtgttaattacttaaactctctgtgcttccgtttctatctctgtaaagtgggaattatatccacctcataggttgttatgatgattagaagagttaataactgcaaagcactcgtgctgcctgacacatagaaagtaatatataaagatttattaagtaaataaataattgtgttaatttctgtccttatctccttccttgtatatttttgaaattaatgttactctctttatagattcttaggttttgcttctcttctaatataagaattggaagttaaatattttcctcgaattaccacttttgctatattctataaatttagctatgtggtcatcgttttggggttttgttgttgttatagttctagatggttttgaactatccattatggatttttctatgatcttggagttatttacaagtactttaaaatttttctctatgtaacaatatcttatgtttttgtttctatcttgtaacctttggttaa

SEQ ID NO: 221097 - DNA, 456 bp, Homo sapiens
agtgagactctgcctcaaaataaataaataaataaaatttaaaaataaaataaaattgagaaaattcctttagttttcttctcctctgtattgggaaaatgatgaatttcaaatgaatgtagtagctggatacttctgtttcgccaatgaaggacattctgtggagcatggcttgtgctagcacagttccttgtgcatgtcgtagtagctactaaatgagggatggttgttttaggaatatgacagcattcagagtgccagagaaaccttgttgattgggcaggatggtgtgtagtgtggggtgttcagttttgtgatttcttctcacattctatagtgatattccaattctctctatataaaattttaaggaattcatctgttttataagtcgaagggtactttccttagactgtaatgaatttttaatgaataaacttatgttaccacttaaga

SEQ ID NO: 221098 - DNA, 402 bp, Homo sapiens
ctgaggcaacttttatatcataatgttttattatgatgatttgctctgaagtgttcttttgttaatagtgataatcatatttcttttgggacctttgaattttaataattatcaatttaataattaacaaactctttaactcaaagggatgagactttagttatggagacttgtgaagactatggtgggctgtcaggggtgagccttgtttccctgggggagatttgggacaggagatgggtgtgggaggtgtgggctgtgcagtcacactgtgaagcacagtgcccttgaacccatgaattctgcttttgttctgtgtctggatatcagaagtaactttgactaggaccgagacattcttcagtgtttgcctcacaatgctgaaatgtgctttttatcatc

SEQ ID NO: 221099 - DNA, 558 bp, Homo sapiens
caattcccagaatccctcaaatgcagatgcaggaggtggccagtttttacaaaggcagggctgtgtaggaggaaacataggtgttatcttagatgggagtgattatttgctaaatgcaattttgactgcttctaatttgctgctcagagattccgtccttgaaccaaacaccaaaatttttaagttgaaaagattgaaatagcatcaggtagtaatgcagatgttatagaggacaactcttgcatctttcaattccttggtagttttgccacccccatccctcatcctttactggttttagtgaattctgaaaggggactttgattctctgaatggcaccaagatagaaaatggctttggtaacatcttagagcagtgagtagttcttaaccagggatggacatcagaatcccccagggagtatctactaaacaccaggcctgctgaatcagagtctgggtgaaaggcaggcacatgtagttaggaaaagctctggatatgattcagctgtgccttcatgactaagagccactgctctgttctactgccattctgtga

SEQ ID NO: 221100 - DNA, 389 bp, Homo sapiens
caatttgttatcatcattattaatataattactagattttccatagtatgctattatggactgaatgcttgtgttatccccagtttcacatgtagaagccaaatccccagtgtaatggtgtttggaggtgggaactttgggaggtaattaggtcatgagggcagaaccctcatgaatgggatggtgctcttgtaagaggatacgtgagagagcttgcttactcttcctctctgctatcagccagaggagggcacaaggagaagatggccatctgcaaacccagaaatgaggcctcaccagacactggatccatgagcaccttgatcttggactctccagcctccagaactgtgagaaataaatgtttgttgtttaatccacctagtcta

SEQ ID NO: 221101 - DNA, 128 bp, Homo sapiens
cccctcagcagagacctcaacgaatctttattcctgagaactcagcagcctgctctcatttcccctacggacatgaaggccactgagacaggtcaggactcagccccaggcctcctggacctccttcc

SEQ ID NO: 221102 - DNA, 433 bp, Homo sapiens
atcatcaaacttgggggtcccatctgtggttgtctacatcatatactatctgttcttataacgaggggtttcactgaggaagactccttccaaggtccagtaaaacaacaaatgataaacaaccaaccaacaaaacaaaacccaaaagagctaattatgggccattctgaagtccatgagcaatattctatttccttcatgaatttctaagtgacaatgaacttccccaccatctaggaacatctaagaggggaaggaagaaaattgcagcatccgctccccttagaggcttttaatactcaacatcaatttctttggcctggtgacagagcccatcatccaggtagaaatgtggatctggaaagaacggcctccagtctgtgatttaattccacaagtttcaacactattgtccaagagtccgagattaaaa

SEQ ID NO: 221103 - DNA, 511 bp, Homo sapiens
tgcggaggctggtttcttccaatatgtgttgcaaaatgttgaggtcattctgtttttgcttttctgggagtgcttttatctgtttgcctaagaaggagtccctcaaatgtgctgctttgtctgatgcctgtttcccaccttaataaactttctctgccttgttgctgtagtctctgtggcaagaagagaccctttctgataggagtcttggtagggaacagaacttgcccgcccccaacccagtcccattgcacaacaccgtgatgcttcctgtgtaacatggtctaccccctctctagcagcactagcacgagggcatgccctgtgaacctgaggctcttagtgcctgggccacacaagcacacaggtcaggcttttcctgccaatcataagggaaggagtgaccaaaataacatgtggggaagttacaatggtttgggaaacctcaaaaaattctaatggcagtgattttacagtctatgctaaatattaatgaattactttcttttaa

SEQ ID NO: 221104 - DNA, 637 bp, Homo sapiens
tctaagcattgaacgcatcctccttttgttgcagtctgaaactttttccaaaaaataaaataagtgagaaatacttgactcaaaggaacataaaggagcggagggtttttatctgaaagggaaattgcaattcccaaatgtagagaccattgctttgaagttacttttatccaacttccctggtagagaactttttaacctcagcttcatttttgaaacattgatacgcttaccttccatgttgccaaaggacaaattaaaagacacagttaacaggcaagcagccatcttatctcctgtctgagccactctttcttccacttttgtcaccctttcaagtcactaccgagcaggctgagcagatgcacttatccaagatgagtagataagcaggtattctgggggctgacatggaaagggaactgtggggcatggtgatgatttgtggtttcctctattagggaaattctgggggagttcagttgactgactattgaaaattgcttaggaagcctgtgggaggcttttctttctctatttgtagaaataaatattactgcctaattaagtgtcagtcagtacattcaaacacttctgtttgatattggtgggctcctgtggaaatggtcccctttag

SEQ ID NO: 221105 - DNA, 408 bp, Homo sapiens
gctgtgtacaggggggcttgtggccttcaggtggcatgaggcaggccggtgggggaggggcacagggtaaagtccccaatccctgtcttaccctgtcagtggagaggaaaagaaaaccacctgtcccagtccctgtggacccccaaggagcaggccaaggacctccagcatcacagcctcgcatgagcccggctggggtggtcagtcctgtggcccgggccaggtcagcggtcaagctggcaggtccagactcgcaagaacgacccagagagcttgttcaggctgggtttctcagccccccactgcgtctgcttctgtgggtctcgctgggccccggaacctgcattgctgctgcgggggtctgggtctgagggcgcagctctccctgctgggtggggtgtgggaggc

SEQ ID NO: 221106 - DNA, 559 bp, Homo sapiens
gttttcacacatagcaagattttgttgttttcgaaggttgagtaatattcaattgtattatacaccacattttctttatccattcatctgtcaatggacaatcttttattgaacaatttattagtttttagtggtcaaagaacaagatcatgtcctttatatgatttatatgttttggttgttattttagaagcccttctccatttcagtagtataaatatatgtatttctgacctttttcttcttatactgttagtttttcagtataacattgaacttttaaaacaccttgactttttttctgagtatggtatgaattagggatatttgttacttttttcccatattaacagttattcacctaattatactttattcagttggtctagactttttcctacatatttgccatctttattataatttaaatcagcatatacacttggatttatttttggtctctctacatagggctatgtatctattgtttaattcttagagatttatgtggatatgtggtaggtatatgtcttcactcactgcgcttattttcaacatt

SEQ ID NO: 221107 - DNA, 141 bp, Homo sapiens
aagtttccttctgttccctcttactgttatatccttggtttctctggtgtggggtcttccttacagcagcaagctcataaacttaacttgaccgcaggtgtgttccttggtggtctttatctgatagactttgtcacatgg

SEQ ID NO: 221108 - DNA, 380 bp, Homo sapiens
ccaaagtgctaggattacaggcgtgagccaccgtgcctggccccaagctgaggattatgtacttaactaaattgaagcttttcagtggctatgggtgcacctgacttaggaactatatagtctagtagcagtgaggattggcttggggaacaccaaaagcaggaaaggcagttacaggcctgttatagcaatgttggccagcgatggtgagaatctcagtgaagctgtgggaatagaaagaaaaggattttgaagaattttctgaagtagagtcaagacctgctgtcacaatgaatatttttagatgaatagatgaatgaatgaatatctcagtaattttatatctctgtttatataagtagccagcattttcttttttt

SEQ ID NO: 221109 - DNA, 618 bp, Homo sapiens
ggcaccagggagggagcatctgttttttctccagtactaatagtacaggcaagtcaacatggctatgaagctataccatttattacatacacaaacaggatcagaatcaaaggagagaactcccagacccctgatatgtactctcttttgttgcatcattctttttgcatgatgcaaactcccttcacactttcccccgaccttcccctaaggtgcatctacctagagcaggtgtagccccacctttggtattttgtagtttgtttccatgtttatttctcaggcattgagagatagggtatgtgtaaatgcagctttgtctatgacctttaactcttctgtcagattctcacagtgttcttggctatcttcaaccacagttaaaagaatgaaaagctttctacaattttgtttctttctctctttgttctatctgtctgtccttgtcccagtacccctcctacaaggtctgtctctctccatccaagtcctggctaacctttagtttctcctgaatttattagcatacctccttgatgctttctttcaaccagtgtagtagattccttttctgatcatatttcccattcaggattctttgatctttacatatagctt

SEQ ID NO: 221110 - DNA, 306 bp, Homo sapiens
acaccaggaaaacaggagatcagcaaatgaccacagtggactggatagcaaaggcccttcctttcattatcaggcagcttataagcctctctgactctgttcagggcctccaaaatacccaccagaacgtatttctttagaaaattgtctgtagaaaacccctgtagaagtacaggagttcagtatctaatttaacccagacattttgaaaaaaaaaaatgtgtttcttgcatagttaagtttgtggaccaaaaagtatgttgcctggaaaaaatgtcaaagttcaaaagagaagagttccctctg

SEQ ID NO: 221111 - DNA, 442 bp, Homo sapiens
aaggcatctgctctttcagggaatttcctgttccccaacctagcctggggcagactggttctctctgctttggtagctaatacggttggatgtttgtcccttccaaatctcatgttgaaatgtaatctccagtgttggaggtggggtctggtgggaggtgttagggtcatgggggtggatccctcatgaatgtcttagtgcccacctcgcagtaatgagtctcattctattagttcacaagagagctggttgtttaaagagactggcaccttctcccttctctctcttgccctctgtcaccatgcgatgtgcctgctcccgcttcgccttctgccatgattgtaggctccctgagtcctcaccagaagtagatgctggcgccacacttcctgtacagccttcagaaccatgagccaaaataaactcttttctttataaatta

SEQ ID NO: 221112 - DNA, 349 bp, Homo sapiens
gctgtatccttctaccccttacctttcccagcctctggtaaatactattgtactctctatttcaatgagaacagcttttttagcttccacatatgagtgagaacattctgtacttgtctttctgtgcctggcttatttcacttgaggagcttctgactaaattccttatgctttgctttttgatcttctgttacctcaatttttttcttcttgaatttcattttcttctttgtctttgaccctatgtatagttacgatgccagattagatttatagcagcctcaagttgtattaaatgatattttgcttcctgtaatactattataaaataaagtttgtttattctcta

SEQ ID NO: 221113 - DNA, 1072 bp, Homo sapiens
gtgctttcctacttgttgtctcctgtaatgacgtatcatatcctgaatggcgggagggcaaggatcattagtctcattttacacatgctcattctgggactgggagagagatttcctgatttgcctaaactgccacagtttgtcaatgatggtggagggatgggggcaacactgaacctccagcttcctaagactttcccactttctcaagcttttgtcgaatgtgtcattagtggcattcactttggtcaactttggttccttgggtattgctggctccccatttttttggatttaaactcttcaaattaaataaatcagatttacatgttaaaaagaaaagtcttctctaaaagactccttcatttttgtaaatctttgtaataatttcaacagaccttaccttagaatttcaggcaataggtacatatcgtacacctctgttagttcttccagagactggcgcaggggttggagatgggagggaatagatgggggaaggaatgtggagcagggggcctggactccagtccaagctctgctgaaggagggccttttccaaagtggatcctcctgaaggcagaggctcttctagaacacataaatgtgcagcattggctagtaggagtcctgctggaacgaggctgaggcacatacaggatagtttataggagagtcaagtctcatgcattaaaattaaacaagcacttgggctttgttggaataaagatatgctagaaatgtcaccaaggatatataccaaatgccaaatgtagtcatatacaatgaaggagagcaatggtaggagaggtgtcggcaggctggagagaacaacaagtgctgtgggctaggaactgtgatttggaagtgtgcaacccaaactaaaaggagagaaaatggttacagccactggcagcatcccagagtcttacctactgcctccggtcctttgcaagtaggtagggtataaatataatgttatctgcccagcacaaaggagaggggagaaaagaaagcaagaggcagtcaaagggacagagcctagttctgagtcctgttttaccactcaatc

SEQ ID NO: 221114 - DNA, 544 bp, Homo sapiens
atctagagacagaaagtagggtcgtggctgctgggggctgggaggatgggggaatgggcagtgaaagctatgggtgtgagcttttcttgtgggtgatgacaatgttctgaaattatagtagtgacagctgcaccactctgtgaacatagtaaaaatcactgatttggccgggtgtggtgggctcacgcctgtaatcccaccactttgggaggccaaggcgggcggattgcttgaggtcaggaggcctgcacctgtagcccagccaattttttagatatttttatagagatagggtctccccatgttaccaagggtgatctcgaactccaggcttcagatgtcctcccagctcagcctcccaaagtgctgggattacgagcgtgagccatcagacctggcctccgagattctttttgaaaagcttctaaatctgaattctctgtgaatataatttgccaaaacgtatgagtaggaatctgatattacagtctgtcaagatgtctggccggtgtcgctatcactccatataatctttcccttcccc

SEQ ID NO: 221115 - DNA, 437 bp, Homo sapiens
ggttcttgcgatctcggtctcaagtatttgattctgtagcatggaaacagccatagatggtatgtaaacaagtgagcgtcgctgtgttccaataaagctttatttatagacattgaattttggatttcatttaatttacatgtgtcacaaaatattcttctttgagttttttttcaatcacttaaaagtataaagtcatactgagctcttaggcctttgcataatcaggtagtgggccagatttggcccacaggccctagtttgctggtccctgtcatagatgaatcttaaaaacattatgccgagtgaaagaagccagatacatggcctggagcctgtaatcccagtactttgggaggccgaggtgtgaggttcgcttgagcccaggaatttgaggccagcctaggcaacatagagagacccagtctctaccaaaa

SEQ ID NO: 221116 - DNA, 399 bp, Homo sapiens
attgttacaagtagattttaaatgttcttgccacaaaaataactatgtgaggtaatgcagatgttagatgaagaatagctcaattaagctacttcataatgtttatatatttcaaaacattatgttgtacatgataaatgtgcaaaattgtatttgtcaatttaaaataaaatgtttaaaaagaaatttatgaaggagggttgttaaacaaaaaaggtagattgataaaaagtaaaattctagttacagatttggtctaaaaaacttaaaattataaataagcaattagctagattaaacaacagtagaagaaaaaaagtcccataattagacaaacgtagcaataagtaaaaacaaagtaaccatagataatgaggaaattaggtatataagattaat

SEQ ID NO: 221117 - DNA, 504 bp, Homo sapiens
tacatttaaaatttggacggaatgctaagagtggataagatgcaccaaggagtgagtgcagatgagatgtctggggacagcctgaggacaccccgtacgttcaggagagacaggaggccaggcacactggctcacctgttaatctcagcaatttaggaggccaaggcaggaggatcgcttggggccaggagttcaagaccaacctgggcaacatggcaagaccccgtctttaccaaaaaccgcaaaaaacaaaaccacttccagtggccccagtcttatgtggaacaaaggtcagtcctcaccatgagccacgaggcctctagggatttggcccctcctgcccaggctagtttcaaactcctgagcgcaagcaattgcctcagcctcacaaagtgtggggattacaggcgtgagtcagggcactggcctcatggggttcttaatttccgggtttaggctgcttagataatatgtcgatcttggcttataaaaatcttgccatcc

SEQ ID NO: 221118 - DNA, 437 bp, Homo sapiens
atggctgtgcagtattctacggagtatatgtaccatattttctttatccagtccaccattggtggatatttaggttggtttcatgtctttgctattgtgaatgactattactttaagaagcactaggaataaacctgtatttttgctcttgggtttattcctcttcttccaatatggatataaaggacaattctatttaaatatttttcaattatactgaaccctgaagaattaaaagtgatgtttataaaaaatacttagctataaaatgcctaaccatttatgattaaaatttttctcattaaacagagcatggggtctatcttacttagaaaatcgtttttgctgttaatggaaaatttcttttgtaaaaagtcattttctagccaactttgttaataaaatacaataaattactcttttatatttaattgtta

SEQ ID NO: 221119 - DNA, 1995 bp, Homo sapiens
ggtacgatctcatctcactgcagccattgcctccagggctcaagtgatcctcccacctcagcctgttgagtagctgggaccacaggcacgtgccaccatgcccagctaatttttgtatttttgttagagatggggtttcaccatgttgcccaggctgttctctaactcctgggttcaagtgatctgcctgcctcggcttcccaaagtgttgggattacaggtgtgagccatcgcacctggctagacctcatgttctaatgacaggaagggtcaatacatgtatagatgtataagttagaaagtacagtagaaggtgataagtgttctctagaaaaataaaggaagaaaggaggtcgtacagtatcagggtggagacaggggttgcagttgtacatagggtgtttttgggaagtcctccctgtgaaggtgacatttgagcaacaacctgaagggaaagaacaagagaaccatacttcactcctgcaggaagagtgtgtaagactgagggaacggcacgtgcaaaggtcctgaggcaggagtgtgctgaagggtttggggcatcccaaggaggccagggtggctggagtggagggaatgagcaaggaaggaggaggcggaaagagggtcagggaggtgacagggcagattgtgcagggcttggtgggccactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtggtggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcactctcctaagtggaccacccaatgttagagttatcgaagcaattatattttaatcactttcttttaatattacatttgaaagtactgtgttaaaatcgcttaaactggcagaagcggacttttaggtcatatgcacagtggggtgcagactctgcattttaagattcagtggagtgtttgaccgttctgctgtacactggaggggaaagagaagggtaagaagatgaagcctttactttgcttctcatagcttgcagagaaggatgggggcaggtgagcagagacagctattcccagattacagccaaatacatattttgaaaatgatgaatggaatttcagggaatggggccctgtaagttccctgaggtcaggtaccgtgtcttattctttactgttttcctaacgtgtgatttagtgcctggcacatagtaggtgcccagcaaaaatatttgttgagtacatatgtgaattaataagtaggtaatgcatggaatgaaacatgtctttttggaaagatcaagaaggactaccctgtcatgtgagaccatcactaagaaaccatttgctgaaaaaaaaataaaaaaataaaaaagaagggctccctgcataaaaaggaagtcatttaattatttaaagcttcatctcaaatgctgttgcacacgtgcgtgcacacattcattcattcaggagtcagttattgagtgcctgctgtgtaccaggtgactaagacagaaaaaatccctgtctccatgaggtaacatgctagtgggagggagacaactaagaaatcgaacgaggacatttcagatactggtaagtttgatgaagatactaaaatgggttagcagtggtgaccttggggatacacagatcagggctggaactcagtaactgcagagaaagcaccggtgtgctgctcacaggcgagtggggcacagacacagacacagacacatggagcatgggaccacgtgtga

SEQ ID NO: 221120 - DNA, 1942 bp, Homo sapiens
ggtacgatctcatctcactgcagccattgcctccagggctcaagtgatcctcccacctcagcctgttgagtagctgggaccacaggcacgtgccaccatgcccagctaatttttgtatttttgttagagatggggtttcaccatgttgcccaggctgttctctaactcctgggttcaagtgatctgcctgcctcggcttcccaaagtgttgggattacaggtgtgagccatcgcacctggctagacctcatgttctaatgacaggaagggtcaatacatgtatagatgtataagttagaaagtacagtagaaggtgataagtgttctctagaaaaataaaggaagaaaggaggtcgtacagtatcagggtggagacaggggttgcagttgtacatagggtgtttttgggaagtcctccctgtgaaggtgacatttgagcaacaacctgaagggaaagaacaagagaaccatacttcactcctgcaggaagagtgtgtaagactgagggaacggcacgtgcaaaggtcctgaggcaggagtgtgctgaagggtttggggcatcccaaggaggccagggtggctggagtggagggaatgagcaaggaaggaggaggcggaaagagggtcagggaggtgacagggcagattgtgcagggcttggtgggccactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtggtggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcactctcctaagtggaccacccaatgttagagttatcgaagcaattatattttaatcactttcttttaatattacatttgaaagtactgtgttgcagactctgcattttaagattcagtggagtgtttgaccgttctgctgtacactggaggggaaagagaagggtaagaagatgaagcctttactttgcttctcatagcttgcagagaaggatgggggcaggtgagcagagacagctattcccagattacagccaaatacatattttgaaaatgatgaatggaatttcagggaatggggccctgtaagttccctgaggtcaggtaccgtgtcttattctttactgttttcctaacgtgtgatttagtgcctggcacatagtaggtgcccagcaaaaatatttgttgagtacatatgtgaattaataagtaggtaatgcatggaatgaaacatgtctttttggaaagatcaagaaggactaccctgtcatgtgagaccatcactaagaaaccatttgctgaaaaaaaaataaaaaaataaaaaagaagggctccctgcataaaaaggaagtcatttaattatttaaagcttcatctcaaatgctgttgcacacgtgcgtgcacacattcattcattcaggagtcagttattgagtgcctgctgtgtaccaggtgactaagacagaaaaaatccctgtctccatgaggtaacatgctagtgggagggagacaactaagaaatcgaacgaggacatttcagatactggtaagtttgatgaagatactaaaatgggttagcagtggtgaccttggggatacacagatcagggctggaactcagtaactgcagagaaagcaccggtgtgctgctcacaggcgagtggggcacagacacagacacagacacatggagcatgggaccacgtgtga

SEQ ID NO: 221121 - DNA, 605 bp, Homo sapiens
ctcataagagtggtggtttcttaaatacatgcattaaagttcatttgtcgctagacaaagcccatttttgtcattaaatccctagatttaggaagaaggtgctttttacaaaataagaaaaggaatcctggaaaggctacagtcaatataaagccatttaatagcatagaccacctggatcctaatcgcatttatgggattatatggcttcatgtaacattttattttactagccacagtgttaaagttaccatgtggatggggaggaaggaggtggcagtgaaaagaaatatcttagaaaatgattcttaaggggaataaagcaactcttaaagagaggaaatatttcatagcctaatcccaattttaaaggtaatgctggctggatgtggtggctcacacctataatcccagcacttttgggaggccagtgatggaggatatcttgagcccaggagtttaagaccccagctctggcaacatagtgagtctccgtctctacaaaaactaaaaaaataaaaataataataataataataactttaaaagttattctaagttatttagcaattatttaatggcctttcttgcttagcctggcatgg

SEQ ID NO: 221122 - DNA, 262 bp, Homo sapiens
actaggtggcatctttgtaaaaataaaagcacatcaaaagaaatgtttattacataaataaatgctgagatgaataaaggtagatgtttcatgagaaatacgaagtcgtttggtggaataaatcctgagaaaatgcatagatttatcatgaaaaggaaaatggaaaatggtattgtaaaattactctttcacttttggaattgagaagctttttcctattggttgttttcattaagtttgaatataaatttattatgtaacc

SEQ ID NO: 221123 - DNA, 1407 bp, Homo sapiens
gaactaaaaaaggttaagaagttagcatattctctcaaaggcctttctacatcttttatagtcaagtctccttttcttaggagttaatttctggtcagaaaatgataggtttgtttcattctttaatgggaggcctgtatacagaagccagaacgtgaaggtttagctgtatggttgactcttcctcatggtttctctttcctcatagagaatcctgtattaggtaatgtagggtaaaatgaaaagtgaaatttcgttctaaaggggcctcgcagcatcaggggcgacagactagagaggtgtgtctcccagcatgagctctgtggataagcaatggtcacgcctcctgagcttcttgtatttagcttttgacagctctgctcccctgtgattatttctgttttttgttttgattgtctctcacatcaagctcaccaagcaataattgttcaaacaggatgacaatccccatgcatgtgatatgcttgctttctagattgagtcactcactgtcatgactgcccatcctcattgcctgtgcttcccacttcaccactctctcacattggctgttcatggaaggctgttttctgtgctctcatgcttctcccctcgcgtttcctgtactgtagggagcttactcttcccttcacactgtatgtgcaatagcaatccccttgtggctccagcagacaccaagaaatgagctgacactcacactgcagtagttccgtgtcttgccatagcggtaagaagcatgtgaccttcctcactgcagcttcacctcagaattagctgttactgcagcacagacctgcttgtgtgtgccattccccaggtggtaggatataagcttgacttgagaccagcgatggtcagtaacaggctttgaagtggcaggattgcgttaggtgtgctgctgtgatctggtgctgctttgaccttgaaagcaggataacgcatgcacttacttacccccgcattacttgggtaccttaaggactagtggttcacaacttactttaggagcttttatttattctgtaacacgtgagatctggtaagacagtggggggtaaggaaaacagacaagaccatgactcttctttccctcttccccaaaacgtgcctcttggaataatcttcagtgtgccctccagcagagccgaaatcaggcaggcatagactccctcctctctcatcaaaccgcagaaatagagttccttcatcataaccgcaaagcttcctcctcccctttgcaccctgcctcagctgcattttcttgtcgcttctacatgggagtgcttgctgttctgggaagagtggggagaagcggtgggaatccttgagccaattgaaactgaggtcatcttcaggaaaaccatgtcttcctgaagttgaaagatt

SEQ ID NO: 221124 - DNA, 285 bp, Homo sapiens
cttcttagcagctaaagagggcagcctctgcgtactgcctgggaacatggcaaaaccattttaggcttaaaaaaaaggtggagaacaagttgtacattatgatcttttaaataaataggccagcgatatatttgtaacagaagcagctctggaagcgtacactgtcagccacagaaactctggggctggggggtggtaaaggaggagaaatgtgtcacccaggcaggagcttagtggcaccatcttggctcccaagttcaagcagttctcctgcctcagcctccg

SEQ ID NO: 221125 - DNA, 771 bp, Homo sapiens
aatagcctgaataaagatgtgcaatttaaacaagttcagattgcctacagttcaggatttttaaaacacgtagattattttgggagctttatctttataaaccttgtaataacaaaaccacgtgagtaccagaatcatttctcttacttagtttcttgcaagggaagcattattgactcttctttttgcagcaaaccaacatttaaaacacattgaatgataaataagaaataatcttgtttggttaatgtacctgaaaagccaattgtgtagaggtaaagaggaaactgttgtaattttgtttaagattggagaagaagagaaaggttaaattgttccttgaaaacataacgcagaaccaaaaacccccacatgtactctctgacatcttcttcacacaagacatattttatattaatgaaattcagataattaaaaatccaagtgtaggcatagaaaaatctttactttttcttagatactggcagagttgttttaactcagtgagaagcatcacatggaacaatagaatttattagctgtttgttaaattgttttagctgctactaaaatatatgctttcacttatcagaacttactttcaagttccattacatccttcacatgcagtatatgaactttacagcagcacacactgtctctcccttctctgcctttttgctgttgttgtcatacattcagtatctcaatattttataaacaccactacacatatttattttatctaccatttgatggccatttgggttc

SEQ ID NO: 221126 - DNA, 482 bp, Homo sapiens
acaatagaggcttgggtcaacctatgacggttttcctgacatcataatgccatgttgaagaagcatgtctgcgaatgaaggcaggcagaagcaaataggactaaaatatagaaaaaagaaaacacgttcataaacttgatagtacccttggatttaactctgctttaatcaaattgcaccacatagatgtttccaataacaaaagctaataaacaatgttttttcgtttttgcccatctagattgagtcatgtttctgtaatatgtaaccaataatttctaaatatttaagctctttttaaattttcttgcatgtgatttcttattttgatatgcaagattatgtcaccattgtggatattaatttattaactcttctaattgtaagaattactttctcggtatcatattttcagttttaagatttctactatttgaaaactgtaaagatttatgttcaataaataatattttctttcattg

SEQ ID NO: 221127 - DNA, 533 bp, Homo sapiens
cagaagagaactatagcttcccctaaaaaacatggtaaccacctaaatccaaatgcctccacataacctccataaaactttaaaaataatgaagagatgaggctacatgggtattgctaaaagaaaaaaaattaactgaaaaaaccctcataatccatgtctatggcataactaagaggcacagaatagtacaaacttcaaatggattgtcaactaaaggaaaaaaatcaggcttttaaaaaagaaaatttagttttattcagtcttactgaagactgtaacccaggagaatctttcagagagattcccaagcagtatttcagcccctgtatcagggggtggcagttctgcatctgctcataagttacattaaacatgctcacaagttacgttagagcaaagtgccatcaaagtttgggtgtgagagtacatcttgttactgattacagaggcatagtcactaatccctcagaatttatcttatatacaggaagagccaagggctaggctaggatcactgacctcatcttaaa

SEQ ID NO: 221128 - DNA, 561 bp, Homo sapiens
ggttagacaaaaatttattaggtgcgacaccatagaatgatcaataaagaaaaataataaattggacttcatcaaaattaatttttctgctatttgaaagacattttaaaaatattgtaaagacaagctatagacgtggagaaaatatttacattgtacaagtgtaataaatattttaatctcaataagaagtaataaaaaaaccaaataaataatggacacaagctttgaacaggtattttatcaatgaagatatggagatggcaaataaacacaagaaacaatgataaatattatttctcattaaagaaatgcaattaaagtcacaatgatatatcaccacacatctattacactgtcttagctttaaaaagttgattatactttaagttctggaatacataataaccctagggattaagtactatttagttaaactttaaatctcagagaaatggggaactacaatttaatcaccaaacttcatacaaatattaaacagagcagggcttgaactccaggtctgtctcactccacaatcctttcccaatctgcaacatt

SEQ ID NO: 221129 - DNA, 555 bp, Homo sapiens
tttttcactttctgactgtgacgaatgatgctgctatgaacattcagagtttttgtgtggacatgttttcaattctcctgggcatacgcctaggactggaactgctgggttacatacatggtaactttatgtttaatactttaaggagatgtcagactgttttccaaagtggctgtaccattcaacaatttttctacattcttgtcaacacctatttttgttatctttcttattgtagctaccacagtaggtgtgacatgggtgctcatcctgagtttcttttttttaatggaaaaatctattttaaaatctattgttactttctagaaaaggaagattgtgtgaagatgtaaggctcgccatgctgggatgtttctatccttctattttttaaaaactgtgttaagtatcttctatataataaacactgtaccaaccaagccttaaaagcagaagtagtaaaatagcttgtcctcaaagaactcacagcttacatgtgagatgtgaaaatgttaggtcgacgcggccgcgaatttagtagtagtaggcggccgc

SEQ ID NO: 221130 - DNA, 478 bp, Homo sapiens
agttaaataggaaatttgaaaaactaccaggtacagtggctgatgcctgtaatcctggtgctttggcaagtcaaagtagaagactcacttgaggccaggagttcaagatcagcgtgggcaagagatgagacccttatctctacaagaaatgtaaaaattagccagccgtagcgtcatgtacttgtagtcctggctactcaggagcataggacaggaagattgcttaaggccaggagttcaaggatgcagtgagcaatgattgcagcactgtactccagcctgggtgacaaggtaagtccatgtcacaaagaaaagaaaatttgaaaaacaatatatatttatatatatactttaggtatttaatattatcaatgttttatatgtttatattatatacactatatactttatatgtatgtagatctctctctctgtgtgtgtataaatataaatttcttcccttctccaatattagcaa

SEQ ID NO: 221131 - DNA, 437 bp, Homo sapiens
ctggaagaagacatccaagaagctaatacaagtggttacttattaggggacagacagtgaggacaacgggagcaggaggatgagctattcactgtctttttggattgctttgatttttggaccgcgtgaaggttcacgtattgaaaataaaaaggccggacgtggtggctcacgcctgcaatcccagcacattgggaggcgaaggtgggcagatcacctaaggtcaggagttcgagaccagcctgaccaatatggagaaaccccgtctctactaaaaatacaaaaattagctgggcatggtggcacatacctgtaatcccagctactcaggaggctgaggcaggagaattgcttgaacccaggaggtggaagttgtggtgagccgagatcacgccactgcactccagcctaggcaacaagagcgaaactccgcctca

SEQ ID NO: 221132 - DNA, 338 bp, Homo sapiens
acagcttctcaaaatcaaatatttgatggtgaatttgattgtaaacacttaaaagtaattagatgaaatatggttgcatacttaaacaagagtaagttcttagaatatgcaatctaattaaacattaacagtcaagcaaaatctttgtatacgattttgagaaattgttcaatatatttttataaatcttttatattgattaaagctagtagttataatttgaacatattatttatttttagtttccaattgctttgtaatagtggaaagcaaaataaatgagtaaataaaaataaaaataaaaatatcgctcatatcagtcctgacaacttaaacta

SEQ ID NO: 221133 - DNA, 101 bp, Homo sapiens
agggtcccatcctcaaagcagtcacttccagagccccatggagcctcatatcccatgatatccacccttattctgtctcaggcccaccagctgcctccctg

SEQ ID NO: 221134 - DNA, 460 bp, Homo sapiens
cacaagagatttagacacctacatacagcagactcaacgatctccaagcaaataatcagactatctaaagtcaaagataaagactgaattctaaaagcatcaaaagaaaagcagctagtcacctataaaggaaaccccatcagattaaaaatcaagaagacaaacaatagaaacaaaccccacggaagatccaattactggagtttaaacattgtcttaaaaaatctataattatgttcaagaaattaaaagagaactaaagactatataaaagaatgaaagaaaattctagaactgaaataacaaaaactgaaattacgaagtcaatggatgtatttaacaattaggcagcagggtggctcacgcctgtaatcccagcactttgggaagctgagaatacaggcgtgagccatcgcgcccagacctcaaaatattgattttaaagctcagtgagatacaa

SEQ ID NO: 221135 - DNA, 435 bp, Homo sapiens
cccaaagcccctgtttctcttcctgtttatagcccctctccaactcctagacataatcaatatcctaattcttatggtatttacttccttacatttttcctaaagttgtttttttaaacaacctatgtattcatttacttccaaacattggtcttgctaggttttgcattctttcatatccagcttcttctgctaaatgaacttgttactcattgtggtttgtattttcattgcttcacagtatccagctatttataccacagtctatcctctcgacggatgacaggcatttgggtcatttcttttcatttatttattttgagacagagtctcactctgtcgccaggctgtagtatagtggcgtgatcttggctcactacaacctccgactccctggttcaactgattctcctgcctcagcctcccgagtagctg

SEQ ID NO: 221136 - DNA, 427 bp, Homo sapiens
tctattctgtgaaatgtctgtgtattatctcttcaaggcccttgcatctctccaagtgtgactttttttaaaaaacggtgtgtatcatataggctatataattttgatactgagaactatacagagaacaatactattaaatgatagacaatctccaagaagagactctgcatttaagcagttgaaaaattgtgcaacccttagaagaggatcttagatggccgggcgcggtggctcacgcctgtaatcccagcactttgggaggccgaagcgggtggatcatgaggtcaggagatcgagaccatcctggctaacaaggtgaaaccccgtctctactaaaaatacaaaaaaaattagccgggcgcagtggcgggcgcctgtagtcccagctactcgggaggctgaggcaggagaatggcgtgaaccc

SEQ ID NO: 221137 - DNA, 435 bp, Homo sapiens
tcttacactattatgttagtcacattgaatgcaagataaagcattttattctaaagatgaggtccagattctaatcaggagatgagtcaagctcagaaaaggaaatctgatttagagttctctcagtcttcctggcttatgtcttagttcattttcagtctgcttttgtgcttgtttgatgtagtctctgtacaaggtatagtcaccatgtagttgcatgttcactacatgaaggggattgtgctagattcttaatagattattacttgatatcctgtagtaatttgtaactgttacaaagatcagaaaatgtagtgccatcaggaggctgaggcaggagaatcgcttgaacccgggaggcggaggttgcagtgagctgagattgcaccactgcacaccagcctggttgacagagggagaccccgtctcaaaaaa

SEQ ID NO: 221138 - DNA, 1046 bp, Homo sapiens
tttcaaactgacaaaagcttcttctggattgaacacaaactgcatgtaaatgtcgttaagtggttcatattttaaaagcgtgagtgtaggccaagaaagaaatctccagctactgtttgcctgcttccatcagaatgatatgtttggcgcacagtgtgttttgtatatcagtcctgttgtttatgggaaataccattcctcacccatccacgttcccctgttactaggtcccagctactgccttacagagaaggtgatgtttcatatttgcttgcttgtttgtttgtattataaggaattattcttagcgatgttaaaaatgattctttcccatgcaaggaacttttagacacccaagtttacactctgcatttgcgataaaaggaagtaggaaagtggagcaggagcaaaatgcagaagacaccaaaagaacctttgcagagagagtgtcctgccagggcatcgacggccgctcccggggcaggagctgagttaagtagagccccagcactactttcctttcctgatgtggctcaagggatcattgcaaaaatggactgtcccctattggaacataaaaaggccaaatcagagtccatttgacctatatcctttaaaactgcacaactgatggcgggtggtggggtgggggttgttagaaagcagttctaagagccaaaccgaatggcatggcatgaatctcaaatttatttcactatgattacaaaagcaatagctacttggatgtaaaagaaaaactgggctgggcgcagtggctcacgcctataatcccaacactttgggaggccaaggtgggtgaatccacctgaggtcaggagttcgagaccagcctggccaacatggtgaaaccccgtctctactaaaaatacaaaaaattagccgggcctggtggcaggtgcctgtagtcccagccactcgggaggctgaggcaggagaattgcttgaacccgggaggcagaggttgcaatgagccaagatcatgccattgcactcctgcctaggcgacagagcaagaatccgtctca

SEQ ID NO: 221139 - DNA, 506 bp, Homo sapiens
aggcgtgagccactgcacccggcctacttactgctctttagatacattgcttgtcatttctgaggtcagtttcttcagccaaaaacatagggtttaataccttaaagatattgtttggattgagaaatgtgacaagttgccagaatgagacaggtacttaataaaggatagtatcctttcttaaggtctttattagtgggaaaaactgggaaacaacctatgtctgatttttgcctgttgctaagcagtgaatcgcaaatgtttagctctcccctgttttagtgaaaggttgggtgatggcagcggtgactcttttttgtctttttttgccagaagtaacctggagtggcctaagatagaaggtgtggagaaacaaaatctagccaaacatatacatgcatacatacataggtaaatatctcagcaggatgatgaattcgcgcagcaggatgatgaattcgcgcagcagcatgatgaattcgcgcagcaggatgatgaaaacgcgc

SEQ ID NO: 221140 - DNA, 796 bp, Homo sapiens
aggcgtgagccactgcacccggcctacttactgctctttagatacattgcttgtcatttctgaggtcagtttcttcagccaaaaacatagggtttaataccttaaagatattgtttggattgagaaatgtgacaagttgccagaatgagacaggtacttaataaaggatagtatcctttcttaaggtctttattagtgggaaaaactgggaaacaacctatgtctgatttttgcctgttgctaagcagtgaatcgcaaatgtttagctctcccctgttttagtgaaaggttgggtgatggcagcggtgactcttttttgtctttttttgccagaagtaacctggagtggcctaagatagaaggtgtggagaaacaaaatctagccaaacatatacatgcatacatacataggtaaatatctcagttggtgaaggtgaatatagaaaatcgggatcacaggaaaaattaccatcaaccctaatgaggttactggcagtcaaaattaaaaaaaaaggaacttatactaccttcatctgatattaattctgaggaaataaaatgtttcttaggaatgaattcctttgtgtatgaaggggaccactgagtggtagtactggcatttttcagccaatgtgacaaatttcacagtgctgtcttagagatgcctaaaaaatgtattaaggaacgtggctgggtatggtgcacttttggagactgaggtgggaggatctgaggccaggagtttgagaccaacctgggcaacatagtgagaccttgtctccacagaaaattaaaa

SEQ ID NO: 221141 - DNA, 530 bp, Homo sapiens
actgacagaacatgaatatgcctgctctagccactgcaccttctataaagtctcacacaactttccctgttcatccccaactccatccagaggacacatattctcacccatcactcatcattcaaacgagtccctgaccagctgagtggcagccttttgcacacagccaccccatcacgcgcacctccaacctttcacccactgtgtgtcaaccttctctgtgtgaccagccactgagtcacgaaccacactatcctctggcagcagaaatgctcatacattagttttcaaagtcccgcgaaagccaccggtattctgtacctataatctcccaagaggcctttccacagctcacacagatcccaagaatggtggggtaagtccttcctgttaccgatgatggctctgaatttccaacacgccataggtctccatgcccctttatgcttcctgggtctcaatcacttcaaaacccctcaaacagtacctatccaaagcaaatcgcttggcaggcccccaaacagaacctg

SEQ ID NO: 221142 - DNA, 379 bp, Homo sapiens
gaagtgtttcttttttttgcttgtgataaaaatcatttaaaagtatattaagtgttgcataatattacatcatatagatatgtcatcagtcattcatgcctgactataattatttattcatgcttcaaagccaagactacactcaaagacagcttattaatgctttcattacaaatcaagaaagaaagtaaccaagcctggaaatgagttagaaagacaccaataaaatgaacttgagaagagtaggaagaaggattcaataaagataaaaccaaatagcaatgaattgagaaatggaaaaatgataaataaatgtatttgatgaataaatggagttgataacactgttatttgaaactgcaataaattttgatcttca

SEQ ID NO: 221143 - DNA, 557 bp, Homo sapiens
ccatgttttatgacaggtaatctctactactgatagttctctagtcttggtttggttcatcaagataaagaagaaattaaacaccgacaacaggtttagcaagtgtggtaaaagttgctgtggatgtaaaaatatccaaatgatcattaaagaacaatgaaaagaatcatgctggcttccaagaaattgcacagaagataattctcttgcaaggtgaaggttagtctcttaaaaaaaaaacccattcatcttggaaaaaatttgaggaaaacggtgtaaagagacaacttcctgaaaattgcaaccatgttgtcagcagtgtcaggatcacgtggctccctgaccttgccctgctttctccagtcaggtgagcctactgtcctgacctgcagttaattcagtaactgttagctcactggccctgccttttaagtaccaaaggaatgagttggcttcctgagaagggcaaatgacctatcaaaggtcttgcctgagtgagaaaaggtatagcccattctcttgtgcaaagattccaataaaactctaatttgcagtca

SEQ ID NO: 221144 - DNA, 470 bp, Homo sapiens
ttatgtagttattcatttgagacaggttctccctctctcacccaggccagagtgcagtgtggtgatctcgactcgcactgcaacctccgcctcccaggctcaagctattctcccacctcagcccctggagtggctgggacttcacaggtgcatgccaccacacccagctaatttatttttatttatttatttttgtagagatggaatttctccatgatgcctaggctgatcttgaatttatgggctgaagccatccgcccacctcggcctcccacagtgctgggattacaggtgtgggccaccacacctggctcaaattttagtatatgtgctgccaaagcgagcatgcctgtctcaaatttttaagtataattttgggccagtcgtagtgattcctgcctgtaatctcagcatggtgggaggattgcatgagcccaggagttggagaccagcctgggcaacctgtctac

SEQ ID NO: 221145 - DNA, 564 bp, Homo sapiens
gcggacccctcaggatactcaagtgaataagatgtgatagactttacacaggtaaagaactgctgctacattttaacttctttaaaacaaaatcagcaaaatataatataaagcttcctattaacgattaaagtgaaaaaatgtctaaatgtaatgaggaaagaaagtgtccggccgaataaaccaacctgataaaactacaaagatattctctatgaaaggaatagttttggaaaaaagttttaactgcctaaaaagttttgtttccgtttttgttttctttttcatagacatacgatcttcccatatttgcctaggctggtctcaaactcctgacctcatgatccgcccacctgagctcccaaagtgctgggattacaggcatgagccaccaccccagcctactgttacttttttacaataattttaccttatatgtatatccgtaagcaacatatggtttaatagtgcccattttcagtcttattctcaatgtaagaattgtatgattcttctgatgcttgattctttcactcttacatgcttgagatttatccatgttga

SEQ ID NO: 221146 - DNA, 428 bp, Homo sapiens
tgagacagagtcttgctccattgcccaggctggagtgcaatggtgcaatctcagctcactgcaacctccacctcccaggagaatccaggaggcagaggttgcagtgagccaagatcatgccactgcactctagcctgggtgacaaaagtgaaactcagtctcaaaaaaaaaaaaaagaaaagattttatattttgtagtctccctagttttgcttccaagaaggcaattaaaattcagttctttctgtattttcattacttctgaatctgagtcaactgtcagatggatgcttttgccttaatttgactttttattacttccaaatcatagccttagagacaagcactttctggatttcagtctggtccaatagacagtttaatggaataaaaaaaatgagagactaaattacttattaaattaagtg

SEQ ID NO: 221147 - DNA, 595 bp, Homo sapiens
tcactggagtggcacttttaaaatttctttcaaaagttattcctatgcgttcataatttggctgtttggcacaataggcctagcttttggcccatttcagcttttgacatgccctcctcactaagcttaatcatttctagcctttgatttaaagtgagagacatgtaactcttcctttcatatgaactttttgcagacattgtagggttactaattggcctaatttcaatgctatgtgtctcagaaaatagggccatctgaggagaggggaaaaacgaagggagtgtttggttagtggagcagccagaatacacacaatgtggatccattaagtttgccatcttacgtgggtgaggttcattgcacctcaaaacaattacagtggtaatgcccaaggtgactgatcacagatcactataattataattaagaactttgaaatattgtgagagttattaaaatgtgacaggacatgaaacaagcatatgctatcagaaaaaaatggtgctaatagatttgctcaactcagagttgccacaacccctgatttgtaaaaaatggagtatttgagaagcaaaataaagcaatgtgcaat

SEQ ID NO: 221148 - DNA, 521 bp, Homo sapiens
ttatacaagtaatacacaatctttgtagaaaaatcagaaagtacagataagaaacacaaaataaaaatctactatggaccaaccaatcataaataaccactgttaacattgaaaggagatgtatattaaaagaatagtatactatgactacatcagattcttgtagaaatgcagagatgtcttaacattagcaaatctattaaaacgattcatctaaagtcataatagagaaaagccagttgatcatcttgacagatgtggaaaaaagccatttaataaaaccccaacatccattactaataatattttcatcaaactagaaatagagggcataacctgaatgtataattcaaatattaagattattttacactaagagtcaaatttatagttttggagaaacactcttctaagtaaaaaaaatttgatatatatatatcaaataatgtacaatatcagcacaattatgtaaatgttttttaacattgttctaaaagtaccagtcaatgtgatgagttgag

SEQ ID NO: 221149 - DNA, 416 bp, Homo sapiens
ccaaaggaagcttgtgaaattctatgttggcctcttccattggcctctatgcatggtgccccggagcccagacacccgcagagagggcctggtaatgccctagaccccaaacctggagtctgagaactggttggcatactcccactcttacccatattttataagacttggatattaacaacttgtattagctacagacctggttcatccagtgacaggacaaatcaaagcccatcttaggggtactggggttggcctcagtgttcccacctacttctgtcgagaaccaaactcctccttcccacctctagcagtgtggggtcaccactactccatgaaggagcttacagtctccttccctttttccaagagcaggacagtttgcttaaagtcatgaaagcaagaacaaaaaaata

SEQ ID NO: 221150 - DNA, 449 bp, Homo sapiens
aggatcacttgagccaagttcaaggctgcagtgagctgtgactgtaccactgcactctagcctgggtaacagagagacaccccatctctaaaaataaaaatacaagaacctcatcttgagggccttgacctgttcccatctctcttcatttcctctctggcctgtctcctaactttccctctcatttcctctgctccagctaaacaagcctcctcatttgtctcccaacatgcacatgcctaacatacttgcaccccagggcctttgcgctggctactccctatgcttggaacgttctcttagatacctgcactccagcctgggtgacagagagagactccatttccaaaaaaaaaaccaataataagatatacgataatgccagtattcctagcagcaggttgattgagtgtctcagccccgaaagcaggactctgggtcaccacaac

SEQ ID NO: 221151 - DNA, 1810 bp, Homo sapiens
cagttatattaacagtggcccctcatttttctgtgagccccactttgctgctgctgagttcgccagcgggtcacctggaagcacgtggcgacacgggccacatgacgtcatcccagcaggcttgcgtcatcgccccgggtgcctggtgacgtcaccagcccgctcgcgtcacgcgcacgttctgctcctcgtggtcctgcccggcccgcgccaccaccggccctgctctgcggggccacccgtgcgccccttcgccgtccgctgactccgccctcccgcctgccgacccggccgccgaccttcccccggctctgtcgctcccaaggctttctgcagccctccgtgctccaggccgcacacctgagggtgggacccccggaggccgagccggtgtcggatcaaactcggagaccgagcagggcccaaaccgggaccggagtggggacgggcggaggaagccaagaggctcgagaccgaggctcgcccacccctcggcgccgccggaccctgcgccactgggggaatttccttcccgacttcccgcgcggccacagccccagctccgtccagcccccgctcccggccccctgggcgggagagtgagccccgagactccgcccagccccgggggtcccgggccccgttcgcccccagcggcccctcccggcgcgttgctcggccccggctgcatcggggagcgcgggatcacccggccctgtccccagcggtgtcggaggggggcgcgggcgggggccccgcatgccattgtcgcccgcggaggccgcgcccggagccgaggcgtgactgacagcgagcgggggaggagcgcggccgtcgattggctggggcgagtgtgggaaagaatgcggagccggggttcacacaccccgcggcggcgaggccttaaatagggaaaaggcctgaggcgcgcgcgggcctggagccgggacccgccctaggggctcggatcgccgcgcgctcgccgctcgcccgccagcccgcccgtggtccgtggcggcgcgctccacccggcacggggaggcgcggggcgcaccatggccgcagacacgccggggaaaccgagcgcctcgccgatggcaggagcgccggccagcgccagccggaccccagacaagccccggagcgcggccgagcaccgcaagtcctccaagccggtcatggagaagcggcgccgagcgcgtattaacgagagcctcgctcagctcaaaaccctcatcctggacgccctcagaaaagagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttatt

SEQ ID NO: 221152 - DNA, 1888 bp, Homo sapiens
cagttatattaacagtggcccctcatttttctgtgagccccactttgctgctgctgagttcgccagcgggtcacctggaagcacgtggcgacacgggccacatgacgtcatcccagcaggcttgcgtcatcgccccgggtgcctggtgacgtcaccagcccgctcgcgtcacgcgcacgttctgctcctcgtggtcctgcccggcccgcgccaccaccggccctgctctgcggggccacccgtgcgccccttcgccgtccgctgactccgccctcccgcctgccgacccggccgccgaccttcccccggctctgtcgctcccaaggctttctgcagccctccgtgctccaggccgcacacctgagggtgggacccccggaggccgagccggtgtcggatcaaactcggagaccgagcagggcccaaaccgggaccggagtggggacgggcggaggaagccaagaggctcgagaccgaggctcgcccacccctcggcgccgccggaccctgcgccactgggggaatttccttcccgacttcccgcgcggccacagccccagctccgtccagcccccgctcccggccccctgggcgggagagtgagccccgagactccgcccagccccgggggtcccgggccccgttcgcccccagcggcccctcccggcgcgttgctcggccccggctgcatcggggagcgcgggatcacccggccctgtccccagcggtgtcggaggggggcgcgggcgggggccccgcatgccattgtcgcccgcggaggccgcgcccggagccgaggcgtgactgacagcgagcgggggaggagcgcggccgtcgattggctggggcgagtgtgggaaagaatgcggagccggggttcacacaccccgcggcggcgaggccttaaatagggaaaaggcctgaggcgcgcgcgggcctggagccgggacccgccctaggggctcggatcgccgcgcgctcgccgctcgcccgccagcccgcccgtggtccgtggcggcgcgctccacccggcacggggaggcgcggggcgcaccatggccgcagacacgccggggaaaccgagcgcctcgccgatggcaggagcgccggccagcgccagccggaccccagacaagccccggagcgcggccgagcaccgcaaggtggggtcccggccgggcgtgagtggggcgaccggggggcgggagggacgcgggactcagccggtgcccgacccgcagtcctccaagccggtcatggagaagcggcgccgagcgcgtattaacgagagcctcgctcagctcaaaaccctcatcctggacgccctcagaaaagagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttatt

SEQ ID NO: 221153 - DNA, 1966 bp, Homo sapiens
cagttatattaacagtggcccctcatttttctgtgagccccactttgctgctgctgagttcgccagcgggtcacctggaagcacgtggcgacacgggccacatgacgtcatcccagcaggcttgcgtcatcgccccgggtgcctggtgacgtcaccagcccgctcgcgtcacgcgcacgttctgctcctcgtggtcctgcccggcccgcgccaccaccggccctgctctgcggggccacccgtgcgccccttcgccgtccgctgactccgccctcccgcctgccgacccggccgccgaccttcccccggctctgtcgctcccaaggctttctgcagccctccgtgctccaggccgcacacctgagggtgggacccccggaggccgagccggtgtcggatcaaactcggagaccgagcagggcccaaaccgggaccggagtggggacgggcggaggaagccaagaggctcgagaccgaggctcgcccacccctcggcgccgccggaccctgcgccactgggggaatttccttcccgacttcccgcgcggccacagccccagctccgtccagcccccgctcccggccccctgggcgggagagtgagccccgagactccgcccagccccgggggtcccgggccccgttcgcccccagcggcccctcccggcgcgttgctcggccccggctgcatcggggagcgcgggatcacccggccctgtccccagcggtgtcggaggggggcgcgggcgggggccccgcatgccattgtcgcccgcggaggccgcgcccggagccgaggcgtgactgacagcgagcgggggaggagcgcggccgtcgattggctggggcgagtgtgggaaagaatgcggagccggggttcacacaccccgcggcggcgaggccttaaatagggaaaaggcctgaggcgcgcgcgggcctggagccgggacccgccctaggggctcggatcgccgcgcgctcgccgctcgcccgccagcccgcccgtggtccgtggcggcgcgctccacccggcacggggaggcgcggggcgcaccatggccgcagacacgccggggaaaccgagcgcctcgccgatggcaggagcgccggccagcgccagccggaccccagacaagccccggagcgcggccgagcaccgcaaggtggggtcccggccgggcgtgagtggggcgaccggggggcgggagggacgcgggactcagccggtgcccgacccgcagtcctccaagccggtcatggagaagcggcgccgagcgcgtattaacgagagcctcgctcagctcaaaaccctcatcctggacgccctcagaaaagaggtaagtcgggggcgaaggcccgagacccggagtctgggtcgcagctgacctggacctcccgcctatccccgcccccagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttatt

SEQ ID NO: 221154 - DNA, 581 bp, Homo sapiens
ctattagcctctgaatattccacatatatttgttttttccttccaggaagaatatacagttctactggaatattaaacaaaaagtagggcaagatctctattctcagaaaaatagagatcttgccctactttttatttaattttccagtatgatgggtgctaactcagtacctccaaggttagttatttatcacattgacctctgtagcctacaaacacctctctgctatacccacactttctccatctccaaaacttgctcattcattgaataaatatagcatcctagggcttgagtgagcatctggcaattcaatggcccctgacttcgaagtatttactgtctaagacaatggttctcaaacattagtgagcaactaccccacccgaagagctgaagtgcagctgagaatttgtatttctaacatgggtccaggtaatgtaggttctggtcgctgggaccatattttgagaaccactagtctagtggattcctgagaattcttgaaagaaactggcaaagtagaggaggaagccaagagccttgttgcaaagcacccataatccttacactaatatct

SEQ ID NO: 221155 - DNA, 261 bp, Homo sapiens
ataagcttattagtctcaggaaaacattcatccaagcaatggaaaagctatataaatttaatatttctacctgtctgtaaaagagtattgtagtaatctcgctgtatgtgcttcttgctgttgatgggcgtgctgccagaaaagaaacatttagggaatatgctagagaaggggttctccaagattggcgagatctgactgtgatggctgcagacgacacacataggagaatctgaaggtaaataaaaactccaaaacatg

SEQ ID NO: 221156 - DNA, 284 bp, Homo sapiens
ggctcggagaagggaggaagaaatagggagtaatgtttaacaggaacagagtttcagtttgggatggaggaaaaggtcatggggatggacagtggtgatagctgtactacaatgtgaatgtatgcaatgccactgaataatacacttaacaatggctaaaacaggccaggtgtgatggctcatgcctgtaatccccactgctttgggaggctgaggcaggaggatagcctgagaccaggagtttaagaccagtctgggcaacacagcaagaccccagtctctac

SEQ ID NO: 221157 - DNA, 591 bp, Homo sapiens
gcatttctttagaaatttccccaatcatattttaatacatctttcaagtacttacttaaataaatttcttaacatagtacatatcacttttgaaatccaaaaaattttaagagctcttcaatacattcaggggctgtttacaattcaaaaataaatattgtttgaactctaaatacttctccaaacatattttccaaaactttctaaagtttcctgctgcctgggaaaattttcctcattgctttaatatgccatatgtatatgtaatcttttccataaggttgcctttttccctagaattctgtgcttgaatgctctttgcttctttagttttgaagactgaaagtcttgcttgtatcatagaactgatcttatatcttcagataattataatcctttcctgttcttgattgtgagaagaggtaatgcttttgctgtgaaacccatcttaggagtgtccatctcctcagtcaatcaaatttaagactcagaatttatctctgaaacctaacacttttctatgaaatcaagtttgaagatacttgtaaactattttgatttgaggatactaatttcttctcagtcttacca

SEQ ID NO: 221158 - DNA, 423 bp, Homo sapiens
ctcctgtttttaaaggcatcaaattttttcaatagtcgattgtagttctcaagtattgttagtcccataatattttagaaaaataagatattcatcaattgctttatttttaattcacatgcatttactcagtaattttgtttttagaaatttggtcttagtagacaattttttagagagaaatagccccatttataagatagagttcaccaaatccagtggcattttttgcaggttcttccacattccctttgtagcatttgtatatgcgagtccccgctcccttaaactctcatggttctttttttttttttgggacggagtcttgctctttcacccagaccagactgcatgagctgagagatcatgccactgcactccagcctgggtgacagatagacactctatcttaaaaaaaaaaaa

SEQ ID NO: 221159 - DNA, 245 bp, Homo sapiens
atctgaagcaaaaataaatacaataaagtaaaaacaaaagattacacgggagagagagcaagaagaaaacgcaaaggaggcacaagaaggagacagagagagagggtatgatgatctttattatggatgcgcagtagtgaaaaacaggaaataaacggttctctaaaaacatatcaatggcaaaatataatactctcataaaaggacaagaacaataattaaaaatgaatatcttaataccatct

SEQ ID NO: 221160 - DNA, 570 bp, Homo sapiens
taggtaatagtttttataacttaatactaattcagatttgtttatcttagcaaataagctgtcatagttcttcagtcataaatcatctcttccaatgcaaatatccttcagggatagaacaaacaggatcaaaacacagtgagaggtttgaacccttagattctagattgggttcatttgaatgtgagagattaaaggaaagcctctgagatagtcttaactgtataaaaaactctgcttcttttcattcaaatattgtaaatgcttaattatcaaaattgtagggccttgacttatgatgttagaaaagaacaataaaataacatctttgtataccacatgtccccttaatttatgtctaggtatgaagaagtaaaactataaaacctgcctaatatatatatttagtataaactctgtagcaacacagctgcatgtagtttttgagcttaattctctgtcaggctcataagatcctaaaacccttggagagttcagcaaaaaataaatgagaataggatgaaaaaaaaagattgcattttttaaccttttaaataccctcatgttcac

SEQ ID NO: 221161 - DNA, 131 bp, Homo sapiens
tagccctgcccctatctgatggtccttccctatccactctggtggaagacaaagggcatataatcttgggagttctagggctccacccaacactggtccctctccatactactacagctgctgctttttgg

SEQ ID NO: 221162 - DNA, 375 bp, Homo sapiens
gcaccatcactgtgaattactaggcaaaatcttctccaagtggacaatgctgtatgttcattcctccttgcaatccccatgactgcattagcaaaggagccccgctgaggctgagtagggctgacacttgcctgcaggtgggcaggtccccatcagcactggccctacttccaggactggcctaggagaggccagggataggaatggggactgtttagatcggggccgacttggaggattttttcctcctgcttattaaatgttaaaggtttgacttggcaggcaatcaggagcccaaaatatcataaaagggaaaaaagttgccgagtggctaagaggtgcaccacgggagtgtcactgggcccgccggcgagg

SEQ ID NO: 221163 - DNA, 399 bp, Homo sapiens
aagacatgaagggtggaaattggtcactcgagtaaaaattataaattatgttaaacaaataataaaaggtaaatcacacttcataaaaattttatgtacatttcctcctgattctcattacaactatggtcctcattacaactgcattagatagcaagaatagttactatttcccttgtctttcagataagaaagtaagagattagagaaattacatgagttacctatttttcaacatttaatgcctagctgggcagaatgtgaatgccagccaagtcttaatttagagctcttcaaaccatgacagcctccttccaaattacatacttttgaattactttaaaaattgcaatatgggccaggcgcagtggctcatgcctgtaatctcggcactttggg

SEQ ID NO: 221164 - DNA, 449 bp, Homo sapiens
cattatgtaacaatagcctttttaatatcaaatggtttttatgatctgtcttcaatttttcttaaaatgagactgcactaaagattttcttgacatttctgagaatttcattttcagtttcaaaaaattatttattcctttaatctttcaatgtggaaaagtaatgaatattgattcatttttagaagcgctaacatccaactaggtaaacttcatgagtgatggctattaatgttctctttcatcttatagacagaaaatcaaagctatttaaagtaaaggatttgtttcaaatcaatgtatgtccacaaattaacattaatgtttacaatactttctgtgataattgtgtcttacttgggtgtatatatgtctttatatctatctgtaaagatatagttgcaagtagatgagagacgaatgttcatgtttctatatggtctgaataa

SEQ ID NO: 221165 - DNA, 367 bp, Homo sapiens
tcagtgctaaaattgggatagtcccaggcacactgggatgtttggacactctgccttgtcctagtttaacaacagctaccttgaagccatctgaaatcagcctggagtagtatgaaaacagctatgttctgatcttgcctttggaggttgtttttgtttgttttgtttgggggtggggtgagggaggagttgctatatcaaatacattttatagtttttgaagatgcgttttttccccctcccaaattcactgcattacagtttttgaaacagaacgggagaaaaaaaataacaaacagtgctggcatccaatagatggtaaattcacttttcatttttaataaagagtggacgaaacagaacggga

SEQ ID NO: 221166 - DNA, 514 bp, Homo sapiens
ccacagctgtggagtcccattctgggactctgacgggcaccctcagatctggtgttgctccactgttcccactgagtctgagttccaacttcttttaaaggagccaagtaaaggtccacacactctgctgtgtcttctccactctgggatataaatgctgttggatcatgtgttatacaaatgtattcctggttcatctcttgacagtttagtgaaactcaaaccaatcattgctgatgtggaagttgtgaaaaagcaggaacatagaagtgagagcccagcagctgttattttctggtacctgttgaacaagagctgagcgctgtttccctctgttttgcggagggatgtgctttcttaaagcagaaggttgacactttcctgagccgcctattccatttcagtactaacagctgtcattagagcccatctccagcttgctcttcatctcctacgtccatcgcaaaaaaatcacattttgcaagggatggtcctatggggtctttctgcttca

SEQ ID NO: 221167 - DNA, 487 bp, Homo sapiens
gaacatgctggagttgaggtcaagtatcttgaagctagattcttctgtgtttatcaatacagatattgaagttgttcacaataatgacaggagaaggtgtgaatgggaagactttgatcaggatgacctgaaactcaaaaaagaaagggttttttgcacaagagtgaaaaacagtggtttggaaaaggcaaagaatatcaataaaaatgcagacattgcctcggaaccacaatgtagaaaaatgtgcaacttctacttgaaaaggtaacagagaggtggtgtcttcctgcaagatggattttaattaaggcaagaaaatggggaagtggactcataaaaatatgagaaagaaggccaggcacagtggctcatgcatttcgggaggctgaggcaggagaatcgcttgaacccaggagatggaggttgcagtccgctgagatcgtgccgctgcactccagactgggagacaaagcgagaatccgtctca

SEQ ID NO: 221168 - DNA, 387 bp, Homo sapiens
ccgatattcaatctacttaatacacaccaaggtcctttcagatagagagaaaaaaatagtgaatattgctcaccagcagatttacttttaaaatatctaaggccggacgccgtggcttatgcctgtaatcccagcataatccttgggaggccaaggcaggctgatcacttgaggtcaggagttcgagaccagcctggccaacatggtgaaaccccatctctactaaaaatacacaaattagctgggcgtggtggcgcatacctgtaatcccagctacttgggaggctgaggcaggagaatcgcttgaacccaggagatggaggttgcagtccgctgagatcgtgccgctgcactccagactgggagacaaagcgagaatccgtctca

SEQ ID NO: 221169 - DNA, 483 bp, Homo sapiens
cacggtacagtccctaatggcttcccttggctaggagagggatttccccatccccttgcatttcccaggtgaggtgacgccccaccctgctttggctcatcctccttgggctgcacccactgtccaactagtcccaatgagatgaacctggtacctcagttggaaatgcggaaatcacccaccttctgcgtcaatcttgctgggagctgcagaccagagctgttcctattcgtccatcttgccagccaaggccaactttttttttttttttttttttagatggagtctcgctctgttgccctggctagagtgcagtggcataatctcagctcactgcacgctccacgaggtcaacttttttagatctcacatatgagtgagaacatgtgatatttgtcagaaacatctattttagaaatcacttatgtatctgtgtttctaaagatttgtagttttcttcttgctggctctaaaggtttattt

SEQ ID NO: 221170 - DNA, 381 bp, Homo sapiens
ggtcctggatggttatctttgaaacttcctaacctgttgggtccccgtcgttaaacttatgccaacagaactaaactcactggatgtgaattgcatcagagatgtaaacatttaaaagcgtattaaggctgggcgcagtggctcactcccgtcatcccagcactttgggaggccgaagcgggcggatcatgaggtcaggagatcgagaccatcctggctaacacagtgaaaccccgtctctattaaaaatacagaaaaattagccggtcgtggtggcaggtgcctgtagtcccagctactcaggaggctgaggcaggagaatgcatgaacccgggaggcagagcttgcagtgagccgagatcacgccactgcactccagcc

SEQ ID NO: 221171 - DNA, 310 bp, Homo sapiens
gccgtccagaaagactccagcgaaaacagaacttttggataatcagtaatttaatctcacctaagcattttgaggccttcaaaagtgattgttataaatcagaaactcaggaaaaatcccataggcatggggcccataacaacggggtgaagtaattttgtttgctggttattgccacagctggttggaaatgtatgtatttgcaatgttctgtccccgttttagaggtaatgctttctgacttccctgctactgacattaaaagaaaatgatgaagcaatcccattcataaatacatggtggggcctga

SEQ ID NO: 221172 - DNA, 544 bp, Homo sapiens
agaaagatggtggtaactgacaaacatacggagtgagctagctgaatcctgtgctaaaaagagggggcacaactgaatactcccaatatctattcctatgtagcaagcccaaaacttagctacttaaaacagttaccattttatttccacataattgtttgagtcagaaatctgagcagtgctcagtggagtggctcttttcttttccacatggtgtcagctatgacagttgagctgaaactaaagtatccaacatgatgtcatcacatgattgaaggcttggtactggctttggctaagaaacccaagttcttcttacagcctctttctcttcacatggtctctcattattcagtgatatttcctgggcttctttaaatgtcatctggcttccaacaaggagagaatgaaagctgcaaggcttctaagtccttagttgggaagttatagaacatcacttaccatattcaattgatcatatgaagtcacagggccaaccagagattcaagggagggtgaacagtctccaccactcaacaatggg

SEQ ID NO: 221173 - DNA, 652 bp, Homo sapiens
aggctgaacttggattggaaagatgggagagacagcaggcctgggtgtattcaggattatttcctaataactcactctctcctccctcctccctttcttgaaagtgagtggttagggatgagcggttgcaggcagagatgacagcatgagatatttcaccaaagagtgggtgtttaaccaccacttgtctaggagatgggcaacatgtcccagagatgattctaacagggaactcttcctggcagagtccagtgaagggaaccaggaaattcgggggcagggcaatcccactctctctgtcaggtgagatcacctgcgcagtggtttgagttcaggcatcttactttcttttagttagattcataggattaaaaattatctgcttatctagtccaatatttttaaggcatgtcaaaaaatctgcagaatccccccccccttttttttcataagaaataaacatacataaatctgagaaaaagcagagctggaaaaaaagtgggggcatctcggaggatgaactacctggagccccattctggcagctcttgagaattctggaattcctctggaaactactgatttagtttctcatttccatttgagaaaacaaaatataataatagcgatcaaggttaaaaaaaaaaaaagt

SEQ ID NO: 221174 - DNA, 175 bp, Homo sapiens
acggttgcatattccatcccattaggataccaggagatgcaacatttttcttcgtcctaaacagggtcacttaattcaaggttgtattagcaccttcagccaaactaagaaccatcggggatgcctctgggtttttgcccaggacactgaaaaataattaggtgtctgaactggg

SEQ ID NO: 221175 - DNA, 319 bp, Homo sapiens
tcacagtgccataccggatccagactcttgtttttagaaaagatggttctcttcttggtttattctccctgatttgatgtgagaacatgtcacgcagtgtaactcttctctgcctttgtttaatttgttccctctgtctgggactcccttgtcaactccactcctaaaattgcatgcacccttcacagcccaaggaagtctgtctcattctgtggacgttcccacctccctttcctgagatcccaggcactttattcacactggtaggagacatttatggatccagtcattcattatttattgaaatgttaatccagta

SEQ ID NO: 221176 - DNA, 2912 bp, Homo sapiens
  misc_feature (64)..(64): n is a, c, g, or t
aaatccttgatacatgctttccaaaggctgaggaaacagaaagtgagagaggggtgaaagctgnatataatggggattatctggagattagttaaagtttcactaatgccattaatttaaatatttgactccggccctttcgtgtatgagatttgttccgccattacttcaggtagatttcattacctcgactggactgcctaaatacaactttgtgtcagtcaatatggttatacttatacttaatttacacatgctaatggcaatattagatctattgaacagatatcatcagtaaacagttaatgattgatattcaggtccaactttgattattgatcatatattttgtgtaatttctgtggttattataaatatatgattgataaccagttattcaggcaatttgcatttataattttttatgtagattttactaatcagctagaaatatctcttcatgaaggtaattattagtaaaaaaatttgtgcagagaattgcgcagagtatcttaactttattctaacttatcctactactaggaatgttcttaataatctttattaaaaacttagtttcttagattgtctgtacctgtgttaaaatgtggtctacagccatttaaataaaaggtctctattttatgacttatgtgaatttcggatttgtaacgtatatatgtatgtatatttatgtttgtgcatttgtgcataagttaaatctttgactaaaagatggacctcaacaagtgtgggaaagtgttatagttacaatatcctgctttttgcttttctgtataagagacttggtagctgcatcatatatcatggtcatccaaacctcttgttttaaatgagagacatagttaatcataattaaaaatgctaaataaatttgaaataggaactatttgacccattaaataaaaagatcccaggaattcttagatgtaaagttatctaattcttgagatttaacttaaaaatataagtatttatttatgggtagttttaaatttgtctttcaagcattatggagattagaaattttgtgtgctttttttaaatttgaaggtccttaataaaacagtatgtaattgtgagaagcaagagtgctgcagcatgttgtgtcttttaaatatctttgagagtaacagaaaagcccaaattctctcctagtgtcgtttttaaaatcaagtattgaaactgaatatagttcagctaagctttctttgctgtcactcttaacattgccataactctactttcctagtcatttgattgtacagaaaaaagtaaattcttttactatgtaagtatacccttatcatcaatcatgtactgcataatgcatagaaaagaatacatgtaacattttttgaagcataacagtaacacaatactgatgatttctcacccagcttaaaaactagatggtatcattgaatctctatatgttgtctgtccctattcagtcactctatttcccttcacccagatgtgatcattattctaagatgttttcattcatttccttacttcttataaaaataatggtttctgaatgtattactaaacggcatatattgtttaattttgagcactatacattacataatgtaattacctattaatgtaattattataatgtaattatactttttctcttaaatcttgttttaagatttatttgagtcttggcatgtagctatagttaaatttcatgctgtatacgattttattacgtggatatacttgtattcattgtagtagggtatattgggtgttccatgtttattttgttttttgtcactatgaacaatcgtactgtgaagattactgaacatgtgttctagtaatatgtgagtaaattctttcattgtatatctaagagtggaataggtgagtctcacagagaacgtgcatattcaaccatgcaagataatgccaaattggtgatacactgatacacatttccaccagcaaagtgcaatagttctctttgcgctgcaggtttatcaactctgacaatcttcagacttcttgatttttcctaatctatgggtataaaaatagtatttcatcatggttttaatttgcatttcctaataatgaggttgaacaatttttttatgtttatcttccattctcatttctgtgaaatgccttttttttgttatttgtccccctgcccccaattttgttttattaggggttcttatgtattgtggatacagatgccttttgtacatatatgttgcaaaaatcttctctctgttaatgacttggttcttttatggtatattagtgaaaagaactgaatttaaatggtagttaaatttatcagtctcttatatgattagcactttttgtgtcatggttaagaaattactttctgtcccaaggtctcgaggatatctttatttttttttcaaaggcttgcccttagtgttccaaatttatttggaattgattctttgaaaagggtaaggtagtagtccaatttcatttttctccatatggataactatttgttttagtaactttattgaatagtccagtggctagagtgccatctgtcatttcatgattctttttttgcctagttctgtgttgggctcttccattctattcatcaagttgtctatctctgcacaaatagtacatgatatagttttaattactataattctaatgagtcttgatatctagtaggacaagtatctgtattttcattaggagctgcctgacgcattcatataaaatgagaatcagcttatcaaattccttggaaaagtattcttgtggttttaattagaattttattgaatttgagaaattagaagtagaattcttaaaaatgttgaattttctttttcataaacatactgtatcaccctcatttatttagg

SEQ ID NO: 221177 - DNA, 496 bp, Homo sapiens
agtggtttctggatattcagagagagctatacggaccttgagctgatcttgtactctagtgatgctggtgcacaaacacaagggtagggacgctatcaggggtgtcctgcataaaggtcagaacagacaacctaaaatgcttccttcacctctgagatctaggattcaaggatctgacacagtttccccctctgggaaattcacagttccacagggattatgaattaagagggtgtgtttgtacttgtgcatttatgcttgagatgtcaaagtgggcaacagataaatctgctaagatattgtaccaaaagacagtaattttcccgttgggaaaaacaatagtagtcacattatttaccagaaacaccaaggagtccatgcactgaacattttataaacattttatgaaaagtaaaatgtgttcaatcctaaatgtcttcttgtgtgttctatggttcagggtgggatgtgggaaggggaaggccatgcaccaccc

SEQ ID NO: 221178 - DNA, 332 bp, Homo sapiens
agaagaaccggggcctgtacaggcacatcctgctgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctca

SEQ ID NO: 221179 - DNA, 1144 bp, Homo sapiens
agaagaaccggggcctgtacaggcacatcctgctgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccagccctgccttgccggcccctgcacatttaggatatgctcctgggtggggactgggctgtgcccagggcctctgtcccccaggatgtcttgtggtggcggtcggtcgttctgccccccagggcaccccctgttgtaggcactggctagggaggggcaggcctccttcctgcccctcgagacactcttgggagatgcattttccgtctggctcacagggggagggtgaggcttgcaccccaggccctgcccaggccactgtgagggtgggtgctggctgagcccccggggcagcaggagccaggcaggtgatgtctttgtctcggtcccacagcagagccaaggtgaggg

SEQ ID NO: 221180 - DNA, 359 bp, Homo sapiens
agaagaaccggggcctgtacaggcacatcctgctgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaaccccagtcacgtgtcacacggaggatcaagtcctgct

SEQ ID NO: 221181 - DNA, 277 bp, Homo sapiens
cccccgtgtgtggttggtttcccacggccttctgaggctgggccgtggtcagctgcccagaggccaggctgatcggcttctgtcgagtccaggacttagggctgctgatggggcagagcctgaccccgtggggatctgcctgcttggcctgctcctgccgcggccggacgctgctgtgggctgctcctggtgtcactctcgccctgcttggcctccctctcgttcacagcctcctgctctttgtggatgaagcggacgccttccttcggaagcgagc

SEQ ID NO: 221182 - DNA, 374 bp, Homo sapiens
acatattgaacaaaccatttctatttcaatttacaaactgggcccaaatagtcattatttagaagcattgatagcccccaaagcagtttctgtgatttattcactgaaccaagaatattagatcaccactgagccaagccgtttatatatacgtggctatctcagactcccagtgagataacatctgggctcagtcttgcatctggaaccaaaaacaatgatctactctgtgctttaaatttgacaacttaatttgatatcctctagactagggtgttcagagcaaacctagagagattgttaacagccatctgagagatgcagctccattcatggaaactattggccaactttaccttaagaaagaaaaaggg

SEQ ID NO: 221183 - DNA, 539 bp, Homo sapiens
atgaaatgatatcctaagtgtgctgtttaggaagggagtagaatgcaacctagagttctatacccagagaaaatttcgacagggaaagcataacacctgtatatcagtgttacaatcaaaccatctactgctttggaagaaagggccaagaccaagtcaggctgccatggtaagcagtcttcatcgaatgaccagatgatctctacagtcttcatgtggacgatgatctatgtctaatttatcagtaaatatcagcatctagtagggtgctttcgataaattttgttgaatgaaagaaaaaaggcaaattaaggtatttattcagtaaacaaaaagggatagtgaagaaccaagctccaggacttttgaagatagactttcttgtctgtggtgcactgagaatcagctctatcttagtattcatttacgtgtggagatctagaacagagttacattctttctggtgacaagctgagactacctggctgctcaatatccagctcctgggagacaagggcctcaaaactgttgggattggg

SEQ ID NO: 221184 - DNA, 424 bp, Homo sapiens
aacctaccatattaacagacattaacattttgctttacttgccttagaatcaattttctctgttttaaaaagcagaaagcattaagcacagataaagcacccccatctcatcctctacctttctctccagaggtaaccatcaccctgaagttagtatgcttcttttcatgtatgtacatttaaacttatgttaatattatatagacatgtccataaattatatatactgttattttgtgtgctttaaatatttatacaaatactagaaaccatatggtacatttccttttgtaacttgcttttcttgccaacatgttttgacatttatctgtgttaatatatttagatcaagtttgttcattttaactttctgtagtattttattacatgaataaatgagtttatttactcatttgcttaccga

SEQ ID NO: 221185 - DNA, 299 bp, Homo sapiens
ttccttgcattggaatacttagaggccattgtagggttatgaattggcctaattttagtattgttttgtctcggagtagagaggcctgagcagagggagagatgagagaaaggctggttggtggagcagtcataactcccacaacatttattgagtaagtttgtggtcttatgtgggtgtggtttgtgcctctccccaaaatgacaatggtagcatcagagatcacaggtcactattaacagacataataataatgcaaaaatccaaggtcaaggtgctggcaaaaagaaattaaaaaa

SEQ ID NO: 221186 - DNA, 422 bp, Homo sapiens
cttgggctctctctggtgcactgggcaagtcggcttgggggtcgggttgaggggggcggtgtctccctcagcgtggactcctgctctcaagaccgctatcccagacctgtccacaaggtggcagtgttcgcagggagtaagccccttaaggtttagcctagaaaggtcgcaatttgttccgcctcattcttttggccaaagcaagtcacaaagccagccagcttcgaaggtggaaggagctgacagaatttatggtcttatggctgagcacggtggctcatgcctgtaatctcagcattacagaatagtggttccgtgtatggatatagcacaatttgtttaaccatccacttgttgaaggacatctgggttgtttacgatttggggctattatgaataaagctgctatgaacatttgttta

SEQ ID NO: 221187 - DNA, 145 bp, Homo sapiens
aggcacaggaaagaggcagaaaagcccaggaaaagaaaggggctggacaaaggaattggggggaatgagagaactgttctgtatcttgagtgttgttacagttatatatctctgtgtgtttattaaaactcagaattgtacacca

SEQ ID NO: 221188 - DNA, 660 bp, Homo sapiens
cacttcagcaaaaccatcttattggcaagtgattagagcatttttagatttgaaagctggttcctggtaacctggtattattagctggttttatatatggatggctggaatgccaagatgtagggggatgagaatatattcagattggccgtttcaggattatgcacctgggtcatggtacttggtaaaaggccaaaacccatcattggcagtaatcaggtgtaagaaaatatccaggagttctagtagtacagccttgctcccatataaagaagggtaattataaaaacactttttaaaaaatttttggtaattgtgttcatataatttatactaaaagttacgtgaggaactattctagctactcggacagctttaaccaaatattgaatgttctaccctgttttgggttgtcttgtcaacccaagtgcacactttcaggggaattaaacatggtggagaaatggaagaaaggaaagaatacttgccgtcacatcagctgaatcagcttttgtgattcagtcttatcacttttgtaaccatgaagcactatcaatgttgcctcatagggtttagttctctatattagcactattttatagaactttctataagggctggacgtggtggctcacgcttgtaatcccagcactttgggag

SEQ ID NO: 221189 - DNA, 547 bp, Homo sapiens
tgccttgatgtactgcatatacaaaaccagtttagtatataatgtggctctgataccatcttgaattataaattatagcatgctaccaccagtaagtttggtatcataattttaattttaactgtggctgacaattttggggggaataaacacgcataactagggcaatcagatttgaaaaaatcaatgaatatacataaagcttgattgagcatccacaaatacatagaaaataaattatgcaaacaatcctaagaatgcatttccagtaactgattatacaatccttatctatgtagagttgggaaaaaaaattctttttgtgatagtagttttttccatatggaaatccagtggtcctgcccagaagcagtggctcatgcctgtaatcccgacacttggggaggccgaggctggcagatcacttgagggcaggagttcaagaccagcctggccaacatggtgaaaccctgtctctaccaaaaacacaagaattagctgggcatggtggtgggtgcctgtaatcccaactactagagagggtgag

SEQ ID NO: 221190 - DNA, 191 bp, Homo sapiens
aacatataaaactttcatgctgtacatgctaaaacatattccagacaaaagatgccttaaaatgttttagcatgtacagcatgaaagttttatatgtttattaatttttgtttataattgttaatgaatattaattttgttaatgaatatatattaaaccaattaataaacagtcacaaagctgcaaaccg

SEQ ID NO: 221191 - DNA, 1201 bp, Homo sapiens
aattgtacatcgtaacaaatggagattattcccataaagtcctcatgacttctgaactgatcttttgcagaaccatattggccccccaactttgccttatccttagacatttcagtaaatttccctaatcacctccacaatcattcaaaatgtatttgtggcctcatgtaatggccaaaaaagaccactcctcataggaagatgttagattacccactacatttcttacctttattacaaaggagagagtttctaccctggcctggaagcctctatgcccctgctgccaatattttgtcctcaatgcaccagatgacatacttcagagctctgctgtggtacacttgataaagcacattgcagaaccacacacttctttgataatgcttatatttgttgcatgtaatacaaagtgggaacttctacaacaaaataattaattagaagaacataagtactttacagaatccaagaaaccaaagcagcaagcatgcttcgcaaggacagaaacaagggtagctcaagagaactcaatagtaggtattctaaataatgttctctatacagaaatggcagtaatgaaacttagaggaaaaacactgagttttggggtctagttccaaactccaaattatcaggaaaaatacctgattggctcatctagggtgaggtgacaagtatcaaaccaagtagcaatggccatgggactcagtcacacagaaaatagaagaatgtgtgtacagttggaaggtctcagagaaaaggagtctgttggacagaatgaccagtctgtgactactgccatttttcatgaccatatatcaacccacattacagatgtaacttagtgagagaaaacatctccctgttttccttcatatattatgaaatatttactttttctagtattttgtctatcttacgtcaaagatttaaatatctttgacctcctgtactaaataccacgccacatcagttttagttgcctttcttttttccttaggctagttttttggtataccatttctaaaccaatggtaggaacattttaaggcatcttttgtctggaatatgttttagcatgtacagcatgaaagttttatatgtttattaatttttgtttataattgttaatgaatattaattttgttaatgaatatatattaaaccaattaataaacagtcacaaagctgcaaaccg

SEQ ID NO: 221192 - DNA, 335 bp, Homo sapiens
taaaaaagttttaaaacattttaagcatgttatgcttttacttattacattaacgttaactttggaatattttgcaggatgtcagagggtgactggtcagagtaggcatgcatgtgtcatttgaccaagcaagaaataaagccagttttcctatgtggacagtattgaatcattttagtgtgcatgtttctaaggtagtaagttatcgtttagaaaagaattagatcaaattagcctagactgaactatcttatttaaatatctcttgtggatactcagggctcttgagcaaggactttaccaaaattacacctggcctcttgcagtcagttctg

SEQ ID NO: 221193 - DNA, 492 bp, Homo sapiens
gggggagggagatccagtttataacggggctgggaaagtaaggtcagaggaactctttgttaaaggtccttttgctgctgccgccgctactgctgactttgtgaagtgtttagtgaagtcaggcaggttgctgaaggcttcttatttgctttccagtttgagtttcctgaatgagtgtgtgtgtgtgcatatgtgcacgcacgtgcttgtgtgtggtaccagtgagcatgtgtagtcaggcaggcataagcccctagcattaaaaattgtttttccttctcctcacccttctctccaagtattccttgcctcattcctgtcctgcttcttcttggaagtgcaaagctgacatctgttctttatcattcttcctctctttttctctttttgtccccacccccacctccaggttaaatttttattacaactattccaaacagagatgagccttgttcccaggctttgagttagttggtagttctgggcccagga

SEQ ID NO: 221194 - DNA, 630 bp, Homo sapiens
gtgtattttccaagtccattaatttccccctaacaatcgtttactatcctcaaattgccacatattcccatctctttcctctatggagaagggtatataaacatctgtatcccattgagctactgggctgtcagattctcctccgattttcctgtgccacgcattttacaataaatgtcgtatgccttttctccttttaacctgccttttgtcagtgaaccttcagaggaggaagtgggaagcttggcccctacagcagcatgactggtaatggtaaaagactggaaacaaccaacatgtgcatcacagttagataaatgatggttgttcctagtgtgcgataccatgcaaatgtaaaatgaatgagcatgttctctagatattgaaacagaaagctctctaacatatgctaaggaagacaagcaagggaagagcagtgtctgtaaaacgctcctgtatgtgtcaaaaagagggggaagataatatgaattggcttgtagatgtagaaaaatatctgcattaaaaaagaaattatcaaccactggttatttcctgttggggccctggggaactgagtagttttgatgtttgagtcatataaatgtagtatctattaaaaatatgaaacaa

SEQ ID NO: 221195 - DNA, 279 bp, Homo sapiens
gtgtattttccaagtccattaatttccccctaacaatcgtttactatcctcaaattgccacatattcccatctctttcctctatggagaagggtatataaacatctgtatcccattgagctactgggctgtcagattctcctccgattttcctgtgccacgcattttacaataaatgtcgtatgccttttctccttttaacctgccttttgtcagtgaaccttcagaggaggaagtgggaagcttggcaataaagaaggaaaataacggggatcctcat

SEQ ID NO: 221196 - DNA, 413 bp, Homo sapiens
gctgacagtagaattggatgaggatgtcagacctggttaagcagtagtgtggaggggctgcttcaactttgcccctggcagatggcaaggatgggacccagaggaaagggaggtgtgtgcagttaaggcgagggtcccccccagtacaaacgaatgaaaactccagctgcgggataatgaatgagaaggcctccaaattactttttcactgatgaaacacaaatggaagtggcatataattaaaggggaaagaaatatggaagcccactgtatattgataggatattttgagtaactctattcatactcaaaatgtgtcctaaactgtagagaactttcttaagcatcttttaaattttttatggaaaatgtcatattttaccaataaatgttgttgtgttagaaaatatcca

SEQ ID NO: 221197 - DNA, 1267 bp, Homo sapiens
  misc_feature (1)..(1): n is a, c, g, or t
  misc_feature (4)..(5): n is a, c, g, or t
natnngcacgagggggaaccaaaaatatcgggctttgaaattctgtggattttcaaaggcggttcccaaccttgtcaaaaactacagtgggtgcgcgatctaatctggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactccggcctgcgagttgattcagactcctcggaagccagaaattgggtctagagtgggttggtccctccgtcagcagttcgggcccagccgaagcttggggcctagagggcagacgtccggctctgatcagagtacagcgggctgggcctggcagcctgcaggcaacctggaccttgcaataaagctgcattcaacataactcagaccacagtgggagcccccgaagggcttcatgtgagtcccgaaaccagagtttagaggcgcggcctggttctcgtttatcttttccagacagcatttaggccaataaggtctttgaaaggaggcagccccaaagccctcaggccgacacctgagggcagggtctcaaacagctgtgcttgaagaaccggcaatcttgcttttcccacacgcagctgcacctctcctgagcgctgcagctgatggctgtatagtgaccacggactgcgtcctcctcacgaagctgcgcaacttctgctaatgctgcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccgtgcattaaaacatgttctctttcatttgcagatttaataaacaaacgtaaccatatcacatgga

SEQ ID NO: 221198 - DNA, 107 bp, Homo sapiens
gcacgagaagaaaagaccaaaaattaaaacccattctctttatattcagaaaaggaaagggctattttttggccaaagcgttacaatttagtttgccaaccagttta

SEQ ID NO: 221199 - DNA, 361 bp, Homo sapiens
catttaatctgtatgattcattggcatttaacatatttgaaatgttgtgccactatcaccactatccagatccaaattattattttttcactacaaaaggaagctttatacccattagagagtcatctcgcattctcccctccttcatgccttgcaacctggaattatgagttggcatgattgtataacctattgggtaatattacttaaaaaattgcaaatatgtatataacttcgacaaagtgttttattttttcttctaacatctcctatttctaaatagcaattctatgatgtataaaattaaacttttatgttttaattgctctattaaatatattcagaggtgctgtgatttaca

SEQ ID NO: 221200 - DNA, 395 bp, Homo sapiens
gatttgtctatcactttcatttactttacaaatgctcctcagaatatgaaacatccagtgaaaatactgataaaacatttattttggtgttctcatctgtgtgagggattaggggaatactttctattctcattgctccaggaatatagaccaatgctattgcttcttgtttcattatcattgtaagttttagatgaaggtgcagcaggatttaggggaagggctgcagaaggggataaagctaatacacaagtaaagaaaggtaactaagtagagaaaggtaaattcttcccttttaaaagcatgtaaatgttcacttttcagttcaaaacaagagaaaaatggcatgttttccatagttgttaatatttagtaccgaaataacagaacactta

SEQ ID NO: 221201 - DNA, 421 bp, Homo sapiens
agggaagaatcaggggagaagggacacaagcccctgaatgcatgccaacacgtaaaacctcaaatcaaaactcaaaccatgcagtttaacctctcaagttgcccacttggccctcttccaagtgtactttacttcctttcattcctgctctaatactgtttagtacattttcactcctgctctaaaacttgcctcagtctctcactgtgccttatgcccctcagctgaattctttcttctgagcaggcaggaattgaggttgctgcagacgtgtatgcatttgccaccagtaacatactttggtgccacatgactaggatatgttctctagtgctaacatgttcgtttacagttcttaggactccctgatagaaaaaaacacaaaaaaaaacacaaaaaaacccaaccaaccaaacaaaca

SEQ ID NO: 221202 - DNA, 790 bp, Homo sapiens
ttgcataatgaagccaaaacccaataggaaaatcaggacaccacaaggagctcaaagttttgttttgcttttgttcctttaatcaagggagtggcagctagtttgatggaagcatttttgtgttagaacattgtggcaagggagagaaaccttaatttctgtaattctttaccaagaactccttgctttgtctttaaaagtgggttaagctaattgtcttgccagggattattggagagagtcaatggtgggtgtgttaagagcctggaagcaaaatgtgagtactgtccccggaaggagagaggtgggataaccactgggctgcttcagggtcttgctgcaatctctttaacatccacaggtcattccgaaaatcagagtcagcatgcagcatggaaaccacttcacaacacttgttttatttcccctttttttggtccattgctgaaaaatgcatgaaaatcttgtaaactataatgtaagagggccccaaatcatggtgattttgtacctcttaattcaagaggtaagagtgagcccaacaagggcagctcgagagtggaaggcgggaggccccatttattttcttgtaatggctccagcctaagttgccttttatccacttaggcccacacgataagttcactctggaaatctcttcagcgtggctgcgtgcagatgtaatcggacctgctctgggtcgtcctaattgcaaacacatttctctccctctgcggccattcctaagcaggcagtggtcagagccttgccagggttttctggcatcttc

SEQ ID NO: 221203 - DNA, 792 bp, Homo sapiens
tctgggtgacatagggagacccgcctctacaaaaaatacaaaaactagttggatgtggtggcatgcacttgtagtcccagctactcgggatcctgaggcaggagaatcacttgaacccagcaggcaaggttgcagtgagctgagatcgctccactacactccagcctgggcaacaagagcgaaactccgtctccaaaaaaagcttatttccagccctctgatccagtctcagatttttatcaaagcagatccctaagggccaatgcagggagactcaacgcttgctcttagagctttgttctttgcatacctctcgggcagtggagacacggcggcccttgcctggatcattctgatcaagatggctacagatacataagcattgatcagaagtccagcctaaggccttcatgatacagcgtgcacagctgtcagtgacagagcccactgtggtggccaaaacttggcatttttaggcacggtgtcttcatatagtgagaagcagaacattttctatattcatgaaaatagcggatttttttctgacaggcctcacaagcttggacacagaaggggatatatgttgtctccccgtaaaccctgcttcaggagccaggcagctcacactgaccctgtaaaccacacagctctgtctgacgcagcaccctttttggaaaggtgttctctatgttcagcagtcccttcccatgaccgtcagagtctgtgcatctgtttccattggtaatcaaaggttgctggatttaacactgactgtatttgtcattgccccca

SEQ ID NO: 221204 - DNA, 102 bp, Homo sapiens
gaaggtaaacttctttatttcagcatccaaaatatttttaataagagggtaggctccacggtttgtttttgtatcctcggctggcccttctgtcgtcttctc

SEQ ID NO: 221205 - DNA, 319 bp, Homo sapiens
tacttgggaggctgagacaggagaatcacttgaacccaggaggtagaagttgcagtgagctgagatcatgccacttcagcctgggcaacagagtgaaattctgtctcaaaaaaaaaaaaaagaaaacaaaaaaaaaaagaaagaaaaagtttgggaatcaaaatatcaaaatatatacaagttgtagagaaagggaaaataaatctgagttattcattgatctttgctagtgtaaagcttaatctcctgcccacagcttactcatatgtaccctatgcactgacttggccttactcaactgagacttcttttaggattc

SEQ ID NO: 221206 - DNA, 437 bp, Homo sapiens
taatctgcatgagcacaggtaccaaagcatccaaataacatgatactatgtgttgttggaactgatcatttatcgtaagtagaagttttaactgaaacaaattatcagtggctaattgtctatttggcagagctcatggccaacattattttggctgctcttgattaggaagtggaccacaggacaccaagggattcttaattgattgttattaacagtcagtggaatgtgtttaataatgaataaaactggactagacggacattctgatttaaaaaatgctgaaaagaattagagttcaaaacatctcaaatatggttcagctatagatctatataactttctttcaatcctacatttcaaatgccttgggagaaaggaaactgatttttgaagtgaaagctgaaaatatttgtttgggaaagcagtagttacat

SEQ ID NO: 221207 - DNA, 423 bp, Homo sapiens
ttagacttctttgtctgggatcactagggggccatatgtgagaaatatgaaagaagcaggttggaaatgcctaatgaaggaaagagaaaatgggaaagaaaatagaagaaaaagccattatgtcatgcccactaaacaggatgccagaacacaaatccagggatcaatggacaagagagggaaggaaagaaactaaaactgaagacctttattcttgccttacaaggggccacaagaggtatctgttaaatatgaattctgttgggctgggcaaggtggctcacacctgtaatcccagcattttgggaggctgaggtgggcgaatcacaaggtcaagagtttgagaccagcctggccaacgtggtgaaaccccgtctctactgcacaatgtgcacatgtaccctaaaacttagagtataatta

SEQ ID NO: 221208 - DNA, 242 bp, Homo sapiens
acatgatacaatcgagccggtacccgcactgtgcaacctgggttctttggacaggaatcagaatatttgctgttattgtatgaagcccttggcatgacacctggcacatggtaggtagctaataattggggcttctattgctgttgcctggcacatagtgtgtgacatatagatttttttttttttttttttttttttttttttttttttttttggggtggggggagaaaaaaccccggggg

SEQ ID NO: 221209 - DNA, 462 bp, Homo sapiens
atgcacagaaggctgcagttctcatgctctttgaggacccgtggctgtgggaggcatttgtgtaatgatgctcttgggggatgagggcaccattggaagcatctcccggttgacacagcacacagggacaggtgttcttcctgcaggggcgggggcgggggtgcctgcttaagctccccaacttcccagaatccaaacagctgataagagtcctgccctggggttgacacggatgctgaaagatgttggctcttgggtgggagacagccgacagccacactccctgcctcctaggtagcctgtctgcaggagagaaggaggccaaagagaaacagacccaaaaatgggggtgggagagtgacctgatgacactgtttgagcacctggatgtagccatgcctgacctccaccccattcttcctggtgtcctgagctagtaaatccccttttttagctgaagaa

SEQ ID NO: 221210 - DNA, 706 bp, Homo sapiens
gaaaaaaactttttacttctttcttttcaatttttatgcctgtgatttctcttttttttttctttttgccttatggtattgtctaggccttcaaacaccattttgaatagaagtggtaagagtgcaatgagataaacataaatgcataacaatggttttttcttcctctgctttctgagtttgtataaattgatgaattgtttcttttaccaatatgaaatgtcttttatctccagtaataatactgtctcaaagtctgcttcatctaacatttatagcttctccagctttcttatagtgtttacatgctatattttttcttttaacataaatttcctttataacatacttttaccttttacttttaatgtaaatctctgtctcttaaatagcatgtagtttggtgctgccttttctttttttaacttagtttctgctttttaagtagggtgtttagtccattaatatttacagttatttatatggttaggtttatatttttatcttgctggtattttttttctccccttttttggcattcttttggattgtgtttttagcccataaatctttggttctttcactatatacctttgcattagttttttagtggttcctctagggattacaatatacattgttaacttttcacagtgttccaagaattaatattacagaaataaatgtttatatttgacaactatga

SEQ ID NO: 221211 - DNA, 713 bp, Homo sapiens
aattggtagtggctttgaggaagataatgtccaatctctggcagaggctagggaaaggggtaacttgaaaaggtgaaaaggtgtgactttcattattctgtcagtaaaactgagtttccagcacagtctgtaggtccaaaataaaccccctcttcatccaatcttctgttgtgtctgccctaagaagggtcttgtggaagagagaagatgagcacacgaccgaagggcagcacacagctgctgctcataatgtggagagttgcagtgcacgtttgctgggcacattacatccattatctggtttaatacaatgatgaaatttggggtgagtactgttattgtctccatttcacagacaagggaatagagattagagtggtgaaataatttgctcaagatcacgtagctagtaagtggtgaagtcaggatttgaacacaggtttcaaaacaggctggaggcctgtttgtgacctgagggccaaacttctattgtggggtgaggataatctatcctgcaaaggaaaatttggggccttgagggcctcactgggactcaggagagagctcttagatgggctctgttagctgattttaaagagcctaaagtacttgctgtgaccgatttctctttctgcgatcagcagcttcagagcatagcacgcttcagctgctcttaaaaggttactgaaaagtgggtgtgaggtattgacatt

SEQ ID NO: 221212 - DNA, 563 bp, Homo sapiens
agtgagccatgattgcaccactgcactccagcctgggcaacaaagaaccaccctgtctcaaagaatgaataagtaaaaattcactttaatttaatttaaaaactactgtttattatttttagatcctagaataagtaatataaggccggtaattttgttcgttgaacacttaaaagcaaaagctcattagttaaaataaaataccattttggcttagagccatgtttggagataatttttttttgtaacatatccaattaattcaatgtttacttgtatatatggattgtctaattaaacttggtacaattgataaatgtatattttatcagaaaattgcccaattcatccaacttatcaaactaattagaattaggcattttaatcttccatgaccatctttatcaaatgattatgttaaaaagtgtagttgttaggagcacaggttttggagtaagggtgagaggactcttctttgaaattccagcactgatacataagaagctttgctgtaatggcaagtgaaacccccaatttcagtgacctcatttattaaaaaaaaa

SEQ ID NO: 221213 - DNA, 584 bp, Homo sapiens
agtgttcctcagggctgaagtacagcatggagctagacgaaatggatgaggtcaaattcttctcacaggaaaaagacttggacgggaaaatccagaatgcaccaaattctcatagtgcacagcatgtgaagatggggtatggagcatggtacctcaagcctaagttggggaaaaagctaagaagtgatgaacctttgattgaccccaagctcgtacttgaaaagcctgatgaacccgacattcttgacggtctttatggaccaatcgcctttaaggatttcattctaagcaagggctatgaaatgcctggcatcattcaaaggctgtttgccaggaggggatggacttatgactctgttaagactcctattcaacgtgcaatgcaagtttacaagtacaaagaagacgtcacagatgcatcggaagaagattagatggttttgaatttactagttaattgggtatttcttgctctcattttaaacatcagtcagaatttatgatgactggccccaggaatgtacaacgttggcaacatctgtaaattcaatacctaatgtttataaatatttcttaatgaaatg

SEQ ID NO: 221214 - DNA, 506 bp, Homo sapiens
cctttgttacaaactaagagttctgttctgatagtacttggtatcactgcttctctgtgaaaatattcaacctaatttcagatgagatcgggtgtgttcagggtggtatggctgtagactattcaacctaatttcaaaaaatttcacctgatccagttttaaagcaaccaatggaataattgatttagtatcaattttatttaaagatgaacccttaaggccgggcgcggtggctcacgcctgtggtcccagcactttgagaggccgaggcggcagatcatgaggtcaggagatcgagaccatcctggctaacacggtgaaaccccgtctctactaaaaatacaaaaaaaaaaaattagccgggcgtggtggcaggctcctgtggtctcagctactccggaggctgaggcaggagaatggcgtgaacccggtaggcggagctcgcggtgagccgagatcgcgccactgcactcgagcctggaggacagagtgagatgagactccgt

SEQ ID NO: 221215 - DNA, 454 bp, Homo sapiens
gtgtgtgggggctgggcacagtggttcctgcctgtcaatccagcactttgggaggccaaggagtgaggctcactttagctcaggagttggagactggcctaggcagcatagtgaggacctatttctacaaaatagtaataataataataataatggtaataataataataaagctgcatggcccccaaagggtcgtgtccagctctggataaacttgtctggttagttcaggtttcatggcgcggcatagaggaccccgaccgttcatcactcattgctgtgtccccagttggctgtggcctgaaactgcctggtttcagtcaacactgttgccgtcttgcatcagccattcagggggtgggtacccatgggagggcctcagccaggacaaaggtccacttctgtctaatcgtgtaactttaaaataaagcttttgtgcagggacagagtaaac

SEQ ID NO: 221216 - DNA, 228 bp, Homo sapiens
tgagaaagcagagacagcaaaggtagctctgtcaaactggtgccattgttggtgattaactggatgactctgtctccaatatgaactcactcatatacacacttattgcttagaagacaaggcaagcaaacctgcccaattttacagaggagaacaatttcacttataagctaaagttaacactcctgatactcctggttcatggtgctccaatatttgttccacttt

SEQ ID NO: 221217 - DNA, 497 bp, Homo sapiens
cgggggggggacggagaggattctacaaaggcggatttcactttctaagtagcattatattggtctacattaataattttcccagcaggccttccaagattttactttgaacaatcacagtctttgtttctcagatcctcttacatgtgacatttggtcaaagttttaaaatcagcagctaacggaggaggagaaaagtactgttcactaaggcactgcacaaagccataccacagcacgtttcagggttccaacaagctggatcacattttccagctaaacactatttcaatgttgtgttacattttctgtacactgtacactatgttttattaacactatacttcatcacactgatcaggaaaacatcttctaaacatcattaaaataagccttaagaaaattcttcggttctttcccacaggtgtgcattttttaaagtatcaggtacagaacaattaattttattcctattcaaggtctttgtatacagcctt

SEQ ID NO: 221218 - DNA, 578 bp, Homo sapiens
tatcttactgaatcctattgtgttctcagttgaatccctgaatacaatgcaatcatttgccagtgataattttatttccttctaatctttataattttctcttccataactgcatttgctggtacttctactatgaaattaagtagcaatggtaatagtaggcatccttgtcatcttcttctctttattagaagtgcttatattattaatctagggatctcaaaaaaatcaaaattcagtataaaaaataaaaaatggagagctagtgagcaactaccagctctattctccacaggtgccacatgttggaccatctgtctacccatgcttacatcaagaaccaaggaagttttgaaaaaaattacagaacataaacaagctttccaaacaatttaagaaaaagacaaaacataattaatactgacatcttaaaattctttaagtatttatgagaaatgctatctacgtttcccttttctaaaagcataatatacagtatcacgttatacaagatacacctgatgcatgatacctaccatctaactaacttatttttctttaaaaacttcactgaatag

SEQ ID NO: 221219 - DNA, 665 bp, Homo sapiens
gtctgcaccacaacagagggtgagacatgtcatgggggtactcaggttactggaaagatttgctgcctagagtagaaaaaggtagatttctattgctcaccccaaatcatgtataaagagcttctgattcacttcctcatgcatcttaacttttacttggcttctcatatatacatatagattctagaatgagtttccttgacatggggacataagtattctaggtattgaaaaggagcatcttcaattgtagctataaatcatctttctggtctctatcttgatttcttattagttttcttggcttgaattatgacttcacaggatatgaatacccagggataaagggccactaaatcaaggtgccagacttgcaaaactgacacctagatccctcaatagaggaaagagaagctgtttgtaatgaccgaggacaaattgaatggtttccctcaggccaaaatttctcctaaggttgatcacctcttctcttcttgtcctaattctccttgcactctcatccaaataggagatgcatcattcctaaaatgtatataaggccaacataatgtatttttgtttttattccatttttgtttttgctctataaatctccatcagtcaagtctgtctgagaccctagggcaatgtagaaaacattcata

SEQ ID NO: 221220 - DNA, 606 bp, Homo sapiens
aagctaagcaagacttgttctcttaagtgtcttacatttgtttttgtgtgtccaccaagggttataatagttactatcttgctatttatatttgaactattggtctattcagttctctcctagccattttcccctaaatgcttttgtcctaacatcttctattaggtgtggtttaagtcagagtcagtctctgtctttctctctcagtcatcacactggactttgagtggtacaagggaatattttcaatttattttctctatgtccaagtgttttcctctaattaaggtgataattaacagtggaatggttaaaaatagtgatggaccaggcacagtggctcatgcctgtaatcccagcactttgggaggctgagaggaaggacgatcacttaaggccaggagttcaggactagcctgggcaacagagtgagactccatttcaacaacaaaattaagtgagtttgggggctcatgcctgtagtcctagctccttgggaggctgaggtgggaggattgcctgagctcaagagcttgaggttacactgggttgattgtgctactgcactccagcctgggttacagagcaagaccttgtctcaaaaaa

SEQ ID NO: 221221 - DNA, 456 bp, Homo sapiens
ctatggactggacagttgggtaggaaccagaaggccaataggaaggagggcaaaggtgcccaactgaagggtaagcatggcagtgagtatggtatgcctagaataaagatggttgggattagaattgggtgacagtgattagtagtttaattcagaagtatctcttcccaactcaaaagtctcactttgggctgaaagtacagaggaagaaggtagacttttaagaagtctgaataagcccccaacttctggagtccctttctcaattcctgttgggagtgggaaatattataaattactctgggcattaaaaatagcttagtttaacctcgattgtggagttaaaaaataacaaagattgcattggtcaaatctggacaatttgagcattcaaaagaataacaacaataagttacaacatatttaatataaagaagaatccacgaagagtgatat

SEQ ID NO: 221222 - DNA, 531 bp, Homo sapiens
agggatccatttcttccagattctgttatctgaccttaaccttggaaaatcctctagtgccatcctggcagttaaggcccttgagcagccgtcactgccacaggctacggaggtaaaggaagcagcaaaacaaatcttgaaaaaggcagcttgctcctgatggagctgcatgagttacaaggtttttaactgcaagaattgttggagccacttctggtaatatatgaatttcataaaaatgttttccaaggtgcacagaaacatctgaggactttaattaagccctccaccatcgggaatggaacttttatgtacatggactttggattttctttttctctttttgagcactgctggcaaggaagcaagtaccaagcgaggattccaattgagttctttgacacggaacctttcttttccttttttggaaaatggaagtaatgtactagtacaggcagtctgtttgggaatatgagcgtttatattaatggcattaaactcagtatttataccacaaggcacctccttccc

SEQ ID NO: 221223 - DNA, 514 bp, Homo sapiens
ttcacattttatttatgcaagtggtgtcacaaaaattctctttgaatcattaccactacctggagcttcaaagggtagtaatatggctctcaaaatttcagtgcaaatttcagttgtttcttcacatcatatagtttctgatttcataatttaaatatcacaaaattagaaagttctaccctttttttcctctgtcacttttcatgtgatctgattttaagtaattggaacaaactgtatctaatttcatgcagcataattgctaggcagcctcaagctatggaggctcagcactctgtctccattaagaaattttcagttgttcgggatatatatatatttttttaatacaaatgaatgagcctggacaaattaaatgtcacaataatctggccattgttaagaggagaaaaaggtatcaacaacattcctaaacccttgtctatggtaggtcaactgaatgtatttctttttctcatagttcttggccttagtgtcccacaaactttcaatt

SEQ ID NO: 221224 - DNA, 450 bp, Homo sapiens
tcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgc

SEQ ID NO: 221225 - DNA, 479 bp, Homo sapiens
agcttttaataaactcataagtatactgggattgtagaaatctttgtaactcttgtccaccttggacatttctgcagcacagtgcacattttgcagcacaattatattgaatttcataataaaagttacataatatcctgagctgctttagcttaaactacatgcagtggtttatgataattattgtacttcattatatcccagttcttttaaagttttaagttcatgtgtatgtatatatatgacaggctgggtcctctaggaggcagattctgagatttgcattcaggaggttcattgggagtgctgggctgtgttatggtcaaaaggcttcagccagccctgcagagaactctgaggctagagtggtccttcagagttacctcaacttggggtgagggggatagacctctatacctttattagttatctctattagtttggggtaatttgcaaacagtgtgcaacagattaccccc

SEQ ID NO: 221226 - DNA, 348 bp, Homo sapiens
ttgtgattatccctcctccattcgatttattcacaaagtgagtgagactgaatggctggtttctagccagaggggacttcaatatttgagtgagggagacaggaaaagacccaaaaatcgttagtgtccccaccctaggacactggcatatccgtgacctctctgagtgctctgagaaaaatgagggaggttggtgggcacagtggcagacaggtggctgctggagtctccctcttcccacgggaccctcctgtccctggcaccacaatctcacctcctttctcacttttcagttgcaaggagggatgcatggtttttttagcaaataaaatataagacatctggtta

SEQ ID NO: 221227 - DNA, 366 bp, Homo sapiens
ggaggagaggcctggtgggagtgactggatcacaggggcaggtttcccccttgctgttctcatgatagcgagtgagttctcactagacctggttgtttaaaagagtgtagcccttctcttttcgatctcttcctcctgctccagccatgtaggacgtgcctacttccccttcaccttctgccatgattgaaattttcctgaggcctcccagccatgctacctgtccagcctgcagaactgtgagccaattaaacttcttttctttataaattacccagtctcaggtaattctttatagcagcatgagaatggaataatacgacaggcctgcacgaaggagctccagattcagctctacctttcatc

SEQ ID NO: 221228 - DNA, 460 bp, Homo sapiens
gacaccctagatcccaagatctccaaggatttggtggcatacccactccagcacacagaagcatgaggttcatgactctcctcttcctgacagctctggcaggagccctggtctgtgcctatgatccagaggccgcctctgccccaggatcggggaacccttgccatgaagcatcagcagctcaaaaggaaaatgcaggtgaagacccagggttagccagacaggcaccaaagccaaggaagcagagatccagccttctggaaaaaggcctagacggagcaaaaaaagctgtggggggactcggaaaactaggaaaagatgcagtcgaagatctagaaagcgtgggtaaaggagccgtccatgacgttaaagacgtccttgactcagtactatagctgtaaggagaagctgagaaatgatacccaggagcagcaggctttacgtcttcagcctaaaacct

SEQ ID NO: 221229 - DNA, 541 bp, Homo sapiens
cagatagatgagggctattggaccatgagaaagtaaaggattcaatgaactcagaaggtcttaatgaaataacaattgtttctgaggggcctttgaacaagtaagctgctgaaaggaaaaatgctgtcatcagaaaacaggatgtttaaatgtatgcatttggaggctgtgtactgtctgaagataaggctcgagatgttcatggcagtgtgtggctggggctgggggataagaaaagttcataggtgatgaggaagcacataaactgaggagccactgtgtggatgctcgagttgctgaggatgctgaatggagttgggtagatagcggaccagctgctgaaatactcaacactgagggagaggttgacagatgacagcaacaaggaggagaagaagaggagggtgacaaagttagatggtataaactcaaagaaacagaggttttttgtttttgtttttttttgagacagaatcttgctctgtcacccaggcttgtctcaaactcctggcctcaagtgatctgccactttggcctccca

SEQ ID NO: 221230 - DNA, 275 bp, Homo sapiens
ctgtcacttcccatgagaatttttcattccactgccctagttttaatctaagcaggtcactgagtcttttatacacaaagctcaccaagtgtctaacttactcaaaacacctagaactagctgggtgtggtggagtgtgcctgtggtcctagctaccaggaaggctgagataggaagacagcttgagcccaccttgagtttggggctgcggtgtgccatgatcacagctgtgaacagccactgcactgtagccagggcaacacagagcctgtcta

SEQ ID NO: 221231 - DNA, 173 bp, Homo sapiens
tctgagcatgtaactgtctcacaagactatgattataaaaacagtatttataaagcagtgaatactttatcatgtatttataaagcagtgaatactttatcaagtattccatatactttatagaagtacacttactgccattttacagatttgaaaataaactcagggccagg

SEQ ID NO: 221232 - DNA, 405 bp, Homo sapiens
caaacacagtttatgaatgtcatatctacattttgatgtactcactgtaaagttgtaataccaataataacggtctttccattacagatatttaaataaattctttccatgtgaagcagaagtaattattatcaatatttgggtgaaccagaatgctggtgacagctccaacagctgcattcagccttggctcagtaacaaaacacagaaagttccccagtgagaaacaaggcagggtttgataaattccattcagctcttcagttacagattattaaaagatgaattataaaattggcacaataatagccatgcacattctttctggccagcatcatccccaaggctctgataatcacagtggaatctttaaatcagaggacaattcaggtctaactcaaacag

SEQ ID NO: 221233 - DNA, 134 bp, Homo sapiens
acaaagtttattaatttattgaatctgtgatttttacatccaatctacagaaataaaaactggtaaaatcaatgggttccttcaggtatagaaactagaaatggtcaactcaatgcctctaaatttgtgctatg

SEQ ID NO: 221234 - DNA, 341 bp, Homo sapiens
cctactcaaatcaatcaacacacacattaaaaaaaaaaaaaaaaaattcctctctggggtcctagcttccaagaagacaaagaaaggaaagaacatggcatgccaaaaagggctgtggctatgtgcagctcactcactgcatgaactgtgcctgaggcatgcccaaggacaaggctattaagaagtttctcattcaaggccgggcgtggtggctcacatctgtaatcccagcactttcatccagatggtacattatatctccaccacttccctttggtgagtcttacaagattttctgttgtgcgtttaggcattcctccagttgattgggttgacgtcag

SEQ ID NO: 221235 - DNA, 462 bp, Homo sapiens
caaatacctactgtctcttctgtcatctggaagtccccaccaaattgggaagatggtgctacagctgccaggttcagaaccacagccgcactgtccccatccgaaggcctccatggctgccactgtcctgctgtgatctccagcaaaataggttctccatgactagtcagtagagacagaggatattgctgcagaataacctaacacctccctggccatgttgccaggggaaatagttaaagtacagaatatactactttccctttcatacctagctgcaagggaacctggaatattactccttaattttccagatcctgcataacagaaaggcttatggcgaggaggttggactggatgatggggaccgatttaccatgtctacttagtaaacagatcaaatgataagaaatagacttcagttctgtgttatggccatgcaaggtagactggcagagaagc

SEQ ID NO: 221236 - DNA, 589 bp, Homo sapiens
tgcacgagagtatatttaaatcaaagcaagaaatcccatttccaaatggcaataaagcatgtgttacatagaatcagtgcatgaaagtgttttagtagcccagattagattgtaccctggcgaataagcaagagttctttttcattttcatcttgcaattcaactgggtatttgggttctttttctattcactcatgtcagatagagacatgcatgttgtaaattattttgtcagaatgaaagcctggcagattaaatgctttcttctcttcttgctttacttgatatcaatctcttgttcatttcttgataatatgtttggttatttttgttttcattgcttttagtgtcagagatggctttggattccccgttctgtgtgctgctgtctggctcctgaacccagctgtagaggtgtgtgtcaatcccaactggtgaagtactgagaagaagctacacaaaaggcagcaaagtattagtaagtgtacctctgacattttaaccacctctgacttttccatggaatggacaagtagtagtctctgtcagagctacattttaaaggagaaaaagaaacgtgaagtcatga

SEQ ID NO: 221237 - DNA, 1197 bp, Homo sapiens
ctgccatctcggctcactgcaccctccctgcctgattctcctgcctcagcctgctgagtgcctgcgattgcaggtgcacgccgtctacgcctggacaacatagctactaaaaatacaaaaaatgagctaagcatggtggtacatgctactcccgaggctgaggtgggaagatcacttgagcttggggaggtcaaggctgcagtgagccgtgatcatgccactgcactccagcctaggtgaccctgtctcaaaaaaagaaaaatgtggtatatacatagaatattattctgcctttaaaaagaaaattctggctctccctctcactctccctctccccacggtctccctctccctctccccacggtctccctctccctctctttccatggtctccagctcctaaccgcgagtgatctgccagcctcggcctcccgaggtgccgggattgcagatggagtctcgttcactcagtgctcaatgttgcccaggctggagtgcagtggcgtgatctcggctagctacaacctccacctcccagccgcctgccttggcctcccaaagtgccgagattgcagcctctgcccggctgccaccccgtctgggaagtgaggagcgtctctgcctggccgcccatcgtctgggatgtgaggagcccctctgcccgggctgcccagtctgggaagtgaggagcgccttttcccggctgccatcccgtctaggaagtgaggagcgtctcggcccggccacccatcgtctgagatgaggggagcgcctctgccccgccgccccgtctgggatgtgaggagcgcctctgcctggccgcgaccccgtctgggaggtgaggagcgtctctgcccagccgccctgtctgagaagtgaggagcccctccgcctggcagctgccctgtctgagaagtgaggagccccgccgcccagcagctgccccttctgagaatgtcagagatggctttggattccccgttctgtgtgctgctgtctggctcctgaacccagctgtagaggtgtgtgtcaatcccaactggtgaagtactgagaagaagctacacaaaaggcagcaaagtattagtaagtgtacctctgacattttaaccacctctgacttttccatggaatggacaagtagtagtctctgtcagagctacattttaaaggagaaaaagaaacgtgaagtcatga

SEQ ID NO: 221238 - DNA, 521 bp, Homo sapiens
gcacgaggccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccag

SEQ ID NO: 221239 - DNA, 720 bp, Homo sapiens
aggctaaggcaggagaatcgcttgaacctgggaagcggaggttgcagtgagccgagatcgcaccactgcactccgatctggcaacagagtgagactccatctcaaaaaaaaaatgtttatagcactatttgatgtatgttttcagtgcttaacactatgccagaggatggaaagaatgggtaacctgtgaattttcagagaagaaacaaggaaattgaatttttggaatacaagttggctctttccttgtgtacatgcagcctaggatagtggaatgagcaaaatattaaaaatctagtcctggcaccactggttatggtaaggggatttttgtataagtcaattagttgttgaatcattttctcatctgtaaattgaaaatggcactctcccctgagataatgcatgttacttgccatggaaatataagggtcaggattctatgaattaatttttaagtagcttagtatcattcaatagtattctaaaataccaggttacttatactacctattcatgtatgacatttgtgttagtataccttctattcatcaaaggggctatgagctagacctgcagattaacacgcagatgtggccttaaaaaaaatatcagctaatctgggatccagagaagtaggtgaaatttgaacaatgaaaatacattaacagcttctaaagatttatagcagtattatgaccagcatggtagtgatgaaat

SEQ ID NO: 221240 - DNA, 789 bp, Homo sapiens
cagttccttgtcactctcactgcagcacgctttttctctaccttagctcagcccccaccatgagggcaccagagctgccttgtcttgcaaacacccgctctctgacctccaccttcgactctttccactcccttagtcttcaacccttggaccaagccagtccgttgaacccatcacttgcgtaccatcctgcctctcccatcttgccttctctccttacctaggttagagctatcattttaatcttgttcctacaaacactttcagttccctggcccctgtctcccatcatctggcacaaaacccatctccactggcttgggaaccattgagtgtggcaggagagaaatcacataaccgatgccatattttccctgtaaattcttagccacaaatctcaaatgagcattcattttccataatccccagcaattccactactggttagtaacatttccactctcacctcgatatctccccactgttactctcaccttcgggcctggccttgcacttcactgaaaagatagacttcatcctgcaggacaccttgtgttcccacctccaaatcccccagccttctgcacctgtgcctgtgtcctcatcgcctccccacctgcgacagtggcagaacagtccctgttcatggggacccccacgtctgctccagatcccattctccctcacctctgaaagcatttgctccttcatctgtcacctctctctccagtgtcattacggagagtcctctgtcttaacacaaagcaaccctctcgaccccacttccct

SEQ ID NO: 221241 - DNA, 537 bp, Homo sapiens
  misc_feature (529)..(529): n is a, c, g, or t
cagttccttgtcactctcactgcagcacgctttttctctaccttagctcagcccccaccatgagggcaccagagctgccttgtcttgcaaacacccgctctctgacctccaccttcgactctttccactcccttagtcttcaacccttggaccaagccagtccgttgaacccatcacttgcgtaccatcctgcctctcccatcttgccttctctccttacctaggttagagctatcattttaatcttgttcctacaaacactttcagttccctggcccctgtctcccatcatctggcacaaaacccatctccactggcttgggaaccattgagtgtggcaggagagaaatcacataaccgatgccatattttccctgtaaattcttagccacaaatctcaaatgagcattcattttccataatccccagcaattccactactggttagtaacatttccactctcacctcgatatctcccatcttgccttctctccttacctaggttagagctatcattttaatcttgtngggagctt

SEQ ID NO: 221242 - DNA, 614 bp, Homo sapiens
gaataaactcaaatacacggtggtgccatttactggaagaaaaaagcgggtgcgctcttgactttcccaggattcagttacctaaaaatcagactgtattttcatttttacagctaataaaaaaagttcatcatttcttactaactataaattattataggacctaaaatttattcacggtatcttcttatgaattttcatacctgctaaatctcaccaatccagaattgtcttcccctggatatatgttttgttacctcatcatctttgagatccttttatatgtcatcttctcagtgaagacactgaccactattttaagtcatattccactctctattcccttaccctgcttaatttttctccatagagtggatcacctaactcataatgtattttacttatcaccctctactagaagaataacaagatctatcagcagggctttttgttttgttgtttttttccactgttagatctctagtatctacaacagtgcctagagctggacaaaattcaatactttttaaatggatagacagatggatgaaaataattttcagaagagttttttgaaagacgtagtaccctttcaccagacttttcatagaacc

SEQ ID NO: 221243 - DNA, 780 bp, Homo sapiens
ggttttggggttgcttagttttattatgttattgattttaggagtttttagtggaaagaaccagggactatatattttggagggaaaaaaaaatcatcattgatttttttttttaacctagctgaagttaagatagtatttttatttaaattctgattttacatttgtaactgttgtctttcctactgaaaatcattcttaagaacaatattataattatttgctatatcctataatacataaaaatagtttcaaaataataaaactagaattactaacaataagcctactgaatgagatttaaatttctgggcagctttctttgatattaatatattccactatgtatgcagtcaagatgtatatttctaaaatatcttgaaatacttgtttctctgtgtgtttgcgtcaccaaattataatgcagttaggtttgtttcaatttcttttcaattttcagggattgctttttaaatttttacttttgaatgtgtaaacatttatgtaattgcaaaatcaaaactattcattatttatattcagagaagttgtgttttcattcctgtcccctttattctatcctatccttacctcccctataggtaattgattttaaatgtttagagttatttttagcaatataagtagtatggatattatatacatattctctcttatgtactagcaccttctttttttctcttaacagtttaaactgattgcattttaagcggtattatatgtttacctagtaggactggaaatcttgaataattagat

SEQ ID NO: 221244 - DNA, 515 bp, Homo sapiens
ggcatggtggctcacacctgtaatcccagcactatgggatgctgaggtgggaggatcgcttgagcctaaggagttcaaaatcagcctggacgacatagtgagacaccccatctaaagagagagagagaatgggtcctccctcccctccctttcgagaaaagcctgacaaatttatttgatcatagttttacatgatgcatcatgtaaaaccagaatgaacacccaaagataccaaaatcaaaaaaaaaacctgtctatttttatgcttaggttctgtgaagcagggacagccatgtagaaatgtgattggaaaaaagtgtatgagctgatgggaatagactgagtggggaaatccagtcaggcctgactgctcagagtcttcttttttaaaaaatttatttataaagaaaataagtgtgtttcttacagttttggaggctgagaagtccaaggtcaaagggctgcagctggtgagggtcttgttgctatgctgtaatgtggccgaagccaggaca

SEQ ID NO: 221245 - DNA, 314 bp, Homo sapiens
ttccatgtataaacaaacagggcatgcagataagtaatggggggctcaaatgcaacaacagttttgcagtccctggcccccacaaagcatctgcaaggcaagggtagaaattagaaggtgaaggattaaattatctcaaagacattattgctgcacatacgcaaacctgaccgttgcatggatttgtcttgtgcttggcaggatctagatgtcctgttccatgactaagttatcatgtcatgggagacttcaagcggtggatgccctagtggcttttaactgccccacccatgcctgcaaatggcagccttgat

SEQ ID NO: 221246 - DNA, 459 bp, Homo sapiens
gataactcggagcaattaatacttttctgaacttgtttcctcgtctttgataaggacagtagtacctatgggccaaattttggaggctacagttagatgcctcccacaaacttcattaaaagacaagagaacacatgtattatgtggggacactcagacccccagaattggcatgaatgttacttggaactgaagacatttgagagccaacagatgcagaaagatgccgtttcaaagcttcccttatgcgactaacagcagaaatttctgggagtgaagctgccgtaaatctcctctctaggggagttttagtggccagaaaaaaagacaaagaccacttgcacctgcaaaaacaaacattcttatctcccttttgttcccccagaaacctatttgttcttcccatggaaggctttttctccctcctcttcccctattaaatggtatatataaagtaga

SEQ ID NO: 221247 - DNA, 386 bp, Homo sapiens
ctagattgtgccattgcactccagcctgggcaacaagagcgaaactctgtctcaaaaaaaaaaagtaatgaaaaaggtaagatcatcaattggctagaaataataacattaatgaatattcatggaatgtttaccatattcctaggcatacagagctttctggtagacattttaaaattgtctttgcagagcctggccaacgtggcgaaaccctgtctctactaaaatacaaaaaactagctggatgtggtggtgcacacttgtcatcccagctagtggggtggctgaggcatgagaatcacttgaattcgggaggtggaggctgcagtgagcccaaatcgtgccactgtactccagcctgggtgacagagcgagaccctgtctca

SEQ ID NO: 221248 - DNA, 318 bp, Homo sapiens
tcttttacttcgcaggaaggatgacagaggcaagcctcctgagagttccaggggtcaaggggcctgtgtttcccctaagtacttatttagcattttgttttgcaaaataacaatgaattgatttgaaggcatacaggtggggacatttttacaatgaaaagaagcagcattgcaatttaatgcctaatataaaataagaggtgttggagagaagaagacaaatagcaataagtgttcccattaagtagagtagagcagcattttcttttcttttcttttctataatcccatttgtgggaatgagagggagtgccaaaa

SEQ ID NO: 221249 - DNA, 500 bp, Homo sapiens
ggctggactgcaaagtcctggaatgcttccccccaacccccaacctccacgtcaaacctgtcgttgcaacgaaataaataaaactgacagctggaaaaatgaggggcaagcagaccaaatatgataaacggtctcttgccgtgtattgtattctctacaataaaaccccaagcagatgctaaaaatgtgtgcggctttgtgaggagataggcgtgctctgtgtggccgagattttctgagaaaggtaatttaactgcaatgcacataaaggagagaaaggcagagaagtaatttggaaagtgtacatcaagtgctttttaaaaagttgatattgttggttatttttcttttattaaaatccacagccctgtgggctgctgtcccatccttatcgggctcattcaagaccagcattgacatttctaatttgcaaatttaaagattgtcaggaaatggtttaaacacccagtatgattggggagctttttgactgtgggtga

SEQ ID NO: 221250 - DNA, 1141 bp, Homo sapiens
gggctcacaggataatccacgactgtctcccatcttaagatccttaatcacatctgcaaagtcccttttgccatataaggtaacatattcacaggttccagggattaggatgtagccatcttaggggagccatgtttctgcctgccgcagacagtctggcctcaggttataatgaaatttgcttgtggagggttgtagggagcgaagtgatttagggagtcggggactggaggattattgggacataacagtagctagtacttttgagagtcaagtctatcccagacaccatgtgcctaatctcattgtatcctcagaacaacccctgcaggggtactgttagctgacccctgtttacagaggagggaactatccaaggaaggctttctggaggccaggtgcagtagctcatgcatgtaatcaactttgggaggtcgaggcaagaggatcgcttgaggccaggagttcagaggcaagaggatcacttgagcttgggagactgaggctgccgtgagccatgattgcaccattgcactccagcctgggtgacagagtgtgaccctgtctccaaaaaaaagaaaagagaccagcctgggcaatgtagggagacgcccatctctataaaaataaaataacataattagccagatgtgggtggtatgcacctgtagtcccaggtacaatggaggctgaggtgggaggatcacttgagcccaggagttggaggctgcagtgagctatgattgcaccactgcactccagcctggccaacagagccagactctctcagcaacaacaacaacaacaaacccaaaagaaacaaacaaggaaggctttctggaggaggtcaacatttgagctgcgtcttgaagagattaaagggttttgctagtgagtgggaaagggattccaggcagaggtgttactggtggagggtgtccaggttcttggcattttgagcaaagaattggacaaaacacacgaacaaaacaaggaaagaaagcaacgaaagcaaatatttacagaaaacaaaagtacactccacagggtgggagtgggcttgagcagattgcttacagaattgcctggggtttaaaaaccctctagaggtttcccattggttacttgatgtacaccctat

SEQ ID NO: 221251 - DNA, 515 bp, Homo sapiens
tgcatagaaatacaacttattcctcaagtctcagactccctagcctagaagagaccttcaagaggtcttttaggaatctctgtgactcaagaactgatgtgcctaagggaaattctaacagagaagacactttgccatttgggaaattctcaccttcctatatagttgtgacatggacatattctgctctctttctctgggtttaattgaggggcaaggcaatgtcgatgaagagagctatggttcagatgtatcccctccaaaatttagatgttgaaacttaatggccaatgtgatggtattaagaggtggggtcttcaagaagtgactaaattatgagggcttctcccctcatcatgactgagattaggccctcacaaaagaggacacagtattcaaggtgccatcttggaagcagagactgaatccttacaacaaacctgccacctccttgatcttggacttctcagcctccagaactatgagcaatatatttctgttctttataaattaaa

SEQ ID NO: 221252 - DNA, 317 bp, Homo sapiens
aaaaagtgttctttagtggtggcagcctttttgtcaaataaaattttatcagaatacactcaaaattggtaacaggagagccgttctgggtacagagattgaggggaacctgtgtgtgacctcttgcttcctgacccctcccatcctactccagactcttctgcagaaccccatgttgacccctgctttgaggtggcagagttaacactactcttcgttataagctctcgtctggggcaactcagaagaacgtaagttccatggggaaggtttttgtttgtttctaattgtggtaaaatatatataacataaaatcg

SEQ ID NO: 221253 - DNA, 378 bp, Homo sapiens
ccttgcctagattttttagttgaaacacctacatgtggactctcaatgtggctgcttaggcttcctcacaggatggtgactgggttctaagagcatgagtcccaaaagaatgcagcagaagctgtatcatcttgttcattgagttagcatttgaagtcacacagtggtcactttcactataatcataagcctgctcggattcaagaggaaagaactcaggccctctcatagggaagactatcaaagtcacattttaaaaaagattatgtggggtgggaggtagataatgttgtggacatcattggaaaatactagctgccttatcatgtaattcctcaagcatcttttctaagacagggtctcactctcatccaggct

SEQ ID NO: 221254 - DNA, 714 bp, Homo sapiens
tcagctaggcgcagtggctcatgcctgtaatctcagctaactgagaggcacaggtgggaggatcacttgagcccaggattttgaggttgcagtgagctatgatcacactactgcacttcagtccagatggcaagtgacactccatctctaaaaaacaaaataaataaaaaataaagtatataatcggtgtcatttagtacactcacaatattttgtgaccatttccttaagtcagtttttgacagtatatattttatgttattacaaagctgcctacagtaagcagacattaatgagaacatttgtagaaatttcaagaatttccatcttttttgaaagtccgtaagtttagtaaaatgtcttcattattttttaaggtactttttttcttgggagaaagtgaatgttatagttcttagaacttgtataaagtttctgtcttgaaggtacatatcgacttctttctcttttggtggtgcattttatcgtttacacttaatgattgctatgactcttataaggatgtactgtgtttttattaaacaataatttagtacagtatttctgagaaattcatggatctttctatgaaattgtctgacaaaactgggaattctgagatgatgaaatgaattgtcaaaaatagatgataggtcatggtggcaggcacctgtagtcccggctacttgagagactgatatgggaggatcacgt

SEQ ID NO: 221255 - DNA, 444 bp, Homo sapiens
ttcaagatggattaaagacttaaatgttagacataaaaccataaaaaccctggaagaaaacctaggcaataccattcgggacataggcatgggcaaggacttcatgtctaaaacaccaaaagcaatggcaacaaaagccagaatggacaaatgggatctaattaaactaaagagcttctgcacagcaaaagaaactaccatcagagtgaacaggcaacctacagaatgggagaaaaaatttttgcaagctacttatctgacaaagggctaatatccagaatctacaaagaactcaaatatctacatttttctccctaaaaatacaaaaaataaaaccgaaaacctcacaacaaacaaataaccttgtacatggctttgtaatgcaaaatattttttaattcctttaaaaatatataaataaaatatatgaaataacattgactt

SEQ ID NO: 221256 - DNA, 411 bp, Homo sapiens
cagaaagagagagagagtatttgcaaactgtctgtatagtttggatgtttgtcccctgcacctcatgttgaaatctgatcctcaatgttggacggaagtggagtctaatgggaggtatttgggtcatggagatggattgcttaatgaatggcttaatgccatcctctgtaaatgagtgcattctcactctattagttacggaagagctggttgttaaaaagaacctggcacctccctccccctttttctttgctttcctctcttgccattggatctctgcacatgatagctccccttccatcatgactggaagcagcctgaagtcctcattagaaacagatgctagtgccatacttcttgtacagctggcaaaactgcaagtccaataaacctctttttttaaataaatta

SEQ ID NO: 221257 - DNA, 591 bp, Homo sapiens
atatagatgaatctcaaaaacattatgctgagtgaaagaagccagatcccccatccctaaactacataatgtgtgattctactcatataagattcgaaatggggcaaaacaatgttccacggtgatgaaaatcagatcagtggctatttctggaggaacagactgggaaggggtggagacactctccagctcaatggaagtgctcaccatttgatgtgtacgtgttaagactgattggacagtacatttaagatctgagcactcagtgtgtacaaattaaacctcaatttaaagaaaagaaaggtaaaataaaaatcacagccaaaagaatgccaaatgatcattggtagtgaaattggtagctttgattgtcttgtaagtggtcccagcagaagatagagcagtgcataatgagggggctcaggtggcctgggttactaggataaagcagctctcacaggcttaaccagaagggacagcagcaaaatgagactaggagtgagggtagggtcaagagtagaaaagaaaggagactaaggaaagatctcacttgaaatggattccaaaacactaaatgacaatggtaagaat

SEQ ID NO: 221258 - DNA, 513 bp, Homo sapiens
aaggggaggaagagactgagattattctattattgttttcttgtttctaaaccatgcatatgtatcttggtctcatttttatacttgtaactttacatttttattgtttttagagcctcctttggtgaataaacagaaatgaaaaggtgaaaatcaaatcaactttgttactccttagttcttaaaagttcaatatttcattatttaaagagtcccctataggccagttgtggtggctcatgcctgtaatcccagcactttgggaggccgaggcaggcggatcacctgaggtcgggagttcaagaccagcctgaccaacatggtgaaaccccatctctactaaaaatacaaaatgagccatgcgtggtggtgcatgcctataatcccagctactcaggaggctgaggcaggagaatcacttgaatcctggaggcagaggttgcagtgagccgagatcatgccattgcactccagcctgggcaacaagagtgaaacacagtctcaaaaaaaaaa

SEQ ID NO: 221259 - DNA, 416 bp, Homo sapiens
ggagacggatgatggctgcacaacattatcaacgtatttaataccactgaattctacacttaaaaatggttaagattgtaaattttatgttagtgcatattttactataataaatcttttcaaaaagtaagcaatgaaggaagatataccatgctagcactaaccaaaagaaagctagaggagctatattaatttcaggcagagcagactttagagcaagggaagttaccagtggtagtaaggagcattacataatgaaaaagggtcaattctccaagacgacgtaacaattctcaatgtgtgtgccgctaataacagagtatcaaactttgtagggcaaaagctgatagaactgtgcaaggagaaaccgatgaatcaatggaagtcttcaagggcacgcaatcagaaatgaacag

SEQ ID NO: 221260 - DNA, 240 bp, Homo sapiens
tggaactttgctgtgtatatatgtataccatcactgccattagtcaaacttttttttctgataataaccaaaagaagattttataattctttaaaacagtgttctaaggaaacactcatataaataacttattttattggtaattaaagatacaagttgttttacattttagtggtacatttttgcatagatacaaatggctttgacctgaaaacttttttattctcctgaatattaatg

SEQ ID NO: 221261 - DNA, 408 bp, Homo sapiens
aaaataccctgggctctgcacgaggatgagcaaaagggaaggaagaaaggaaaacagacctgaaatggaggtttgcaccgagtcacactgggtttaagggcaaacctacaaagaggacggaggcacccttcagagcctaaagtctttctaccatcatcttgtctgcccttactagagagctgttcatccgagactccaacaccttccaggccctctcttctagacccagcagcccttggcagttcacactctctgcagagatctaccatccaagaccttcccagcaggtcccgggtgcctgcaacaacgtgggcaggttgtcttaaccactgactgcctcggttcttcaattggctaagttgggataacaccatagtactactcactcagtaaactcacagtcgacgc

SEQ ID NO: 221262 - DNA, 785 bp, Homo sapiens
aactctgctcccagtctgcaaaactcttcttctctccttctactagcccctgatcacaccaaccttagaattagttatcagttccatatggagtaactcctcatggctcctctgtaactaaatggcaacacctcccttcttttacataacattaacaatttacattccttgtcaagttatttggcagtaaggtggtctgcactgtccactaacaattactatcaatcttgtaggctcagagaaatgtactcaattctaccttccccgtactcaccaaggactaatgtctgccattagtgtgggggttaaaaaaaataaaaaataaaaaataaggccaagtcaggtggatcacctgaggtcagttcaagaccagcctgaccaacatggtgaaaccccaactacactaaaaatacaaaaattagctgggtgtggtggcacacacctgtaatcccagctactcaggacttagaggcaggaggattgcttgaacccaggaggcggagatagcagtgagccgagatcacgccactgcactccagcctgggtgacagtgaaactgtctcaaaaaaaaaaaaaaacctgaaataaatgggagacacttggaaagcaaagactacgcatgtttttctttttacacaaagaaaagctttatttatatatactttaaataatccataggatcattactacacaccatcttactgtgagatataaagctaacttacatacaaaaaagctttccagaaaaaggaaaaagaacctatgttctttcatttcccgctgca

SEQ ID NO: 221263 - DNA, 519 bp, Homo sapiens
tttgggaaggggagatagttaagggtagggccctgagggtttgggacaggagggaagggaagggatggaggatctatctgtaatctgtttcaaagaaggaaaaactgcatagtgctttgaagaaattgggcatcagtccaagaagaaatgtgatgccagcagccatcttcacatcacccccaagcctgttcccctatcttgctggcaagtcatagccctacttttacccccttttgctggtttcatgtattttgagggtcagcaattgtccatgcgctgggtgagttcaaacactgtgtgagggaccacttgggtttaggacacgggaactatgtggaagggatggtttcttgtgatatggggctgtggtgtctgtgtgatggggagcatcagagaaggtgtttggggcagcatggagggaagggtgcatatcctgtaagaatcaggggacagggtttcataacctatcatgtgcccagaaagtcaggaatggctgcagttctattaccaagccctgac

SEQ ID NO: 221264 - DNA, 492 bp, Homo sapiens
ccaagatgtcatagcgagagtcaaactgggggcttagaaatgactctgactcataacttttaatcaactgttttgacattttaacctatctaattgtgtaggaggtaattatattgtcagactttggaatgatgttgtttccagtaaagttttgttttaattataaataggaattttccagcaataaaaaatttccaccttaaaagattctcagactttagtacatctttctccaaacacaaggtggcgatggtctacaacaaatgatgtgcgacttggtgttttttttttttttttctttcctttccttttttattcttaatagttcaagttaagaatttgcaaaagtttcacatcttctcaatcatgtttaataaattctaattaaatattctcctacctcctagtattatggaaaatattttaaaaatattacaatgttaaatgaatttattcttgagggcataataaaatgcgtttttaaatcaacta

SEQ ID NO: 221265 - DNA, 536 bp, Homo sapiens
acctgacaatggactagtacctcatatccacttctaccatgacttctgagaaagtggtattttttaccacagtgaacttggtatatgcagtgtgtgtcaggggcactggccttactaaagtagaggcccattctggagaatagtaagaaataaggagcaatacattgatgaaatagaagggacattaagtgatggtcacagaccactcttaggactgccattaacttcagatgttaaagaagtgcttcagctctctgtgctttgtcttcttcttgacaagtgaggatgttaggattatctgccatatcatccagcttcaatctctataattgtataaatctggttggcagtggactcgttagtgcaaagtcctaaagccttaaagatccgaagttttctcactgggcaagcaatttgcgggattacgacagtgaacttggtgtatgcagtgtgtgtcagggacactggccttactgaagtagaggcccattttggagaatagtaagtagtaaagagaaatacactgatgagacaga

SEQ ID NO: 221266 - DNA, 543 bp, Homo sapiens
ctatgagtttgactacctcaagatatgttatataggtataaccatataatatatttctttttgtgactggcttattttcacttagcataatattctcagggttcatccatgttgtagaacgtgtcagaatttcttccatttttagggctaatattccgtcgcatgtacatatcacatttgcttatccactcatccgttggacacttgggttgcttctgagttttggctattgtgaatagtgttgctatgaacacgggtgttcaaatatcctttccatacattatattaaaaatattttttttcttaaagttgcaactttttggccagtctaggtggctcaagcctgtaatctcagcaccttgagaggctgaggtgggaggattgcttgagcccaggaatctgagataggctctgcaaaataaaaaataaacctagtcaggcatgatggagtgtgcctgcggttccagccactcaggaggctgaggtgggaggatcacttgggcctggcaggttgaggtaatccgtgaggggatgatgccactg

SEQ ID NO: 221267 - DNA, 786 bp, Homo sapiens
tccattactcattaaccattcattttactgcacgtctgttttggagagcaagaaaggacttgggctggaagtactggacactcagtataagtgtgaggtgaagcccatcagtaaatgagtaaatatattcctgccttagatatacttaccttatatgtaaaattagatgctgtagtggaaagtacagcctggggggcagagaggacctggagtatcccttgccagcgttgagcatctcccatcatggggtcccctacacctgctcaggtaccactgcagggccaggcagcggggcctcccccaagttcatactccgtctctgctgttctgtgtccagctcctttaggagaaccttcttctcatgtactgcttttttctcatgcgtgggcttactcaccagaatccctcttgctatcagagcactgacccagctggtgaggtttcccacccagcaaaccatttccttccactcctccccatctcaccagcctcattttgtaatatccttcactgtggacacccttcttaggaaatcgaagtgttattccttaaccacaccaggtctgcaaggaccatgccctcctttctgcctgcccttctttgtctttctttcaaagaattgaaaactcactcttttcacactaccttccctgacatcctaacttttaagcacatttttactggttcctctacttgatgggaatgtcatggtctgcttgcagaatgtgtccttgatgaaagtgttttggctctttaatctgtatgtaaatttccatgtgaatctta

SEQ ID NO: 221268 - DNA, 655 bp, Homo sapiens
tccattactcattaaccattcattttactgcacgtctgttttggagagcaagaaaggacttgggctggaagtactggacactcagtataagtgtgaggtgaagcccatcagtaaatgagtaaatatattcctgccttagatatacttaccttatatgtaaaattagatgctgtagtggaaagtacagcctggggggcagagaggacctggagtatcccttgccagcgttgagcatctcccatcatggggtcccctacacctgctcaggtaccactgcagggccaggcagcggggcctcccccaagttcatactccgtctctgctgttctgtgtccagctcctttaggagaaccttcttctcatgtactgcttttttctcatgcgtgggcttactcaccagaatccctcttgctatcagagcactgacccagctggtgaggtttcccacccagcaaaccatttccttccactcctccccatctcaccagccagatgtaatccttccctttggtattttactgttgccagatgtgtccctttaaagcagttcttaatgggctagataggtctgcctgactcagtctcttggtcttgtcccacagtgcctagtatctcacaggcactctaaaggatatggaattgacctcatcctgcc

SEQ ID NO: 221269 - DNA, 526 bp, Homo sapiens
caacaaagaaatatccagttcaaacgtcggtagtgctgaattgagaaaccttgatgtaaatgaaggaatctcaagcatgattctcagatttcaaaacctggtggggtagctaatatatttggaggcagaaataatattcaaaagataagcattgtaccaaaataaatgaaataatgtaaattcttatattacaaggagatagaagttgagagattggaggaatggagggtaggaagtgggacagaaatacactgaaaacttgaaggagactaaatgacagcagatataaagggactagattttatttcatcagaagcttaaggagacatcagtatgctgtaactgttaaaagtgtagtcttaagctgctttaatacaagaatagtttccaaatccactgttgataatagttcaattgttcaagctcagtactggcaatagtaagttctcaataagtatttgtaggatgaataaattggccagactatacttaaagtattatattcagttctgtatacctcattaaa

SEQ ID NO: 221270 - DNA, 549 bp, Homo sapiens
aagtcaaaaagtccctttttgtaccaatttggattttttgtcacttgcaatcaaaaaattattgacaggtgtcttagttcatgttgtgctgctataacagaatgcctgagactgggtaatttataatgaacagaaattaatttggctcacagttctgaaggttgggaagtccaagattgaggggccagcatctggtgaagcccctgtgctgtatcatcccatggtgaaggcaaaagggcaagagaatttgggtgggggacagggaagggggccaaactcatcattttatgaggaacccactcccaagataactagcccgctcccatgataatgacattaatccattcatgagggctctgcctaatcacctcttaaaaggtcccacctctcaacgctgttgcactggggattgagtttccaacacatgaaccctaggaggcacattcaatacacagcaacaaggcatctccattttatattttattttaactatttttctgaaatgtaatccacatggcatatctaccttaaataaaagatgttaaatat

SEQ ID NO: 221271 - DNA, 297 bp, Homo sapiens
tgttccttaaatataaaaagaaaaaaatggaaaaaagcaagttaaacaaaaagtctagtcatcttcaacctcaaaatacagaggcatacagtcatacacacacctcaatagaagcttaatgacatcataatcaatatgtgtaatgattatcctggggcattaaaagaaatgttaaaaaaaaattgaattgtctccttctaaaaggtaaattttaggaatattttcatcttaattgtttttttaaaactttaaaagacaagcctcccctaggtgacaaagtgcaactctctcaaaaaa

SEQ ID NO: 221272 - DNA, 421 bp, Homo sapiens
tcgcacctgaggctctcggagcggcctcggggcgcgcccacctggaggttggaattacacagggtcgaaaaagctgagtcctggaggcgaggcgctgtagatgaaaagaagcaaagaattgataactaaaaatcatagtcaagaggaaacaagtattcttcgttgttggaaatgtagaaaatgtatagcaagctctggttgttttatggagtatcttgagaatcaagtgattaaggataaagatgattcagttgatgctcaaaatatttgtcatgtgtggcacatgaatgtagaagcccttccagaatggataagctgcctaatccaaaaagcccagtggacagttggaaaactgaattgtcctttctgtggggcccgtttagggggctttaattttgtcagcactccaaaatgttcctgt

SEQ ID NO: 221273 - DNA, 507 bp, Homo sapiens
ggtttcaatactagtgtcacaaaatgggaagaaaaaggactgggattatgcctccatttaaaaaattattcgatatttgattcggtagagacaaaggcaatgtgccatggaggaatgcagccacaccgaatgatgcaaccacaagccgaggaacaccagtagccactagaagcctgaagaggcaaggaacggattctccctggagcctaccaagggattatggccctgctgacaccttgcttttggccaagtgatactattatactttcaaactgcagacttccagaactgtgagataataaatttctgttgttttagaccatcaagtttgcagtaacttgttatagcagctacaagaagcgaatagaagacccttccagctttaaaattgtatgggtggcaaaacaaactgaagatgtaaaaatcaataggcatttagaataacttgctttttactaactaaaattctaaagtacaactgagcattaaaagttctgggcttcttga

SEQ ID NO: 221274 - DNA, 505 bp, Homo sapiens
cagagaggcagaacagaggattttcagaatagtgaaaatactctgtatgatattatgatggtggatacattgcattatatatttatcccaacccaaagtatgttcaacaccaagagtgaaccttgatgtaaactaaggactttgggtgaccataatgcatcaatgtaggtttatcaattgtaacaaacgtaccatactgttgggtaatgttgataataaggaagattatgtatgtgtgtatgtatgtatgtgtgacagcagggggtatatgggaaatctctgtaccttcctcgcaattttgctacaaaactaaaagtgctctaaaaaaataacacctaagaaaagtaacttgcacattttaaaataagcaatgagtcaaagaagaaatcatgagaaaaattagacaacactttcagaagagtctaaataagacccaattcaccaaaacttatgaaatgtagctatacagtgataaagagaaattatagctgccaatgcctgtagt

SEQ ID NO: 221275 - DNA, 356 bp, Homo sapiens
cctcattaaggggcagctgttttccttttgcctactagctagcgctgaggaggcggggctgggctggaggcccaaagtgcgcctgacctgaggttttggctcctaagtgccagggcctggaatggcggggacgggagtttggtgctctgcggaggcagccctgaaggcggggtgccggaagcaggccctcctctgggacgctgaggaaaccctaaaggttctttatttaaaaaaaaacgaaaaacaaaaactaagtatgtaaaatagtgcagctactttgggaagaaatttggcagttcttcagaatattggccactcccatacccaagagaaattaaaacgagtgactacacaaa

SEQ ID NO: 221276 - DNA, 543 bp, Homo sapiens
ttcacaatcaggtttagtagctgatctgaaataatgaaatgtaactaaaattcccttcagcaagtaagaggatttctgaggcagtaaagaagtcgattgaagaggtgcatctgctagcaattttttaggaatggggttcattttattctctagaccgagtgttgccatactttattttataaaggaacagattgtaaatattttaggatttgcatgccatgtggtctctgtcaaaactagctatagacagtattaaacaaatgagtctggctgtgttccagtaaaacttgataacctgaaatttgaattttacataatttttatgttatgaaatattcttttgatttgtttcagtcattaagaatgtaaaagccatttcttatttcttagcgcatattaagctggcgacaagctggatgaaggcttttttttttagacagggtcttgctctgttgcccaggctggagtgcagtggtgtgatcatggctcattgcagctttgacctcctgggctcaagtgattctcccatctcagcctcccaag

SEQ ID NO: 221277 - DNA, 574 bp, Homo sapiens
ttggtaggtttgttcagaatggtattggataatgtttactattaaaatattcaaagtaagatattttttaaaatttttgaaggcaaatgtcttaattggacaaagttacttcttagagtagcttatgacctatcaaagttatttaagtatttctataaattgtggaaatccctagtggaaagaattctggaattcatgagaagaaaccaggatttgaaacctggaaggtcatactgaataccaaaatagtttactaatctgtaaagatgtttaaaaaccatgaagttgtcctttttttatgacatactcttctgaaatattggcactggttcttaagattttcttgagaatgtgttactgagatttaagctaacatatacattatgtaattttaatattcgctactgaaataagttactttaattgtggtatatgaagctcagaatcttactaatatgctattattttctgagaagtgttaacaagtattactatgtcatcctaagtatctcttttcagaatgctgttgctttcacatgtattctaaggagctggttttcacataatggtatct

SEQ ID NO: 221278 - DNA, 448 bp, Homo sapiens
tcaacaatgacagctccttccgtcttctaacctctgggcagacactgactaaaggaagaaagcacagagaggatctcttgacggaatgcaaaagacttccctagatgtctgctatcaaatgtcttccttttaatcttgggagtagaaagggaacctggcttcctttctggacttaaccatgaaaccagcaccatcacatcacccctaaacagaaactaagacccttccacatgccccttgtcaccacaaccatcctctactgacccatttttacagattagacacctctttggacttcacttccctcacacatgcagtagggataatagataacagaattatccacctcataaggttactaggaggattaagtgaaacaacagatggaaaggtagctgacactggcacagtctcagtaaaatttacctagaatcgttatttccgtgtt

SEQ ID NO: 221279 - DNA, 634 bp, Homo sapiens
aacacacacagtgccagatattacacatgtccaggactttcagtataacactctgttcctcctcatcttgtccagatagaaattcttaagagcaaaagcactcatgttgctccacatctcatatggtaacaataactttctctggtatgcattttgccaaacctttgagaacatcttaagtttacattttataagaaaatattgagggtactttccccaataaatgtaaagtatattcaatgcttatagtagatggtcatttgatattattttcaagactgatattctgtatataaaatatgagttagacgcctgttaaacttaaagtgtttcatgaacaaattcattacctaatttcttcactatgccagaggactacatgttaaaagtccattttgcttttctgagagtactagagatgaatatgcaaccatggattaaggcaattcattgtcatggagccttgtgtgcacatgcagtttgtaaaatgatttacaaaattcaatagagcattgttcaaccaatgcctcttttttaattgggagataatttcattcattgcaaaaacaacctaggtcctgtggagacaaagacttcattggggggagcttgagaacagcaatcttagatctga

SEQ ID NO: 221280 - DNA, 346 bp, Homo sapiens
caggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaac

SEQ ID NO: 221281 - DNA, 510 bp, Homo sapiens
agttttcctgtacttggctaactcactccaaggccagcaataggcagagccctagtggggccttgataatactatctgaaaagccagagcccaaaggaatgagctccagagattctcccaacaccttccccacccagagcaagaataagaaaaacaagttcttcttatcagtttccccctttgaaattcttttcctataccattatcctttgatctcttctcacaactacttttgtaactatttctgcaagtttgcaaggattttgtaagttcctgttttccagctgtgcagtatggcaatggtcacaagacatgcctgagttgtaaaacctgtcactgttcgataaactgcctttgttctgcttctgtaagcttgcttacccaccttacaggttttgcacccttttcagatgtatatataaaagtcaagccctgtctttgtttggtgctcagcctttggatatgaatccgctgagttggtggccacctaataaaatcctcctgttccaa

SEQ ID NO: 221282 - DNA, 154 bp, Homo sapiens
gtccatgcattgtccttcctcctggtgactgggatgtgggctggatttcagcatccccaggccggagccttgcttcacctatatgtggctttgccagacagtgacagatccagagtaagctggcaaacatggcagctgtcaccaacagcagcag

SEQ ID NO: 221283 - DNA, 534 bp, Homo sapiens
ccgtgctgagactgctgaaactgataagaaggcttcctcggaacctggtgagaaaaatccatcaattctcccttttgtaataaaagtgtgttacatttgatagcatgtattttggggggtggatataaatgatggaaattgtcttttaaacatcatataaccattcagtgtgctgagacgtggcacagacatctccatgtgcaaatgtactttgcagctcatatgaccccctttataacacgaatcactgtcaagggaatgcctgactgtacaaaaactgcccacaattgagcatctatcactgaagatctctcagtagggctcctctctaggttatgccagatcactggtggtaatgtagaggaccacagaggtgtgggcagagcttatgtcccaaaatacaggaaacgatggggctggggagctggtgatgaaggacatatcgtctgtctgttgtgaatggatgaacttcagccctatcccttaatagcaaaatttcctaacaaaagcaaaattatctgtgttgcacaaaaa

SEQ ID NO: 221284 - DNA, 427 bp, Homo sapiens
tggaagggagtggagagggtgggggaagggtgttatgggcaaaagaaacagtgtttgcgaaggcagaggcaaagtgaacttgttctatttgagggaactgtaagtgctttataaataaacagaacatcgtgtcagaggtcaggacggggagtagatggaagtactacttcaggccagaaaactaggcaggggagcagatcatgcagacttttaaaaccacacttacacgttccagtctttcccaaaaggaatgagcttccattttcatatatatatatatatatatatatatatattttttttttttttaattatactttaagttctagggtacatgtgcacaacgtgcaggtttgttacatatgtatacatgtgccatgttggtgtgctgcacccattaactcatcatttacattaggtgtatctc

SEQ ID NO: 221285 - DNA, 653 bp, Homo sapiens
aaaacaacgtggaaactgactgactgtggggttgttgtgaggattaaatgagttaatgcatgtgtgtacctggcatataagtaggcacaaaatgagcatttgttgaatgaatgaatgatatcacattttttatctaggagtatattaatgatcatttaattttaatgtatcaacaagaccatactaggtggtttgtgcctgttagcatcatgtggtgatactttgttctccaaatttttcagcaaaagggcatcacatggtgacattccagaaagtaagacaaggggcaccaatcatctctcacaatgcagaataaataaggctttgagtagaagcaagcatgctgtttccagcaagtcttccagttttggctttgacatgtttctggcaacatatgataaaatggacattgtcaaaggggaggatgaagtatttgaaaaatgctataaaaaatcaaacaggagtggagaatgatctcggtgtagaggagatagaagtgctataagcaaagacactttggaactgaaaatctgaaatacattgaatgcatatgccttgtgaaggggacatcttatgtgtgaagccttaaactaaagcaatgaaaattattctataatcttcataaaaatttagataaatcagcagggaaagtt

SEQ ID NO: 221286 - DNA, 451 bp, Homo sapiens
ggccttgtggacagacatggagaattatgccagatgcctgttaactaccgggtagggctgctccaaagactctaatctctggtgttcagggtatgtggagaggacaattagaggcccgctgccctgagacttgcccaagaggggacggccaggcaggccacatgaagcccatgtgggctaccagctcagacacacccagccggggccggggcagactcccctaaggcttgagcctcagctttgctcaccgcccctccccacagcccccttccacgtcacccacacctggaggggcaggagcggagctggaagcagaaggccatcctgggagggggctccttcccagacagaaagcagcagagagcggggctgcgggaagtcggggaagccaacctttctttttgcacagattgagatcagaggtcttttaggcaatacggctattttccag

SEQ ID NO: 221287 - DNA, 257 bp, Homo sapiens
gaacacccctttcacagaaaattaggcaaacaggttggaatatttagaatagaaaacatttattataaagtcacaagaaatacctgtgtagacttgctgactggaagtatttggcttccgtaagacaaagaagagtcttagtcatctggttaaagttaaaaacgattgtgtcaccaggctgaaagcagacatgctgtggaagcagtaggctgaaattagaactgaatacaagagtttagagaaaattgaatttggag

SEQ ID NO: 221288 - DNA, 186 bp, Homo sapiens
ctgataccatcactagccacacacggggatttaaatttaaatttaagtcaactaaagttaaatccaaagctaggtgctgtggctcacgtcagtaatctcaacaatttgggaagccaaggcaggaaaatcacttgagcccaggagtttgagaccagcctgggcaacatattgaaaccctgactctga

SEQ ID NO: 221289 - DNA, 451 bp, Homo sapiens
gaagaaggcatttttacagaggagctgtggaaatggccctgctgaggcctggaggatgcagccacaggtgagagccttctggcggagaagatgaggcagtcaggctcagccaccagcccaaccaccgccaagcctccttcagatcccatgcctgggagagctcctgctcttcctcctagaaaccctgagctctggcagccggttgaggccccttcccggaggatctcctgagggccaatctaagtgtgtgggggtgggggcatgattgagagagacaaacctcattctcccatagcccaaggaaacctcccctagctctctccccagcacctgcagccaccaggagtgggtgattgcaaacagcgcagggcaagccagctttatatctcctgtaactttcactccccaccaccctcactttctgtgcctgacaacctaggcaaatcagagg

SEQ ID NO: 221290 - DNA, 640 bp, Homo sapiens
agaaacgaagtaaaactctccctatttgcagatgtcatgattgtttacttagaaaaacccagggaatcaacaataataacagcaaaaatctaaaactagcaaatgaattcagcaagacctcaagatacaaaatctataaagatatataagcataaaaatgtatatttctgtatactagcaggaaataattagaaaataacataatagccccaaataattttatttataacagcaacaaattataaactacttaggactaaatttaatgaaagatctctacatgaatgtaaaacctctacactgaaaactataaaataggccaggcacagtggctcaagcctgtaatcccagcactttgggaggccgacgcaggcagatcacgaggtcaggagatcaagaccatcctggctaacacagtgaaaccccatctctactaaaaatacaaaaaaattagccgggcatggtggcaggcacctgtagtctcagctactcgggaggctgaggcaggaggatgtcgtcaacccaggaggcagagcttgcagtgagctgagatcacgccactgcactccagcctgggcgacagagcaagactccgtctcaggaaaaaaaaaaaaaagaaaagaaaaaagaaaactataaa

SEQ ID NO: 221291 - DNA, 434 bp, Homo sapiens
cagcaatggaatacaaatgcactagtgatcccagccaagataccagaacctgaccaagacaatgttttgctgctgttatccagaattaacctttgattttgaggagtgactttaaagtttggcagaaaagaagcagagtcaaggaccaggaattgcttcagtaaagttgcaagataccaaatcaacctacaaaaatgaatagcatttctatatcatagaaatgaaacagctgaaacaagagagcaatcccatttacaatagctacaaaaaaaagggatcaatttcaccaaggagataaaaaatctctataaggtaaaaaccataaaacactgatgaaagaagttgaaaaggacacaaatggaatgtcatcccatgctcatgaagtggaagaattaatatgattaaaataaacatacttcccaaagcaatctaca

SEQ ID NO: 221292 - DNA, 379 bp, Homo sapiens
gccaaggtgggaggatcgcttgaggccaggagttcaataccagcctgggcagcatagtgagacctcataataaaaaataaacctagattaattatttctctttgaatacttctttagatatttgaggtttattgaatagaacaatgctttctaaattgttcctagctactacccagtgagctgtgctttgaacctcctcacctctttctcacccagagcagctttgtgtatataaaacaatatatgtatttggtatgtgcatgtgtatgcaagattttgttgacaggcttttccttagctttaaaaaaagtttgaaaataataaaaaaaatttaataaaacattcgtcttttgaataattgattaaagtattgaatatg

SEQ ID NO: 221293 - DNA, 437 bp, Homo sapiens
ttgcccctaagctacaaacctgtacagcatgttactcaactgaatactgtagacagttgtgacacaatggtaaggatttaggaatctaaacatagcaaagatacagtaaaaataaggtcttataatcttatgggaccactgtcatatatgtggtctgctgttaatggaaacatcattgtgtgatgtatgactgtaaatatacggacacatatgcattgcatgcacatacacagaaacatgcacatcatagttaatccctaaaaatcaactgattctatgatctcaaatctctatagtactataccaattatgctcttttgaaaaacaaacatagcttgcagacccgttcctacccctgttctttgctctcggttttctaatcattgtaggaaatgattaagctgagcaggggccatgggaattttattttgagggtc

SEQ ID NO: 221294 - DNA, 510 bp, Homo sapiens
gggagggaaggaaaatgagtcatcgtgaggcaaaaggtgtgcagtgacttctttgaacagaaagttttcttccatttaagaagaataacaatcaaaaatggacaaaagttattaaacccatttcctgggtttaaaaaaaaattgtggttgtagaaaatgaaagcataaaaaatcaagtccatgtaagcttgaaaagaaacctgcagtggtggatttgcacatcggccttaattggcccaattgaccttctctgctgtatttacaattgccttaaaattgtaagcagatgtttgaaaccccgtctttaataggtctccaacatctgtttcaccactgctgctgcccaccaaagcagttgtaattagggagcaccgaatgcatacatctttccttatggacccaatcgatcggatttctccccacggtattaaagtcgacccttattcttgcttttatttgaatacattttccaatatattttcttacacaggacagtatccagccaagtac

SEQ ID NO: 221295 - DNA, 406 bp, Homo sapiens
caaggtagtcaggctcctgtactccggatgtgtgtgaagcgcctgagggtcagctcaggcagtagtgattttgttctatggcctctttattttttttgagacggagtctcgctttgtcccccaggttggagcgcagtagtgcgatcttggctcactgcaacctccacctcccaggagaactcttaatcttaggggttgtagagagacaaagatccgtcttctgtaacttcttcatgctgaacaagggtgatagtattcctacctaactattgggtctgttgtattcaggatagaaaggagctcagtcagaaagccgtggttggcaagggtcacttataattttcgagttctgacaaaaggtgatatctggaagattaataagtgctcagtgtaagaaaacggtgag

SEQ ID NO: 221296 - DNA, 124 bp, Homo sapiens
catgtggcaagccccgtactcccttcacactccctctgtatcaccctctcaattagaatttccttgtggacaattctcttttctttgctagtatgatgtgtcattctttttttttttttttttt

SEQ ID NO: 221297 - DNA, 370 bp, Homo sapiens
ggaaaacagattttcaaataagggagtaaaacaaaagcaaacaaaaccttgtttgtttgttttttcataaaaggatatagtgtacaattgggtatgaattcagggcgtcacccatagaagaatcttatgcctatgaagtcatctctaattacagagtttgactaacaatactgcaattatgaaaccactccaccggctcatttaactatacataaaccctaaacacagatctttgctgagaaaggtatacctacaactacctgaaactattattcaaattctgaaaggtatttgaagggggacgggggtgcctattttatctcctaaagcactcactcactttaggaatgcagctgactgaataatctac

SEQ ID NO: 221298 - DNA, 647 bp, Homo sapiens
tccttttgtccatgtctgacattttgttttactttctgggatatttactcatttatgaaacaaccctgatgtggaatttgtttacatcttctatatttttaatttccaagaattcgttcttgatcttgggatgctcttttctatattcttgttttgtttgatggatccaggcagcaccttcctctctgagatatgagagggaattattactattattttgtaccctgcattttttccccttaatttcctttgcatctgtttttgttcctcttccgtatgtcagaaactttcctcatgtctgacaatcagtggctaccaattcaaatttgaattatatgcccatgtgcatgcacacgcgcacacacacacacgcacacacatgcacacacatgcacacgcatgcacacacgcacatgcacacacatacactcgcacccacgcatgcaccacacacgcacatgcatgcacagatgcacacacacctcacacacaagcacgcacacatgctcatgcacacacaagcacacacacacacgcacacacacacacagctgactggaaggtgtgttgagcaggcaagcctggttagctagtgaagcgccgtggtagggagaataatggcccccaaagatgtctatgttctaatg

SEQ ID NO: 221299 - DNA, 484 bp, Homo sapiens
cagtgcataaactgaagtttggatattttctcaaaagatgtgtcaaaatatacatttcaagtgcattaaccactttccttatgcttctgaagataaatgaattgcctgaacatctcaagatcttgaaagtttatagtgatggaagcataggttgcaagtgaatgtgttggccttgtaaattctactcctagaactgtagcataagcaccttcttaattaaagaatgacgcagtcataaatttatgtataccatgacgcgtggaagtatcaaaaatttcaactttccatatgtcaaaagaggagaaactattattttaatatagttgaacactagttggaaatagtagtcttttcactgtgttttgcccagacccagactggcagagttaacccagactggcagagttaactcaaagcacttgatcctttggaatactctttttctcccttttcttttctctgtctttccaccctatccccttcc

SEQ ID NO: 221300 - DNA, 416 bp, Homo sapiens
tcagatcctcactgtctgttgaatggagacatcaattcattccaatgtagacttctgcatagaacagctcacaaaatggcaactggcttccctcagagtgagtgagtgaaagagggtgcccaagatggaaaccacagtctttttgtaaccgtaccttagaagtgacattctatcacttttgccatgttatatttattacacttgtgtcactagttcaacccacactcaaggggagggaattataaaagagcatgaagatgaggaggtgggaatcactgaatgtcattttagaggctgcccaccacatccactactctatagttacatccaatcacttcaattaattagaatgaggaaagggagaagaaggaggttttgaaaaacaaaccactgatggattaaatgttttgtttgca

SEQ ID NO: 221301 - DNA, 280 bp, Homo sapiens
tgaaggtgagggtttcatcagctgaaatgctttgattagcatcttctgattttctttttaaacagttttctgtgtctctgtttggcttttttgggtatatctcttcattttctacttaaaacattccatagccccctcctgtgcagtagcttttatagatgatgttgggggaggagatgggtttggtatatcttgtttctccttcatttctgttggatcctttctgtttttcctcttgtttctttctttccctttactgcagtgtttccaaatgtaccta

SEQ ID NO: 221302 - DNA, 553 bp, Homo sapiens
aaaattgtctaaacgttataaaatgaacacacacctgtttttgtagtcacaaaactgaatcacaattattctaaaaacaaaacaactataatcaagtcttagttccaggaaggaggtaagggtcatctaatccacttctccatgcaagaatgctctttcttctagcgagactagcttgtttgcatgtctccagggacatctgttgtcattacaaggcagccccttccacagcaggccaatgatgaggattagaaacttctatctctcatgaagctaaaatagagccctgttccattggttctacttctgccctcttgatactaaagctgtccacgcagttttcttgtttttttttttttttttttttttttttttgagacggagtttcgctcttattgcctaggccagagtaagactccctctcaaaaaataaaattaaattaaattaaaagccaccaagttctccttccatggtaacccataaactcgttaatctttgaatgctttcattcatgagggcagatccttcaacgatccattcactcttaaaggc

SEQ ID NO: 221303 - DNA, 594 bp, Homo sapiens
ctatccagagttaaaagcatattctctatattgtcttctgataaattgaaaattttaaaaattttgtttaggtatttaagcagtctagtatttgttatatgaagatgtcttgggggatgttattttcccaacaccatttgtacatatgtgcacagtctttttctcacttatttgtaaagcaacctctcatttctaccagattcccatggaccgatttctgggctacttcttaacctgtttgtctataacctgtttgtccacattactactttatatctttggttttggtaatgccagtctcttctctttgtttatttgcggcaaacatatgctcattcactcttccacgtgaccattagaagaattagattgtcaatgtcctctaagtctaggtatttggttaaaaaaaaaaaaaaagaattaggttgtcaaattctgtaaaaagtactattgggattttcattgtgattgcattaagtttatatgttaatgtagggacatatatattagagatttattatgatactgagttttccaattcatgaacatggtttttatcttcatttgtttataggtctcttccccccccacccc

SEQ ID NO: 221304 - DNA, 603 bp, Homo sapiens
ctgacagggcattataaacttcacagaaacttctcaaaccaaatttaattgactttggaaagaaagtgattcctcacttttggagtgagaaagttaaaggttcatgtaatcaaaaagaggcctagaatccctgttctaagccaggctggtaggctatgggaccacttctttctcccctactataggactgcattcaaacctcaacatgaccttcttcctaggttgtctgagtaaaaggctgctctactctgagtccaaaagaacagtgtgaactgtttgggaaaaggacgtggaccctctcaaaagccctcaaccttaacctctcccacttaggatatgaactcctggtctcgaactcctggcctcaagtgatcctcctgcctcagcccccccaagttctgggattataggcatgagcaaccgcacccagccttgttaatatttctttttcagagtcctcagatccattatttccacgggcttttagttgcagcccgtgggagagaccgactgcttactctatcttacttagaactagaccccgagagattcagttttttttaactaaaaaaaaaatttattttgaaatgtcgccactccggg

SEQ ID NO: 221305 - DNA, 436 bp, Homo sapiens
ctgacagggcattataaacttcacagaaacttctcaaaccaaatttaattgactttggaaagaaagtgattcctcacttttggagtgagaaagttaaaggttcatgtaatcaaaaagaggcctagaatccctgttctaagccaggctggtaggctatgggaccacttctttctcccctactataggactgcattcaaacctcaacatgaccttcttcctaggttgtctgagtaaaaggctgctctactctgagtccaaaagaacagtgtgaactgtttgggaaaaggacgtggaccctctcaaaagccctcaaccttaacctctcccacttaggatatgaactcctggtctcatcatgtccaattctgaatatttaaaaagagagttaaaaaggaggaatggcttggcccagtggctcatgcctgtaatcacagca

SEQ ID NO: 221306 - DNA, 410 bp, Homo sapiens
gccataacagaaaagaagtcctgaagtgataaaaatgtaagcccttgttttggcattttaaaaaattggtctcaattccacaaacatgcttaagtttctttgcaaaaaactgccgagatcaatacaaattccttccaatgctggccaaagtagaagacctgtcacccaaattaattaacctttcctcaagatcaattggttttctgttgatttagcagtaatattgtagaacatttagctataatgtattttaatgtgatccctcaatgtcaacaggaaaaaattcgttgaaaaataaaatagcttaaataagttagtagacattttatacctttgtaggaaatattttgccttcaaaaattaaataccaattgtttatttgaattgtaataaagtgtgttttgcaacta

SEQ ID NO: 221307 - DNA, 522 bp, Homo sapiens
ttagtgaacactattttattctttcaaaattctgcatagtattttattgtattgttgtacaaacctttatttaccagccctccattgatagatattttggttgtgtctactttttattattaatcaaaatatttctgtggacatccttgtacatgaatattggtgacttttaaaaagtatatccaaatcttaaatttctggtaaggatgttgccaaaacagagggtgtgtatattttgaagaatctaataggtattttcagcttagtctccaggaaaattacaccaactcagttgacagtggagccttacattctacatggaactcatggagtccccccaaacagagaagggttagaataaaacacttgagtaaaaacaacttatctgctatcagttccttgggtcatgattgttattgatctctcatctatggggacagcttcgcttccttgggaacttgtctgccttgaggatctgtaatgatagaagggacattatactgaccctacacaaacaacaac

SEQ ID NO: 221308 - DNA, 587 bp, Homo sapiens
gaacgagttgtcagagggccaaattcagtggccaagccagaattcctaatctagtgctctttctactatacatcaagacatgggtagccaggagaattttgaacctgggaggcagaggttgcagtgagctgtggtcctactattacactccaacctgggtgacagatgagactctcaaaaacaaaaaaattttttttaagttttttaacgattgcatagaaaagaaaaaattatttctagagaattgcaaaatattgcttttgctcaaatttgattagacttaaagtctaattgattagacttaaataagcatttaagacttattttgtactcttaattttctgtacttaagtggagaaagggtgtttatctttcttcattcaaactgtttattctctctggaaggcttaatttttctgactttattggaacccgatgcagctttcaggcttatggttcagacattgcttcctttaggaagtgctttctttttttctgaactcattgcagtttttatcattgataatgcagtgtgccttatgtaattgtatgtgtaacatccttgagggcagtataaacatctggag

SEQ ID NO: 221309 - DNA, 515 bp, Homo sapiens
ggaggatagtagttgttgttaaggggtgctggtgtctagaggcctccgggatggggttttaggggtggcctgcctggatcaaggatcagcttggacgtgctcagcgaggatggggatgcccatttccctccatgcagctctgggctgggggcggcccatctgggttctcagttcctgccctctccctctactttttctgggaacatcagacaactttctgatcctgtgaaccagtttacttctctgtgaaatgaagacacctcagtcaccacttgactgtgtatccaattgcgcccatggcatatggacaagccctcactcagctaatgggtgggcactaggtgtgcagtggttaatttgttttattataaggagtgtccttgatacctttatctcatttctctattttttttcccttccccaaagtgttagaccatgcactttaatccaacattatttttatatgttttttattcttgtagagacaggatctctctctgttgcccaggctggcc

SEQ ID NO: 221310 - DNA, 364 bp, Homo sapiens
aggaaataataccatggtggttggtctgtttataaaggacataggcaaaaatttaaacagttttgaggaaggaaataataccatggtggttggggccaacctttcgtttcctcttctgttgaggagtcgcttgtcttacccagaagcctttcaaaactaagtggtggcaacgggcctccacagaacttccttttcttggtctctccagctgcccactcgtggttaagaactgtcatccttgtcacttggagtagaaaaagagtctcctgcttggaagagttcattccactccccgcacgtgcatcatagtgtttagcctagcaaatattactgaattgtaaactgaattaatcatcatagcctc

SEQ ID NO: 221311 - DNA, 375 bp, Homo sapiens
  misc_feature (369)..(369): n is a, c, g, or t
cttgaaatgcacattgctatgtgtaaaaagccagtgaaaagatcaatggttgcccggggctggaggagaaggaagtgatacataggtggatcacagggggatttttagggcaatgattctttctgtttaatactgtaattgtagataacatgactatgcttttagcaaaacccgtagaataacacaaagaatgaaccccaatagaaactgtagactttagttaatgctgatgcatcaatattggttcatcgcttgtaacaaatgtaccataccaacgcaagacattattttagggcagttttacacttacagaaaagttgagtaaaaagtacagaaagttcccatattctccctcttctctctcactcngtttcc

SEQ ID NO: 221312 - DNA, 448 bp, Homo sapiens
gggttgctggggttgtgtactgtgcctagagggcggggttcctgtacattcctacttcaccagataacctgcccccaacaccacttcagcttctgccagacagatggaactctccagcatgaaaatctgcgcagccattccaacaagcagggctctgcctgaggttgtccgaaggatgccgaggaaaaggatatcaggactggaatggctcttacagcaagatccaggtttttcattagtcaatacagtgaaggctggcatgatcatcagcttcccatccaataatatctactcatcagtgtgctgttgtcaatcagagattttcaagtatgagttctccaactcaaagaaaagtagctggatccaggaagaaaggcatttggggaagaacaacgttctttacagtgctcatgatgtgtctccagagaaagttacttcagcactaaaa

SEQ ID NO: 221313 - DNA, 823 bp, Homo sapiens
ccatagactgaatttccttcatagtacatgatttttcctaaatataggaaagatcgaaggggtctctggtttatttgcaccatgtttatttaggcatctattaaagcaatgcttgtggtgctacttgcttagtagaaaagctaattataaaacttaatgcaaaaattcagagtactacctttctctttcctctttcctattgtgaacttgcctcccatttactgtctgtcactttctttgagataaataaaaaagacaataattttttctagaaagaagcagtttatcgatctcttctaatatttgcctttcagttttctgttttcaaactgccatttcagttggtgtcatttttctttttgtacttatgcccttctggttgcatttttttttttaaagccaagtaattgccattaataagcttttttaaataaaatgaactaatcttcctttgaaaactttaaaatagtgataatattcttttcaccaccgttgatgctcatcagaataaccaggggaatcttaaaaactgtatgtgtacacatgatattggatttttgtttttttgagaggcctcataggcaattttaatgcagaggcaagttgagaatcagttggttatacttttcacatagaagatgatatgtttcaaagagctctgttctgttattgaaaataggccactggctttaaatataagccctggattatttattagtaacactttaagagaaatccacctgtgagctttaacatttgctatattttctgtaggtctggatctgaaaatttattaataaaagaattaaaaaaataaaaatcc

SEQ ID NO: 221314 - DNA, 648 bp, Homo sapiens
taaaggtaccagtcaatatggatgggatggatttagggcgtgttttatggattcatagctgctgtttccctggcactgcacgaggagcacgcattgctgtctggctcggacccaggattcgaaaggaaagcttgttgctggaaggcccaggagctcaaaaggggggcgtcgccagaacctgcgggaacgaagctgtcagtgccatcactggcgaggagtggagagcagggagcttcattgtctggtgttaaaacaacatgtcctgttgtcactcgtacattctacagacagaagaatgaggtgtcaacagaatcactttctcatgtatttacagaaatctcttttcatcagaggtgcctccctggccctgggttccgagttgtgtgggaaattgtcccacaccttgcccctttctcaaatcataaactttcagctattcaaaaaaaaaaaaagtggtctgttttcttgcacttaaaggaatgagacaaataaaaggagggaggagtcacgtctgtactctgagggaattggctgcaaggtgtaattttggatttcacaaatggaaaaatagcagcatagatttttcttatattattttactgttcatagtggtaaaaaatcaattaaagagaaattatctttcaaaaa

SEQ ID NO: 221315 - DNA, 708 bp, Homo sapiens
gtggcatttataagaaagatggtctataaacattactattgctctggctttacctttaggttggtgtgatcctgaaggaaggaagtgcgtgtgtaggaaaaggagttccaggggggttatgttaatttacaatcatatcaaaataacatgactcttcctcctctccctgtagctgtatctaggaagtaggagtttaacatttccccattcaacctcttaccagaaaactactcctaaataaacatcactaattttgctgccacatcactaagtcttgacagaattacccaaatcatatgtgctaggaaaatcaattgtcaacagattttgagcgtccatgccgttctaggcatcatatttgtatatgaagagaaaagaaatatattagctcccaaagggatttctatctttatacccacagagaaaatagggatgggtagacttggacttggtgtaaaaaatgtacaggtaagtaatacccaaagtcaaaaggaattcaacaattttgctaatatcaaacagtacacagttggcaaatttgggtacgtgtgtacacagatcgtacaaagtattttaagcaacatactaaaattttacttccaagttgtcgtctgcagggtttttccatttcttcttatttatctacttttttgttattgttgtttgtttttttgagacagagtcttgctctgtcgcccaggctggagt

SEQ ID NO: 221316 - DNA, 609 bp, Homo sapiens
cacacacacacacacacacacacacatatccttactcctccccagagacctcattgttgccatcacctgttcagagcatccaggttccagccatggtcttggttggacctcttcttcagtgagctgtctgggagaggctggtgtctggcaaggttagggatgtttgatgtgaggatgagggtctattactcaataactctcccacaatatcagttccactttgctgaggtgaaagccctttcatcttctgaacctttgctctaggtgagttgaagattcctctggtcaattggaggcccctaaaagggagatcttattaaacaaggcagaccactttgggttttgtccttatctgcagataaccatgccatatacagggccttaagcactctttctgtgtgtaacccctcacactttcttcccaactcctaattgtctcagcagctcaggtcagtagcccagtgctcttgttatgctagcctatacaagcagcacacatcagtatgttttggtcttacacactattacatttttatccattgtgcttttaaaagagcccttgttaatttatatcacatttgcatcatttttacatctgggaagcaatat

SEQ ID NO: 221317 - DNA, 495 bp, Homo sapiens
gatttgcctgcctcagcctcccgaaatgctgggataacaggcgtgagctactgcgactggcctctgatggatatttctaagactggaatctaggttgtaaagtatacacgttaagctttagtagatagtgcaaggagtttttctaagttgctgtaccagcagcatatgggaattctgatggttccacatccttatcaccacaaagtattttacgttttcttcttaaccatttaggcacatgtttactttatcacaatatggttttaatgaacttttctctgatttcttagggtttttagttatgtgtattttttagtctaattttctatgtagtctactagtctatttagtcttattgtctagtctaacagtctctgttaactcagttatctgaaattcttatggagtatgctctaatattgcttgttgaatctcccaattctcagccaaggtagattgtgtcctaccttgtgttctttgtgttgtaaacttgga

SEQ ID NO: 221318 - DNA, 546 bp, Homo sapiens
tgaaaagtgaatatttgaagatcaaaacttaaaacacattattcttcttaagtgactcagattatggcagagttcttttaaatagcactgtctcctcatacacaaatactatgttgtgaaaattagataagcctgagtgaaaagcaaatttttaaaaattttttcccagagtcttttctttctggcttgactatggctaattttgctaatacagggcaaacaactaaaaatttaaggtttattcatgtggcatctttgaaataaggaaattctggattagatcccaaagcagtcatagcattgatagaagggagaaggcatctgtgcagataatagctaaatgtcttttcagctccaaatttcttttattttattgtttatgctacatagaccatttgatattctcatgaaattatatgcttcattatggaggaaatctcagagcaccttactataaatttgtctcagaatcttagtgcactcacttgaacttatttggtctactaacataccaaaagacttaaaagaaaatggtttcctgaaaaa

SEQ ID NO: 221319 - DNA, 465 bp, Homo sapiens
aaaactaaaaaaataaatgaaacccacagcaggttctttggggaaaaattaataaaattaataaacctctaattagatttatgcagaaaaaaagagcgaagacacaaattcccgcatcaggaatgaaagtgacacatcactacagatcctacagactttaagaggataataagaaaatattatgaacaactttattttgactactttgataacttaaataattctttgttacagtgttacttcgtattagagagaatgtttttattctcaggcgatagatgcaaaaatatttaaagtgcagctcactttcaaacggttcagccaaatgtcgatgatttttgaatctaagtggtgagtatacaaatgttcctcgtattcatcttttatcttttttgtatatttgaaaatttttggaatacaaagttggaaaaaataaatcatgcccaaaagattgccagtagagca

SEQ ID NO: 221320 - DNA, 353 bp, Homo sapiens
ccaatgcatcaaaaggatttatttatagatcataaaattctcggcttaaagtgggacattttgcttctctattcttcccactaattatgaattgtcactgacttttgcagttacctacttaaatagcattgattcttatacagtacatttcctatagcgtgtttatatgtattcagtataaaaaactgcacatgaaaacacagagattaaagtaaattttgattgtatagaaggatgtaaaattatgtggatgtgttctttttataagaaaataatcatcagaagtagatatcaagtatactctatggtggaatttctattctttttgtttcttttattcgtaatattgggtg

SEQ ID NO: 221321 - DNA, 488 bp, Homo sapiens
tgagatggggtcttgctctattgccaggctggagtgtagtggcacgatctcagctcactgcaacctccacctcccgggttcaagcgatttccctgccttagcgtcctgagtagctgggacttcaggggtgcgtcaccacgcccggctaattgtttgtatttagtagagacgaggtttcaccattttggccaggatggtctcgatctcctgaactcatgatccacctgccttggcctgccaaagtgctgacattacaggcatgagccactgggcccggcctcaggtcttgaatgttgactttgtgcttcactttctgcagttcctactttcctacttagctggaacttttccccctagtgtcttaaagttatctacatatttcattcaatttacattcccaccagccaatacgatgttgtattttggacagccactttgcctttggaactgatggccagtctccagtgggttttcatttttatttttct

SEQ ID NO: 221322 - DNA, 421 bp, Homo sapiens
catttgaactggtctttggaggacattttgtgcagaaagaacttcgccaaggctcaggggcaagtcaagtttggggaaatgccagcagtgcatgtaggaaaaagctgagcataagatgcaagaagcagggtgaattttttaagagtcacatcatgaaggtccttgaatgtcagactaagaattattacccttagaacaattattcttaagtgaaaggtgttggaggaaggaaaggaggagagtatgtaaaatttaaggaaaaatgaaagtatcaacattatgtaaccacttaaaagaacaatatggaggttgctacaatcaaaatgtactccatctttaaaaagttacccatacagatttcagataatcatgtttgtcagtttttattgacatgagtaaaatctgttatagcaccaaaaaa

SEQ ID NO: 221323 - DNA, 640 bp, Homo sapiens
atgctggtagtttctacctggaagagcagacggcttcttattgggtttttaaatgtttcttgtaaatttaggtgttaggagtttttcttcatcattctaggagcagaatttgctctgagggaggtcaggattaattggtatggaaagaggccactaacattgaaagttaaatatttttatttagctttgacttaatggatagggatagggtttcagactagaatttaactcaaatggaaggaaaaacactgtgtaagttagggtaagggaaagaaagatcctgtagatatgattcatcaattttaggttatcttttgggtggaatgaaaaactttccaggtgaccctgtcagaaggtgatcgtgaattgaaaataaaatttatcctgtcccacccccagatttccaggtttactttggctggtttgtcacaaagctccctgccctttagataaatcacctttcgattggaatattccctggccaattagaaccaaatgcaaaccaggcttgagcaaacaactagtgtagttaaattttttttaagtgtgctttgcttgtatacagaagtctccttagtgatgtcttgtggtcttgggtttcttgtttgaagttcattattaaagtcatggtagaaacact

SEQ ID NO: 221324 - DNA, 546 bp, Homo sapiens
tatttttaaggctggatcgtattctattgtgtatatgtatcacattttctttatgtactcatctgttgatttcatatcttggctattgtaaataatgctgtaatgaacatgggagtgtggatatctcttcaacatactgatttcatttcctttggatagatacacagtagtgggactgctggatcatatagtagttctatttttaatagtttgggaagcctccatactgttttgcataatggctgtactaatttacattccaaatggtaaaaagaataaaatgggaggaagaatcatgttttcaacaagtggtgctggaacaattggatatccacatgcaaaagaataaattcagaccactacctcataccatatacaaaaattaactcaaaatggatcaaagatctatatgtaatagctaaaactataaaactcttagaaggaaacataggtataaattttatggcttttggttaggcaacagtttcttaaatttgccatcaaagaaattaaccaaagaaaaaataggcaaattgtatgtcatca

SEQ ID NO: 221325 - DNA, 395 bp, Homo sapiens
acttttttttttgtcctaacaaagctcacagtgtagtcgggaaaataatttataaaaagtaattagaacatagcgtgatggatgctgtaatggacccttgttgtatttcctatttcaaggcaccaggcttctcaagcatgtgcagatggcaccatgattcattaacttcctttgtctggagtgcccctttgattaacttggtgctaacacatcagataatagtggcaattatagtggaagattttatttctagttcattaagctggaagtgttttgtttctctttcatacgtaaaccatgttttgtttcctatctaattatccatgttgatgttttaaagtgggcatgataatagattttattttgtttgcagttgtgtcataagggtaattcct

SEQ ID NO: 221326 - DNA, 554 bp, Homo sapiens
tgtgataatgaagtaggctctcatttgtcaaaaatagctacacgtgcacatcgtaaaagaagcaaactagggttgcttgaaaattctgttccctcaggatgtgtgtattgacaagctcagacaggtctcacacgccccacatgccaccccagcccgcgtaccccacatcacttagcacccattgctgcccactgagctgcctcagtcctgcagtccccgtgtttggatggcaggatcccagggcagtgagtttcagggcataagcagacgttgccacgttgccttcaatcctactggacaagcatcggtgctggcctcccccatgtcctaacagctacagccagtttaatctttgccattctggcagatttaaaaaaatgataactggtagttttaatatgcatggatctaattcatcgggtatatctaagttgtatttccgtgaaacatctgttcatatcccttgccgattttctataagattgtcatcatttttttgttaattgtagatctttatttattaaggaaattatcccattatgatagaacgtgtc

SEQ ID NO: 221327 - DNA, 567 bp, Homo sapiens
gttgttatcttttaggagaagatgcgttgccatgctgagaacatactattcctattcttgttcattcagttattttattaaacacaggtgtagcaaagtattatttcaggtgccaaaggttaaactgcaagttattgttcctgccttctagagcttacaatctgattgggaactgaacagtactggggcaaaacagctcagtaaagggggagagcggtttcgccgggataatgagtggcacagtcggccctacaggagggagaaacggaaaaccgctggtctgataagggcaatgacagcttcaaggcacgtcacctgctgggctgagcctggagtactgtcagtgtttacattaagggagagggaagggagaaccttctagaaaagaaaattaggctttgactagggatcatggattagaataaccccatttaagaagagacagtggtttgacgagaaaaccacgatttatttgagatcatttgaagggatagtgacagacacagacgcagggctcttccacgagtccctgatgtttgacggcagcagctttgtgctggggacaag

SEQ ID NO: 221328 - DNA, 630 bp, Homo sapiens
cccatgagctcaggcaccctaggatcccctgttagactattaggctgtccagcatggtctcctttcccttcttggtggtggtcttttccctttccagaatagaacagtgattcttaaaataagttagagcaggccgggcgcggtggctcatgcctgtaatcccagcactttgggaggccgaggtgggtggatcacgaggtcaggagttcaagaccagcctggccaagatgatgaaaccccgtctctattaaaaatacaaaaattagctgggcgtggtggcaggcacctgtaatcccagcttcctgggaggctgaggcaggagaatcacttgaacccggggggcagaggttgcagtgagccgagatcacgccactgaactccagcctgggcaacagagtgagactctgtctcaaaaaaaaaaaaaaaacaaaaacaaaaaagcaagatcatccactacacatgaacatgaatcacagtattatttgcacaggaagggtgtaacaaaatatgaatgtatcaaaaaatagaaataaagtctttgcagaaaaagtctgtttttctctgaagtgtgttgagattatctgacaactctaagattgtacttaaattgtcaataaagcatcaaaagag

SEQ ID NO: 221329 - DNA, 482 bp, Homo sapiens
tacagtccccaatgtgaaagggtgcctgaaattcccattaataaagtcatctcttgggttaagtctgcattcgtcactcaatcacagcacaccacttttagctttgtcatatttcctacttttacttatttccttaattcatcttccctctttaatttaaacaaatgtatttaaaatgcaaattgtatgtcatgactataaacagaaaccaattgcactttccataagtagaaagtaaccatgaaaataaatacaacaatcacaaactgtagtggcaaaaggatggtggatggaactgtatttcaacatattctttactttgtaatactaggtattttattgtaagaatttacaagcattattttgatatagggttcatagactttaccagatgtccaaaggagcccatagcattttccttaagaacaccagagtagagataccaagacattgactgagaagcttgagatctttctctgtta

SEQ ID NO: 221330 - DNA, 283 bp, Homo sapiens
tgtccaaaacagaaaaacatccctgcctcatcaagtttttaatccaggaaaagacaggcattaaagccaaaaagtgagcaaccagtgtgaaggtgaaatgtgctgtggaagaaaaaagttaaagcaggaacaggcgtctgattgtaactttttgataaggtgctgtgggtatatcatggaaaagcgttcctctacccatcagtatttcagtctggaatctgcagttgtctatttttatacttttcttctcttttcttctttctttctttctttcttttttttt

SEQ ID NO: 221331 - DNA, 627 bp, Homo sapiens
tcaaaaatgttatgttggcttattggttatttcacccttaaagttatacagaaaatccgaaagtacctaataatagcttacaaacaattatgaatttattatttgcctatcaaatccacgattgataattcaaatattcaaaattatgattaaaaaaagatttttagtgaataaaactactaaatgtataaaacaaatagcatgtaaaatgcaaaacataagtgatgtcaaatgtataaatgctactggtatgcaaaaagtttcctatgttttcaaatgcacacacgagaaaattaaaatattctttaacaggttacttggcatttttaaaaagctccatcaactatatatccattttatgacagaatgaagagagaaatacatttttttcagtacttactggtagaactcttatatatattttaccatggtaagaccttttgtttgtttgtttgtttttgagacagggtctcactctgttgcccagactggagtgcagtggtatgatcacagctcactgcaaactctgcctcccaggttcaagcgattctcctgcctcagcctcccaagtagctgggattacaggcatgcatcaccacgaacggctaatttttgtattttgggtag

SEQ ID NO: 221332 - DNA, 391 bp, Homo sapiens
cctgaggtcacacagcatactaaactgatgctgtagactaacatggaataacaatcttttattaagtggaaaaaaacaggttatggaacaataggcaaagtggtttgatttacgtagaatagactcacgtagaaaaaaggctggtctaggtgcagtggttcatgcctgtaatcccaacactttaagaagctgagtggagaggttgcttgagaccaggagttcaagatgagcctaggcaacatagcgagaccctgtctctgcaaaatttctttttaaattagcacgcccaataatagtcctagctagttgggaggctgaggcactgtgatcgtgccactgcattccagtctgggtgacagagcgagatcctgtctcaacaacaacaacaaca

SEQ ID NO: 221333 - DNA, 506 bp, Homo sapiens
ggtggacactcgggctgggccaggaagggaggtgcgcctggtgctagcaggagcgcactgagagcgggctcaggagtccctggctggaaggacccttcccacagttgtctgctgagagccctgcatctaacatgaaggcaccgaggcctggcaattgcaggcagagctattctcagcccgagagcctcctgattctacatctcgagccactgccatcactccccatgtgggtgctgaagaagaacagccacagcactacgggagtgctccaggcctttgagacgcaggactcaaactgccaccgactggctgtcacttatgccatcagtaaaatggggtatcagtccctgcctcatggagccctgggagatgacgtacaggcagaggctggagtctgagagcactgagcagtgctggccaccgcccgactccttgactcatgccactcctttactaattctttgtgagccccactttaagtaaatgtctggagaggaccaattact

SEQ ID NO: 221334 - DNA, 468 bp, Homo sapiens
cagccttttttcattttttaaaaagcttgaatcgaataattttaggccagtggttctcaatgcacagatatactcacaaagttttatagaaatagagaagtctaagccctactccagacttactgaatctcttttcttgatattcttggtatgctatttacatgctaaatctaaggattattgtgtgttgtagctcaataatttttcctctataaaacatattcatctagttttataaagtggatatgacattcactaatttcttaaaaagtagacttaatcattaccctaggagatatttgtttacatttttttcaagtgaatggctttattatctttgttttgcatgccaccaatcaaacaaccaactttccttgttgcattgttcttgcattatttttattatacattctcatcagtccttttacacttgaaaattaataaaataattatagctctgtcaatcat

SEQ ID NO: 221335 - DNA, 679 bp, Homo sapiens
cgcgcagcggagagaaaagagagagcgaagagagggaaaagaggagaggaggggagtgaagagtagaggggaggtgagagagagaaagggagaggcggagagagaaggagggagggtagtggggagggaagaggggaagagagagagaggggaggggagacggggcaatagtagggcagagagaaagggaaggaaggagaggagcagaggagaagagggagagaggagggagagaaaagagatgaaaagagaaggggagagagaggagggagggagggaatgaaggatgacggaggaagagaaagggagggaagaggaggaaggaggaatggggaaggagaaaggaagagggaggaagagaaaggggaggcaggagaaggggagaggatggagaaaggagaggggagaggggagggagggagaatgaggggggaccgctaccactctccctcttcctatcctctacacaatagctagaatgattccttaaaattcaaagagcatgtcaatccattgcttacaattctcattggcaaattattaatacaagccaaagtcccggccaggcgcagtggttcatgcctgtaatcctagcattttgggaggctgcggtaggaggattgcttgaggctgggagtttgagaccagcctgggtaacatagtgagacctcatttctac

SEQ ID NO: 221336 - DNA, 481 bp, Homo sapiens
gggtatacaagtgaaggggtgaggtttactatgaagacctcacatttcagcagatatctctgaaggagggacgcagtggttcaagtatatatttggtagaagagcatcccagcgagcgaggtcagcaagtgcaaaggcctgaggtaggaacatgcttggtacggcctgccatcatgtcttgccagacttattaagagatccctaacaggcctctctactttcacacttccccctcctttctcccactctccctcttcctatcctctacacaatagctagaatgattccttaaaattcaaagagcatgtcaatccattgcttacaattctcattggcaaattattaatacaagccaaagtcccggccaggcgcagtggttcatgcctgtaatcctagcattttgggaggctgcggtaggaggattgcttgaggctgggagtttgagaccagcctgggtaacatagtgagacctcatttctac

SEQ ID NO: 221337 - DNA, 497 bp, Homo sapiens
aaaggctgcaggataaaagtatttgaaggatgtaatttgggaggttaaaagccctggggggatggagctgggagtcctgattcactctgaggccttgagagccacagggagctgtgcaggtgtctctcctgggctgagaggtgttcccatcatctcctgggctgagaggtgttcccatcagaggcatcgaccaggcctctgccacaagtggaggtgggagcaggtttctggtgtgatctggaaaacactgaaagactcagaagaccccaggttgcttcctcagaccaccacctgactcttcctccttagagttcagaagggatttgatcagtgtttcctaaccgttccagggaggaaaggcccttctaatgtcaaattttgagtgtctctgtgtaacaatagttatattttaaaaatcttttgctgaacaaaatgtagtgggctatataatgcatttttattatacataataaaatatatacacacttgaaaatata

SEQ ID NO: 221338 - DNA, 553 bp, Homo sapiens
gagagtatttcagtaactttataaattaagtaagtttttgctggccaatttggaaaactaaacaactattttaaaagaggaaaacgcacaccggaatcaacaagtaaaaattgaatgtcatttttattactatttttacttataagaattatagaaatatttggttatttcaattccctatgtgtataactcatcacaatttgataaggagataggtttaagtgtatgtgtatataaaaagagactgaaaggaaaaagataagtagttatctctgattggttgttgggattagctatattttccaaatactctagaatgaatatgtattacttttctattattaattgggttagggattaaaaaaacattagacctgtatgttaaagttgaaccagcatcgtcaggaaggatacaaaaatcacctgccaaacgatgtccatttcaatttactttatgtcctttctaggaccactgtgagcagttgtaggtacctgtgagagtgctcaatgtaaaaaaaaatttctgttaccctaaattgggttaatgataagt

SEQ ID NO: 221339 - DNA, 109 bp, Homo sapiens
atttaaatgcatgaattctatggtatgtgaattatatatcaataaaattattgtagaaaattcaacggcattctacaaaatgtctgaccagtattctttaaaactcaaa

SEQ ID NO: 221340 - DNA, 396 bp, Homo sapiens
gtttttaataatcttagcctcaatattgttctcatactggtaagtgacaccatcagttgggacacacagtgaactcagagctgtcaaacataaattcttataaaggtgcagacaggtttgtacatgtagaaatgcatcttggtagccttgatcatctaggatatgctgttacaaggagtgattcatggaaagatcttaatcacagcttgaaagacagttttggccctatagaaaaccacataggatcatataggttaaaatgatggattgaggctgggcgtggtagctcctgtaatcacagcactttgggaggccaaagcaggtggatcacttgaagtcaggagttcaagactagcctggccaacatggtgaaaccccatctgtactataaataca

SEQ ID NO: 221341 - DNA, 204 bp, Homo sapiens
agtccacacgctgtgtgattccattcataccaacgtccagactaggccagtccgtacagacaggatgcggacgtggaagacagcgacactgatggtcctgaccctgtgcgggtttaggctaatgtgtgtttgtgtcttagtttttaaccaaaaagtttaaaaagttaaaaaaaattaaaatagaaaaaaacgtatagaataaat

SEQ ID NO: 221342 - DNA, 362 bp, Homo sapiens
ccgtcgtcgtcgtaggagacgacagctctgtgccggttattctagaacaagccgtcgtcgtcgtaggagacgacagctctgtgccggttattctagaagaagccgtcgtcgtcgtaggagacgacagctatgtgccggttattctagaacaagccgtcgtcgtcgtaggagacgacagctctgtgccggttattccacctgaagaccttgcagtgggacaggatgcggacgtggaagacagcgacactgatggtcctgaccctgtgcgggtttaggctaatgtgtgtttgtgtcttagtttttaaccaaaaagtttaaaaagttaaaaaaaattaaaatagaaaaaaacgtatagaataaat

SEQ ID NO: 221343 - DNA, 296 bp, Homo sapiens
gctggggtgccaattccaaatggattcggctatgggccaatgtccattctaaactctgccctcaaaaggatcaactggtttggatgcttgcagatggtcaggagaatcctttctgtgcaaatctgggggtcctggtaatgttcactcggtgcaccatctgggaggctggaatttgtcttaattccagaattaacacaaaaatggcaaaaccccaccatgttaaacgttcctcccttcagatgcggtcttagtcacttttctgatgcttctagcagaatacctgaaactgagtaatt

SEQ ID NO: 221344 - DNA, 412 bp, Homo sapiens
agaggtgaccgatttgacgcgtctcctgctcctttcatcgataagatttacaagccacacaaattagaaaggaagaaataaaaccagatgtatttgcatatgacatgatcttgtatgtaggaaattctaaggaatccacaaaaccgtcagaacaagtaaacaaattcagcaaagttgcaggtgtaagagtgatataaaaaaaattggcctggtgcagtggctcatgcctataatcccagcactttgggaggcctaggtgagcagatcatgaggtcaggagttcgagactaacctgaccaacatggtgaaaacccatctctactaaaaatacaaaaattagctgggggttgcggcacgcacctgtaatcacagctgttcgggagactgaggcaagagaattgcttgaacccag

SEQ ID NO: 221345 - DNA, 614 bp, Homo sapiens
aagcggtcgatctagaggacccccgtacatgtcgaggctagtgtgtgttgagagatggggtttcgccatgttggccaggctggtctcgaactcctgacctcaagtgatctattaggcattttagaatgtgagaaatacttgggttaccttaaataatagtagttcattgggaggatatgtagaaataagagaagactgtttacagagctacatcttgtagaagaaaacaggaatcaccaaacactaggctttgctgaagaacaattcaccagctcttacagaaacctgaatatatttcaggactcagaaggtggctgagaatagtacagctctagcagtaggcttgccttgttttaattcctcaagcagcaggtatcctgtaattcctaatttagttctttgctgttatagtagtaggtctcaacccagggtgattttgcctctgaggagacattttgtagtgtctagagatattttgattgtgaggactaggggaagggttgctactggcatctagtggatggaggtcggggctgctgctgctcttgctaaacaggctgctgctcctccatgcacgggacagcccacccataacaaagactctatgtggttca

SEQ ID NO: 221346 - DNA, 496 bp, Homo sapiens
tcagcctcccaagtagctgggactacaggcgcccacccccacgtccggcttattttttgtatttttagtagagacaaggtttcaccgtgttagccaggatggtcttgatctcctgacctcatgatccacctgactcagcctcctgaagtgctgggattacaggcgtgagctactgcgccagcccctggctttttttttaagtagagatggggtttcagtgttgcccgagctgctcttgaactcctgagctcagacaatctgcctgcctcagcctcccaaagtgctagggttacaggcgtgacccaccactccaggcccacagcttgacttttaaccaccacctgaacttccagccccttactctactgagacatcctccacgctaaaatgaagttggctccttactttatgcccttcctttgctcatagctcatgggaagctggtttctccctgcctgccaccacctgccccaagtagttccatcgccagttcttt

SEQ ID NO: 221347 - DNA, 337 bp, Homo sapiens
cttgcagttgacttcaatgctagctaggctactttctccaagcagtgagaaagtcctaaagagtcttgcttcattttattccaacttctggagtttttaaaccagcattgtttgtgttcttccatatgtagaaactatctctaaacctatcctctcattttccagtttagaaggtgctttcagatatttaggatcttattagttactttcaaattagtattccaatcaaaacgagttgaaataaaaacctgtctgtcctttaacactttgattatagtttatgtacttctatttacatgggtaaaatgtatagtcactaggaataacatgtcaacac

SEQ ID NO: 221348 - DNA, 475 bp, Homo sapiens
gaagaactggcagaggtgttcaaagacaccagcgtttttttcttctccccccatataggaagcaatatagagatttatttctgaactgatacgaattatgccactaatcttaacacattgaaatggatacagtcagttttgatcttagataaaattctttctattaagcgatttcaagaaaacagcaccaacctttgaaaaattcatgatctaaagaaaagtaaattataagaataacttatgaaatataaaatacaaataatgtttaatcccttaaccagctaatctttaacaagaaaacgggtgaaactgttcagaattattaagagctaatacacaaatccagaaagtcttaaaactcctaagcaggagaaattttttaaaactccacatctacttacatcattgtgaaaattcagaacaccaaagaaaaattggtcttaaacatcaaaaagactgacagcagatttctcag

SEQ ID NO: 221349 - DNA, 210 bp, Homo sapiens
tgacttccgggatgccatacttgtctggctttcctgccatctcactagccacatacattgtactccactgtcttcctcaatctctttttctagttccttctcatccccccaacttctaaacattgtagtcctgagagttcttccttgggctacttctgttttgcatctacactatttgcatgactatctcatccctgtattctctacatt

SEQ ID NO: 221350 - DNA, 293 bp, Homo sapiens
gtggaaagggggacggtccctgttccagctgtcctgaagggagagggaccctaggcaccaagacggagctcttcatgcatcttcttgtggaagcgctttccagataacttccggataattgtgttcacatgttcattgcttcacttggtagggctttatggcgctcccaatgtcagccagctgcggtgccaggagctagggtgatgtcaggcccctgctgtcacggagcacacagcccaggtgtggagacagaccccaaggtgaaaaaaaagtaagcaagagtatttcagata

SEQ ID NO: 221351 - DNA, 432 bp, Homo sapiens
tcacacaacattttcaacttcattcccttggccagaatgtactctcatgaacctatctagctgcaaggaaggctggaaaagaaagtcttcattcagctggccatatgcccagctaaacttctgttactatggaagacaagttgaaccatctagaaacaaacaagaataaccgaatgagaaaaacaaaagctatttatttgagcttgctgtagcaagggagtcagccagtcatcacttgcatcttggcagagaattaaaagcaagcaaaggaatgaaaggttcatagagggaagaaaagggaagcctttgggtatgccctgatgggaggctgctgacatagagaagctatagaccggctgactagaaacaggacgtccttgtgattggttagaaggtcaacccgccccgaatttagtagtagtaggcggccgc

SEQ ID NO: 221352 - DNA, 788 bp, Homo sapiens
cttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgccc

SEQ ID NO: 221353 - DNA, 405 bp, Homo sapiens
aatataatagagcaaagataatcaatacaaaaatctgaaaaaaatcagaatatgaataagaaattcaccagatacctagatgtcatgagaaagaccaaacagatatcttggtagtaaagaattcaatgaataaagtaaaaaaaaaaaaatattttcaaaagcttcaacgatagactaggtaaggcagaagaaaaaaattcaccacttgaggactagatttctgaaataaaccagatagaaaatataataaatcatctaaataaagccagtattcaatataacataccatgtagttaccaaaggtttgattctgagtattccagaatactcaagaagaagagatgggcagaggcatgacaaaaattttaaactaagcacatgtaccctaaaacttaaagtataata

SEQ ID NO: 221354 - DNA, 545 bp, Homo sapiens
agagaaacatatcctatgtaattctggacctctgagccattgtggtttcgtacttttactgcatttagctccctttccaagtcctcatttttaaaaaaccttttattttaagttcaggggtacatgtgcaggtttgttatataggtaaactcatgtcatgagggttgtacagattattttgtcacaaagatattaaacctagtagccattagttatttttcctgatcctctccctcctcccacgccgcaccctgcaccctccaataggaccctgtgtgtgttgtttccctctatatatccacatgttcccatcttttagctcccacttataagtgagaacgtgcagtattcggttttctcttcctgtgttagtttgctaagataatggtctctggctccattcgtgttcctgcgaaggacatgacctcatccttttttacagctatggctgcattgtgtccagtctaccattgatgggcatttaggttgattccatgtgtgtgctattgtgaatagtgctgcaataaacatatatgtgcatgtat

SEQ ID NO: 221355 - DNA, 318 bp, Homo sapiens
gagaaggtcaaaccatctccagtcataaagcagcccccaactcagcttttagagccacattcaaagtaattaactggtattatctgtccaagagattggatggataggaagttaaacttctgggagatgcctcattatttgtaccagtggctccacattatttcttgattaattgtgcagactgagaagctgacagctagtttttccaattcaagagtcatcatggggatgttctcaattgttgttagtgggacttgtgttgtttccatgtcgagatattgtaatgccggtaatttaaacagataataatctccaata

SEQ ID NO: 221356 - DNA, 346 bp, Homo sapiens
caggatgtatgaaaacaaaggagaagcttggagaagaccgccacccaaaaggaaggtgatgatggcttgagctaggcagtaaaatacaaggagaaaggaaatggtgaattgagaagttatctacagtttggtgagatgaatagtttcagggaggaagaggacaaaaaaaggaaaaacaaaacaaaacaaaacaaaaacccctaccagtttctaaactaaggggcttctaaatatcacttcaaaaatttggagaattagaaatttggttttggaaccctccatcatttacttcctgggcctcctcctctgcttgtctttgccttaaccaagacctgatttcagaaaa

SEQ ID NO: 221357 - DNA, 690 bp, Homo sapiens
ccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacaccgcaacgagtgcagtggtgagatcctgaacaactgctgcgtgatggagtaccaccaagccacgggcaccctcagtgcccacttcaggaacatgtcactgaagaggatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtga

SEQ ID NO: 221358 - DNA, 515 bp, Homo sapiens
gcaaactttctacagtgaatatatattgtctttataataaggaaaaatgattgaaataaattgagaggtataaaacaaaactataacaaactttcttttgtttattaccatccaacttaaagactgaaaagtccaagagatttggagggatgcaccagtaagatccatattgaccgtaagagaatacacaaggggaatggtacgctgcccgcacgtaccgcagcccctcaccgtctcagcaccactgaggaatcgggctcctgcacttggagaccagcctctgtgaaacacaggtgtagtgagtcatgagatacgctgacaaacgggatgtgaatatcatggaagctccaaaactcccagtaaaggcaaaaagaaaccagttccccttgacctgtctccacatatcatggctctacgtgtgagaagagttatcactctttcttcaaagatttccacgagggaaggaaggaaggaaggaaagaaggaaggaaggaaggaaggaagggagggaggga

SEQ ID NO: 221359 - DNA, 399 bp, Homo sapiens
agggctgtagaaagggaaaaaagaaaagactaacaagtatagagggtcaccagatgttttctagaaaatatgctaggtactgtgcaaatattgccacattttagttaattttcaaatgtgctgggattacaggcgtgagccacctgcctgacccctttgttctatttatttcaatgtttagaacagatgaagtatgtggaattgaacggaattggatttttattttattttaatgagcatcatgaggtagtcagtgagtattggcttttttgacaaggaaaattacccaaatcacccaagagttccattaagaaacaaagctgtgaatcaaaatcgtacaatgctttgctaacatttgaccttatttccttatagaaacaaaaagggctgtagaaaggg

SEQ ID NO: 221360 - DNA, 322 bp, Homo sapiens
aaaacaattaatgtcccttttttgaactttaaccttccttgtgtctgaaagtattaagcttaaagaagaaaaaataaaaagacttgtggaagatatccggcaccaataaagaaattaaggaaatatgatgtcttttgaggagtgtcctggagaaagtgttcataaatccatttgaagaaaaatgcatatgtattagatattataatcttctgtttcagtgaattacattttgtaatccctcattatatattgaaggacatagcatagctttcctttctagcatctaggtcactagtggtatttgagcaatataaatgaagca

SEQ ID NO: 221361 - DNA, 461 bp, Homo sapiens
ggatggtagttaaaaatacatactctgaaccccatctgcctgggtttgaatcccagctctatcccttgtgagctgtgtgattttgagtaagtgacttaaactttctgcacctcagttttaatatatatgaaaaaaggataatattagtactcccttaaggttgtgttagggattacatgaattaatataatgtgtttggatcagtgcttatgttggaagcactaggtaagtgtttattattattacttctcattgtagtctcctttatgaaacgtgtgtgcatagcctgtctggaggatgactttttgtcttttaaagagagaagctgtactacttctactgtaccagaaattcatctgagagcaggttactttctcattgtaaagtccatgcaagccagataaacctatagggtagcacttccttaattagtttacaatttctgaggataggttggtggg

SEQ ID NO: 221362 - DNA, 399 bp, Homo sapiens
acattgtttttcaggaacttggggtcaactcttgtctggttcaagccatctgagaccactgaccctccaactggacagggttgattccctgcagcaatgttcaatgagtgatcttctaacattagagggacaaaaatatcactctcagatgatgttaatgatgccattttgtgaagatgtattccataaagagccatgaagcttgactacatttgcatggaccactgattacctcatttttcctcactcccaatcacctttcctaatgcgttggaccaccttgctcctttatctcataaatatctgtaagaccccatcttcagggaggtggatttgagaggtgttctcccacttccttgtttggctgctttgtgaataaaatcttttctctactgcaaa

SEQ ID NO: 221363 - DNA, 394 bp, Homo sapiens
gtggcatgattgtcccactgcatgccagcctgagcaacagagctagaccgtccctgtctaaataaataaacaaataaaagtagtcaccatcaaaggatataaatgaagcagaccatcattttgaaaaatggtaaacaaaaagaacaaatcaagccactaactggccttttctatataaattgtacaactgggtagcacaataatttataagaagctgcatctcttttttatatttacttttttttcttcatggaaggcccttctcagggtagcaatatttctttctggaagtatggcagctcataaatgaagaaggaatgatataacaataccatcattgttcaatccataattgatcactggctgttaacattataaaaaaaaaaaggtggcc

SEQ ID NO: 221364 - DNA, 556 bp, Homo sapiens
ccattctggcgtttggaggatggtggccctcttctcacagctacactaggcagtgtctcggggggactctctgtgggggctaccacctcacatttcccttctgcactgccctagcagaggttctccatgagggctccacccctgcagcaaacttctgcctggatatccaggcgtttccatacatcctgtgaaatctaggtggaggttcccaaacctcaattctttacttctgttcacctgcaggcccaacaccatgtgtaaggcaccaaggcttggggcttgcaccctctgagtcaatggcctgagctatatcttggccccttttagccacagctgggacacagggcaccaagttctaagactgcacaaagcagcaagacctggggtttagcccatgaaaccactttttcctcccatcacaagcctggttacacggttaggtggaaaagacaagttgtatgtagagatcattatcagaaattgctaaactctgtcatcaaaaactctgttggaatggattttaaaatttcttaataaaagatgaaacatgactttg

SEQ ID NO: 221365 - DNA, 495 bp, Homo sapiens
taatggactcagagttctacatgggtggggaggactcacaatcatggtggaagatgaaagaggagcaaaggcacatcttacatggcagcaggcaagagggagcatgtgtaggggaactctcctatataactatcagatcttgtgagacttattcactattgcaagaacagcatagaaaaaactcatccccgtgattcaattaccacccactgggtccctcccaggacatgtggggattatgggagctacagttcaagatgagatttgggtggggacacaaccaaaccatataattccacccctggtccctcccaaatctcatgtccttacaattcgaaacacaatcatcctcccatcacaagcctggttacacggttaggtggaaaagacaagttgtatgtagagatcattatcagaaattgctaaactctgtcatcaaaaactctgttggaatggattttaaaatttcttaataaaagatgaaacatgactttg

SEQ ID NO: 221366 - DNA, 291 bp, Homo sapiens
gatggagctaggtgctgtgactcacacatataatcacagcactttggaaggcccaagtgggacgatgacttgagttcaggagttgaagaccagcctggacaatatggtgaaacccatctttacgaagaatacaaaaaattaggcaggcatggtgctgcacgcctatagtcccaactgctcaggagacttaggtgggaggatgggctgagatgatcctcccaccctcattcacttctgtcaggctagactctctctccttttcattggcttgtcttagctattaataagtct

SEQ ID NO: 221367 - DNA, 873 bp, Homo sapiens
tctcatttgttgtcttgccttgctcttataaatgagtcattcctaattgcactttgaaaatttatgggaaaatttaaataattgaggaatgaactaccaataaaaacattttcattccatcagttatagttcttgtatttcattggtgacaggaggcaaatatttgtatttattgatgactaaaaagttatagcaaagaaaaatcttttttctgaatattgacagaaaaagaagtcttgggttgctatattgaattgaaatgatatttttcttgttatcatccttttataaagcctgttgagctgcctcttcccatcctgtatgtttttaaatcatcaagtgcttagtgatttctaaaagagttatgtattcagtgttctatttatcctagtattggtgttctcaatctgtaacatggtaatgtcttacaatattgatacctaaataaaagttgacttaactgatcagtttttatttggattcctcctcccagtgaaatggtgagctggggctttgtaaggatcttggcttcatacggtggagaaacgggagactatgccctggagaatatgggactctgcatattccctgccaacaataaactagtagtaagactagcagggcgagggccagagcctgtaaattactaaggcagaaaactatgtggcaccctattcatggaactaccaggttcagaaggtttaccctgggtgcattttcatattcagaactctaaggtagactcattactgagctcagtgtctggcacagggtgagtactcaagtttataaggatgaatgaaccaatataactttacataattttctcagttggttttataagactggatctaaatatagaaggctctaaat

SEQ ID NO: 221368 - DNA, 426 bp, Homo sapiens
tatttgaaagggctgctctgaaactttcggcagagcaaggatgcccatctagattttaatttaaaaaggaactgttcaggatcagctcacctaatggagatgctgtgtttctgcatggcattgtctagtagaaataggatgagtatctcccgtccatgtgggcaggtcagctaactgcacctgaacttgcctaagtcatctccccacagaattgtctgttccgtgataggattagccatgaaatgttggccatgattatgtggaacacagatcatcagcattggggctatttccagcaagactgtactaaaacacagtaacttgtaatccttatgtatctgaagggaattgttataaagaacagtaactgagaatgcacacctaagacataaaggaaactgtgcttttgaatggcatcaacattca

SEQ ID NO: 221369 - DNA, 529 bp, Homo sapiens
tctcagctcctgcccttgccctcactgcatcttttgtttaaccaaaaccaaggaagggagccctgttcacactttgtgctttgctcttgctgttctgtgtctagacagccaaccctttcttacgtatgtgtccgtggagcttcagctcaggcctccctctctcaaaaaagcctccagaattcttacaggttgtagtaaatgcccttttgtgctcctaaagtagtggttcttttttttttggacagggttttgctctgtggcccaggctggagtgcagtggtgtaatcttggctcactgcaacctctgcctcccaggttcaagtgattccagtgcctcagcctctggagtagctgggactataggtgcatgccaccacaccaggctaatttcatgtatttttagtagagacagggttttgccatgttgcccaggcatgggcaatttcatgatttccttgattggctctgttgttaagcctgtgaagttatgcaaaacagttgaacatagttttacccatcaggagtttat

SEQ ID NO: 221370 - DNA, 464 bp, Homo sapiens
ttagcagtgtatattgaaaacttgttatgaccaacgctccaggctagacctttttcggggacccaagaagatgaatctgttatcacccggcctcaaagaagcatatagtttagtaggacaaacaaaagcacacatatcacacatagataagtatagagtggagaaactttcagactgtacttcttagcactatgattctatagaaaaatctggctatgtgtctttttttatgtgtatttctgaattacaagtgatctttaagggaacctagcatattgcctggaacatagtaggtgttcaaaaatgttgaaagaatgggcgaatattctctagtgcctgggataagacagcatgctagatgtaatgtgagcctatgtatgtatgttaactgtctctgctggaaaacaaagtactttagaattaaactgattttatctggctttcaccattttatagaacaaaat

SEQ ID NO: 221371 - DNA, 525 bp, Homo sapiens
gggcccaaggagaagatactagtctgtaaattgttctcttagaaaactggccacaatgggcaagtcatgggaaggtgaggggcagaactgcactgcaaacaaagattgtcttattatgcaagcaaggtctcctaggtaatctttcagagctgctcaaaagaatagataaaaagtctgggtgtggtgaaggctttgtctcttctctgtttaatcttggttatcccatgaaattcctagggtggggatcgtaagacaattgcatttcttttggaggaagttttcctcagttcgacaaggaaacttgcagagagagtgctttgggaggagagaaaatggttaaaaagtctttgatttgaggcagcttctaagaccttccagttttctttaatttaatagttctcagcatgcctaagcactttactttggggcggcattctctgtaccccaacaacaatttaaatttgttcttattcatactttaatttcactaacaattaagagttgcttcagtaaagtctgtgacca

SEQ ID NO: 221372 - DNA, 576 bp, Homo sapiens
gggcccaaggagaagatactagtctgtaaattgttctcttagaaaactggccacaatgggcaagtcatgggaaggtgaggggcagaactgcactgcaaacaaagattgtcttattatgcaagcaaggtctcctaggtaatctttcagagctgctcaaaagaatagataaaaagtctgggtgtggtgaaggctttgtctcttctctgtttaatcttggttatcccatgaaattcctagggtggggatcgtaagacaattgcatttcttttggaggaagttttcctcagttcgacaaggaaacttgcagagagagtgctttgggaggagagaaaatggttaaaaagtctttgatttgaggcagcttctaagaccttccagttttctttaatttaatagttctcagcatgcctaagcactttactttggggcggcattctctgtaccccaacaacaatttaaatttgttcttattcatactttaatttcactaacaattaagagttgcttcagtaaagtctgtgaccaaaaaaaaaaaaaaaaaaaaaaacacaccaaaaaacaaaaacaaaaaaattc

SEQ ID NO: 221373 - DNA, 521 bp, Homo sapiens
caaaaatcacatgatcatttcaatagatgcagaaaaagtattcaacaaaatccagcatccctttatgattaaaactctcagcaaaattggcatacaaggggcctatctcagtgtaataaaagccatatatgactaactcactgagtggggaaaagttgaaggcattccctctgagaactggaacaagacaaggatgcccactctcaccactcctcttcaacatagtactgaaagtcctagtcagagcaatcagacaagagaaagaaataaagggcatccaaatcggtaaagaggaagtcaaactgttgctgtttgctgatgacatgattgtatacctagaaaaccctaaagattcctccagaaagctcctataactgataaaagaattcaacaatgtttctggatacaaaattaatgtacacaaatcagtagctctcatgtacaccaacagcgactaagctgagaatcaaatcaagaactcaacccccttgccaatagctgcaataaaaacaaaacaaaac

SEQ ID NO: 221374 - DNA, 871 bp, Homo sapiens
gggctacaagtatgtgccaccacgcccagctaacttttgtatctttagtagagacaaggtttcattatgttggccaagatggtcttgatctcctgacctcatgatccgcctgccttggcctcccaaagtgctgggattacaggcatgagccaccgtgcccggccccttaaatctattttaatttactatcagggtcttttaatcaaaaagatttagaagtcagtaagagaatttatttaatgctctaaactgaaagcattctctatttagaggataggtgtttttccttctgttgaaaactgaacatgtgactctgaaatcttaccaggttgacaatggtattaaatcttcaggttgctcaggtgccatgaattcaggggatggataataagtataacgtatttgagatgtgtcagccacaaaaagaaagttccttaactgtcatcctgtggtttcctgactgttcacaaccttgccaactaccacaacagcattaattttatgtccagaattttctttttcctacaataaactgagttttactgtaggaaaaagttagggcaaagtcacccattgagcccaggataaccactggataagctaccagcaccagcttttgtaagactcagcttttttctcttaaaaaatgagttccaggaaaatgttctatttcacaaaggcagttttcctccaactcactaatgtttgttgatctgaacaaactcatgctttgttaataaattaagcaaaaatgcttttaaaattcaaccacaatgaaacatttcatcccgacctcattatgtgccatttccatgcctcgtcagagtttctgagaactcccctgtgtgcacctaagtgacagcagaaaaat

SEQ ID NO: 221375 - DNA, 142 bp, Homo sapiens
tgctaagtgctataaataaaatcaaacagaataacgaaagagaaagtagctagactggagggaaaagctgcttcagaatgagttgtcaaggaagcctctttgcaatcagaaaggtgagaaggatttagtcaggcaaatatca

SEQ ID NO: 221376 - DNA, 155 bp, Homo sapiens
tctcgatttcagctctctctgctactattccccttactgacttctcaacaggaggccttctttcaaggggaagaagacggccaactttggcaaatacatctgtttcacgtggaggggttccttgaaatccaagtgtggctatttggagcaggccc

SEQ ID NO: 221377 - DNA, 904 bp, Homo sapiens
tgtacggtcccgaatcccttggatgtccttggaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagaaaaaaaaaaaaaaaaaaatcgggctttttttcggggcggaaaaaaaggttgaatggggctggcaatgtttctggcccattcttgtcaaggggaaaacgccggcccaaagggataataaacaa

SEQ ID NO: 221378 - DNA, 834 bp, Homo sapiens
aaggagctggagcgacaacaacgacgtcgtttccgtttccaccacctcttcctgttcccgtccttgaggacgccgtgccgggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagaaaaaaaaaaaaaaaaaaatcgggctttttttcggggcggaaaaaaaggttgaatggggctggcaatgtttctggcccattcttgtcaaggggaaaacgccggcccaaagggataataaacaa

SEQ ID NO: 221379 - DNA, 924 bp, Homo sapiens
tgtacggtcccgaatcccttggatgtccttggaggacgccgtgccgggtcagtgttagcctccagccctggttgtggaaggcgacagaagtcatggcgatgtttgagcagatgagagccaacggtacaatcctgagaacctggccaccctggagcgctatgtagagacgcaggccaaggaaaatgcctatgatctggaagccaacctggctgtcctgaagctgttcatgtaatcctcctgcctcggcctcctaagtagctgtgactagaggtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagaaaaaaaaaaaaaaaaaaatcgggctttttttcggggcggaaaaaaaggttgaatggggctggcaatgtttctggcccattcttgtcaaggggaaaacgccggcccaaagggataataaacaa

SEQ ID NO: 221380 - DNA, 840 bp, Homo sapiens
tgtacggtcccgaatcccttggatgtccttggaggacgccgtgccgggtcagtgttagcctccagccctggttgtggaaggcgacagaagtcatggcgatgtttgagcagatgagagccaacatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagaaaaaaaaaaaaaaaaaaatcgggctttttttcggggcggaaaaaaaggttgaatggggctggcaatgtttctggcccattcttgtcaaggggaaaacgccggcccaaagggataataaacaa

SEQ ID NO: 221381 - DNA, 868 bp, Homo sapiens
tgtacggtcccgaatcccttggatgtccttggaggacgccgtgccgggtcagtgttagcctccagccctggttgtggaaggcgacagaagtcatggcgatgtttgagcagatgagagccaacatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggaaatggcagggcttgcccaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagaaaaaaaaaaaaaaaaaaatcgggctttttttcggggcggaaaaaaaggttgaatggggctggcaatgtttctggcccattcttgtcaaggggaaaacgccggcccaaagggataataaacaa

SEQ ID NO: 221382 - DNA, 491 bp, Homo sapiens
cttgttaggctccctccttatggtttgctaaatagaagtaaaagaggtagttggctgaggttgaaggtaaatagggttaaaagtttttgaaatttttccctaaggataaaatattaagattatataaatctctgacataaaaagagtatgaattaaaatggtcttctttgaaggataatttaaggaaattccaagcagttgagaacagatggttgttatggaagtgtgtctggcaagcagatttagtttatatctgtgtgtatctgtatacactgagtgtttatacacacatgatcgtacttacgcacaatctctgttcaggaaaaaaaagatcctgattttccagctcccttcctacttcgatgtgtatttcagaaaggctgctcccttttcgtttcattaggataaaataaaaacccgttttccatatttggatgatcactactgattctttaacatgagtgcttaccctcttttttaacagtgccaaa

SEQ ID NO: 221383 - DNA, 1798 bp, Homo sapiens
tgtgagtgtgtgtgatcagagaggataaacaaatggtgtcagcaaaatagaatgtaaaatatggagataatgtggatttacacaatttgataaaaattctcccttgaattttgcagatcatatatgaatatcatcatgtgaagtgcaattaggattttttcatatattaatacatatacatcatctctttaataaaatattttgctgaactcgttttatatttctcatgtctcatatttcatattttctcatatgtctcatattttatattttctcatatgtgtctcatttttattattactatagtatccattaaaggagactggcaaatacctgaacaaagttatgttgttggcaatataagatattaccaattgcataatattatttccaaaggcaaattaatatgcaaactatagatttccatgggtatctatacaaattattacttgaagtccatagaaaacagcttccttagagggaagtaaaagaagctctgataacagacaatgtatagcatttcagttaaagtttgattgacatatttttttctcagtcttttatacttgtgaattatagtctacattttgtctttacagatgttgctaacacagtgcagcatgttggcttgtcattttactgattatgtatattgtctcctagttcaagtatacagtaaatcagagctttcatttttcaaggggcagaaaaataattgttggttgataaggtaaggttatatgattttgagggagcttcattgtaaattgaatgagaatccggttttcatgcaaaggtgtatctatgcgataatactttgaatgtctgtagtttgaaatagaaggttaattttttccactggcttatccttaatgaaggaaatcccctgataattactttgattctgaaaatgttgaaaactccagaagaaataaagcttttctttgatttctcagctgaagtgttgtacaaactgaggaatatgaagtccattcccttctttcttctcttgaataattttaaaattgtttgtttagttgtacaattgaaaatattccttattatagaagtaaaaaaacaataatgcatatttcctcatatcataaaaactaaatttgttatcatctgagcttcaatattcttgctcaattagaatagtaaatataaagtgtgatatttataacagttcaaggtttgataggagatagaggtgttttgattttatgggaaaattacttcctcaagaacacatttcttgaggttttagtaatcacatttgactccctgaaattggcaattttattcaatgtaggaatattatcatggtatattatagtgaggagcacatagtcattattattttgtttttgcaaatttattttgaaaaaaaggagcattatcaaatattggtttactattttaaagtaattcatcaggaaatgattttttaaacactgtccctttaagtaaatgtcccttgcttttcaaagctcaacttattacttatggtaatagagttactttgcttcttaaaacaaagtttatactagagcatagcattgtagaattattcaggtctcaatttctcactggaaaatgagtctttaaaatagtaaggatttaaatttctataaaatttaatcacagatacttatattttaagataaatgtgttggagctaaactctggaattattaaaatataaaacattatatccctctaatgtattttttctatttaaatttaaaacaataaacataaatatctttggaatcaaaaaagcagaaccagaaaaact

SEQ ID NO: 221384 - DNA, 1273 bp, Homo sapiens
ttagcggccgcccgggcaggtacgcgggcagtcttttatacttgtgaattatagtctacattttgtctttacagatgttgctaacacagtgcagcatgttggcttgtcattttactgattatgtatattgtctcctagttcaagtatacagtaaatcagagctttcatttttcaaggggcagaaaaataattgttggttgataaggtaaggttatatgattttgagggagcttcattgtaaattgaatgagaatccggttttcatgcaaaggtgtatctatgcgataatactttgaatgtctgtagtttgaaatagaaggttaattttttccactggcttatccttaatgaaggaaatcccctgataattactttgattctgaaaatgttgaaaactccagaagaaataaagcttttctttgatttctcagctgaagtgttgtacaaactgaggaatatgaagtccattcccttctttcttctcttgaataattttaaaattgtttgtttagttgtacaattgaaaatattccttattatagaagtaaaaaaacaataatgcatatttcctcatatcataaaaactaaatttgttatcatctgagcttcaatattcttgctcaattagaatagtaaatataaagtgtgatatttataacagttcaaggtttgataggagatagaggtgttttgattttatgggaaaattacttcctcaagaacacatttcttgaggttttagtaatcacatttgactccctgaaattggcaattttattcaatgtaggaatattatcatggtatattatagtgaggagcacatagtcattattattttgtttttgcaaatttattttgaaaaaaaggagcattatcaaatattggtttactattttaaagtaattcatcaggaaatgattttttaaacactgtccctttaagtaaatgtcccttgcttttcaaagctcaacttattacttatggtaatagagttactttgcttcttaaaacaaagtttatactagagcatagcattgtagaattattcaggtctcaatttctcactggaaaatgagtctttaaaatagtaaggatttaaatttctataaaatttaatcacagatacttatattttaagataaatgtgttggagctaaactctggaattattaaaatataaaacattatatccctctaatgtattttttctatttaaatttaaaacaataaacataaatatctttggaatcaaaaaagcagaaccagaaaaact

SEQ ID NO: 221385 - DNA, 446 bp, Homo sapiens
ctgcggaggttcctcgtgtctttggctgaatactgatctgcatctgcatttgaggaaaccaccctcagagaaccaaaggggaaaagaactgccagggctccctggaggctgggaacagcttgtgtttccaccaccaagagtgaacagcaagcagggtcagaagggtccggactgaacagtgggcttcacaacaacggccgctcttttaagccgtgttaggagccacccgaacacagcttaaacgccagcctcaagaggaggaaacggtctatgattaactttactacaacctaaaacaagtctcaacagcatttaaaggaatataacaaaatcctgcacccaataaagtaaaatacaaaatggctgacaaaaacaaccagacctgcgatgaagcgggagaaaaccacctctgaccaggagaaaaaccaaccaatagaaacaggccc

SEQ ID NO: 221386 - DNA, 207 bp, Homo sapiens
ttgtcatgtttatctttatagtgggaatattgtgttcaaaagtttcagtgcatgaaggtgtttactttttagaagggcagaagtcaagtggtcctctatgacaagtaagaattaatgctggaaaacttggatggattaaaatacaagtttctccctgcttcacagcgtttgtacctcttgcgttctacctgaagtgttccttatcta

SEQ ID NO: 221387 - DNA, 333 bp, Homo sapiens
tttagaatggagtaattgctgaatgaaagggtatatacatttttctaaagtgatctttcagattcactcccttctatattttatatttcctatccatttctgcttaaacatttaatattttcaattattttagttgataccattctgataggcaaaactggtacacttgttctaatttgcacttttcagatgacagtaaattggatatctttttattctctgtttatactttttctgtaaattttcctttccatcctttgtccattttttaaataggctatttggcatttccttattaatttgcaagaattcaatgcatgctagattattaac

SEQ ID NO: 221388 - DNA, 434 bp, Homo sapiens
agaaaactatacagaatccggtttctctcgataaacctggctctcaccaacacttccctttcagtatttacagcaacctgcataggagatcatcaaagagaatcccattatgccctccattctttttacatcagtcaacaagaaatgcccaagactcccaagtcatcccccatccctatatactttcatccctatatactctgtatgtccctacactgaccccttttctcttcctcccccaattcccgaaatcctttcgcagtgtcttctggaactcatggtacacatcgtcgttaaaatatcctatttcctcagtattgttgttgcacactcttcaccttacttgctcccagctgtaacctctctcccctctgggagttctgctctaactccagccctttcaaacaatggcttctctctcatgtgagataaaa

SEQ ID NO: 221389 - DNA, 502 bp, Homo sapiens
atcttatgatgctttcttttttccccttcccagtactcccaggagatgaataggagttttcaaggacaagaggaaaaagaacaaaacacctcttcttccttcccttgatgaaagaccctactgtcaaaagtgccttttgtttttttaaacctgtctctctcttttcctctctttcccaaaatactgttttgcagtcagtctgtgaaaaccagtgtgagtcgcagaagcagcttctcgtgtgcagccttccatctgtagcttggtctgtattatgtgctgtatttttagaatgcctaaattagtgatgttccatgcgctatttaaagaggagctgggaagtcgggggaagagcagggctattgatcaggattggcttctgaatgttgctggctgttatactcgaatcccagagttagaaatatttgggggccatcaaaagaacagatggtccaggaaggcagctggcccatgtggtaattagtctatgaaggcaattggtcat

SEQ ID NO: 221390 - DNA, 397 bp, Homo sapiens
acaataagtttgtaagtagcacaaattatgaggggtctagggattgcatttcagggaaggaatgacattactatgttccttccatattagaaatcttaaggagtaagatctgacttaaggtgggaggggatatacgtgggatttagactcaggcaggtcaggagctcaaatcccagcttcgtaacaagctgcctgatgttaggcaagaaatgaacctctctagcctcagttttaccatctgtagaatggagatatcatcaatcagttaccatcagagtttgtgtctgttaactctgcttattaataaataacactaaggggccggatgtggtggttcacgcctgtaatcccagcactttggaaggccgaggcaggtggatcacaaggttaggagttc

SEQ ID NO: 221391 - DNA, 320 bp, Homo sapiens
ctgaggacttgaggactcaggcaagctggagtgagggaggagggggacaagtgcctttggaaaggcagtgtggttaagtttgtgctctgtttgtgttacagaccaaatggagttgccttggttgtatgcttcccaggtgtactgagtgcccacctggttttaaaggctgccctggcggtggcccagaagcaaatgtagcatcgtttgccagagactcaagaatgtgtctgtataaataaaagtgaaagtggcatatgcttgagcaaaattggcctaatgggatatggatttacccgacacacactgatagcaaatagatt

SEQ ID NO: 221392 - DNA, 344 bp, Homo sapiens
cctctctttacccccacggtccaccctattaagcacacatttgaaacatcagccaggccgggcgcggtggctcacgcctgtaatctcaacattttgggaggccggggcaggtggatcacctgcgatcaggagtttgagaccagcctggccaacacggtgaaaccccatctctactaaaaatacaaaaattagccagccatggtggtgtgtgcctgtaatcccagctactaggggggctgaggcaggaggatcgcttgaacctggaaggtggaggttgcagtgagccaagatggtgccactgcactccagtctgggcaacagaggaagactccgtctccaatttg

SEQ ID NO: 221393 - DNA, 285 bp, Homo sapiens
tccgcagcctttgttatctcaactactttgagagagttctcttttctccccctcgactcctctgatgctaatctctctccataaatcataccctctaatcttttcatcacctttctctgattaaagcagcctcgggggttgggagccccagtcctcagtgactaaaacactttgatgtcctaagacagtcccagaggctgcagcgctggctggcgcggtcaggcctcacccaccgcggggcaggccgggcgcaggcgtctacacggacacatcccggagttgtcc

SEQ ID NO: 221394 - DNA, 509 bp, Homo sapiens
tctcccccaagcacctcttctgtgttatgcccctcattcttgcagggttctcaacccactctcttactccttcaaggacgtttctgtttgtttttccactttcgtgatttttgcacatttgtgtgctgccagtgctatgaactacctattattgttccatttttctaagcaatggtttcacaaaattgtgggtttggtgtgataattattatgttcctaaaatacattaaaataggtattgaactgttaaaattttagacaaactaaaagcttgatgtgtgtagtagtccccccttatctcagggggatatgttccaagatgaccagtggatgcctgaaattgcagataatacgaaaccctatatatactatgttttttcctgtacatgcatacctatggtaaagtttaatttataaattaggcatagtaagagataaacagtaactaataataaaatagaacaattataacaatatactgcaataaaagttatataactatggtcagt

SEQ ID NO: 221395 - DNA, 691 bp, Homo sapiens
gtacaggaaacgcttacaggaaacgctttacaggaaaagcgtatacagcgacagtcgtaataccagggatatcagctatgaccaggaatcatcgcctatgaccacgcgaaacagcgctacccaggaaaactccatctcaaaaagaaaaagaaaaaagagacagaggttgggagagaagcattaaatactaatatttaacaaaagggaacacacatttttcagtagatattgagcttaatcaaagtacagaatgtacctatcttatcactaaatatagagcaaataagtgaatatcaagggaataaccatgagcagtataaagactgtgctaacaggaagggatgatcaggccaggtgcagtggctcacgcctgtcatcctagcactttgggaggctggggcaagcggactgcttgagcccgggagtttcagaccagccggggtaccatggcaagaccacaaaaatcagccaggcatgatggcatgtacctgtagtcccacctacttgagaggctggggctggtggactgccagagcacagcagacagagaggttacagtgagctgagactgtcactgctgcactccagcctgggcatcagagttacaccctgtctccaaaaaaaaaaagaacaggatgatcttaatactgacatccagaggccgggcacagtggttcacacctgtaatccc

SEQ ID NO: 221396 - DNA, 317 bp, Homo sapiens
gatttaaacttagctcaggatggtgctgtgcctgagcatatggaaaagcttttaaattcagtttcagatttatatctgctgacaaggggtaaaatgaattcttggtctttgttcgaatggaaaaaagtctctacattattaggcgccataatattttattcaaatcttcttagaaatttttggatattgcatctgggggtaagtgtgcctctttgatgtcattcagaagtgtgtgtatcttggttactgtgtacaaaatgcactggtccagttttttcaaagtgccttgacgctatacattaaattgcaatcaagag

SEQ ID NO: 221397 - DNA, 219 bp, Homo sapiens
ctctactctaaaacttgtagtcttggcaagtgcagcacagagtttagaagaaacagaaaccttgtaattctcaggtttcttagatgaagataaggtgagtgattcagtaatcctttgttctggctctgtgtttcatgacataatgaaccttctgcagcttccttctaagaatgttggtctgcatgcctgaaggatcataactattttttccctgaacaa

SEQ ID NO: 221398 - DNA, 400 bp, Homo sapiens
gaactcccagtggagtccagtcagcccatggaactgcaagagacaggatctcgctgcgttgctcagactggtctcgaactcctgggcttaagggattctcctgcctcaatcacagcctcccaagtagctgagattaaaagtgctcaccaccgtgccagcgagttcagtttttgagggtggagccaagactctgaggagagggctgaactgtgaacctagaagtaccatctccccctgcacacacctttggtcaagttgaccccaagaagaaggacaagtcctctgcacggcgatgaggccatacacacagtctgtggcccggctttgggagactgatgggacaaaggatgttttgcacgatccttggtctctgagcaaatatatacatgggttaacacaa

SEQ ID NO: 221399 - DNA, 569 bp, Homo sapiens
catagctagatgagatcttagaatgccactgacttgatttttcagagtccagaacctcaacaaaaaaagatggatatctaccctattttgctaaatcctccagggaatgcatttccacagcctcttgcctgcaagcagcacaatgagaatgtttatgttcaaaatgccaaaggcacatttcaaaaactatttcaaacaaagattttctttgaaaatgcatgttatggggtaggcaagggaaaagggcaggtggggagggtgagctgtagaaactgattaactctttaaatcaaaggcaaatctggggaggcatttaagcttggcaaggaagtcaaatcacagctctgctacttagtagctctgtacctatacatcaggcaaactgcacaaatacctctaagcttcagtttcatcatctaaaaaatggaaataaaaacagtgcctgctttatagcattaatttgagagattaaatgagatattgcatgtacaagtatgctccacaactcctggagtgaataaaacacacaataaatgctggctattgttactgtcatcatttactgtgca

SEQ ID NO: 221400 - DNA, 508 bp, Homo sapiens
cctgacaaagcatcctcttctgttctttccaggtcccctggtttgtgatgcagagtccttcattcagtttccagtgcaaccctttctgatgaattcaccccagagtcacttttactatcatgggatccatcatattaaaacggcacttaggagctgggtgaggcagtgaggaggacaatggaaagactgagcagcaagaagagaggagggtgaggtgggaacccacatggctgagtggaaaaagttaactgaactgccttggaaataggctccacatatttttggatcaagccttagtgttctatctcgtgtgtttgacagagcggattatgttttaacttttcttcctctacatgacaaagttattttgaggaataatcatgaaatgaaacaaataattaatggccaggaaactttaagtagtgaacattttcttttactaacccttatatggtcatgtcagtaaaaataaataaatgaaaataaacatgccatttcagattaggaa

SEQ ID NO: 221401 - DNA, 384 bp, Homo sapiens
caaataatagaaatttatttctcacatttctggaggcctggaagtctaagatcaaggccccattagattcagtgtctggtgaaggttcactttctgcttcatggacagtgcctcttgctgcattctcacatggcagaaaagtccatacagctagctcccttgcaccccttttataagggcactaatcccattcacaaggattaagtcacccttgtgactgaatcacctcctaaaggccccacctcttaacactatcacattggtgattaactttcaacatatgaattggggaggacatcagcattcagaccatagcatattccacatcctaattgtgctttatttataagatcacactatttccttcaaagtacattttaaaca

SEQ ID NO: 221402 - DNA, 352 bp, Homo sapiens
ggccaatgctaaaaggccccacacaataagtgtttatcccagacgtttcttaaaatgacatgtgatgccgtgaaggtctcagagaaagtcaggagtgtttttatcttttttgaaatagttgtgtttcagattaaaagaccacgcattttttaatattttggaaatgaaagttaatgttctttcctattcccttaagactcttaatgcttatattttgtcaaataatgatactttgttttcaggctttagaagccttattgtatgttgttctctgacttggcctttctgtctgtgtggggaggtgtggtgtggtgtgtgcagcaagcagtaaaggaggctctgacttggactg

SEQ ID NO: 221403 - DNA, 442 bp, Homo sapiens
agtgttcttttcagtatgatagccacccaataggtggtcattcaccacatgtagctattaagcacttgtaatgtgaatagtgagtgtggactgaggaactagatttttaatttaattgtaatgcttttaaattaaaatagccccatgtggtgagtgccagcacagatatagagcagttatattattgcagaaagttctgatggaaacactgatggagactggctccttgggtggtcgagtatgattttccacctcagtcctccccacataccgaatgaacatgtgggttgttagactgcaggcattgtgagagcgatggcctggtccttgccctttactcctgatttccagtgccaggcgcacaggaggctctcagaaaacatttggtacatgagtcagggactgcagccaggccatgtgccaggtgctggagctataaaga

SEQ ID NO: 221404 - DNA, 438 bp, Homo sapiens
gaactctgcgtcttctaagatttttgctctaaatccttctccctttacccctgaaacaaaaagctcttctgaggagcagctgacgctagacggaagggaacaaacagaagagcgagcagcacccttctgcagaagtaaacttagcacatttagttctgcagaagaaaggtgctgtgctgctcgctcttctggccaccagagcacacggaacaaaggaggaaaggttcctgtgtcttgtcccactggctggagttggaccgcacaatctaagctgatctcgattggctatttcaaatagaacagggatgtgggttacagtggctggatgagcggtttcgccaggaagaatagtttcggcgggaagggcagttacagagcgggtaactaagggcaaggaggcgcaaagaacaaggaagttagactttgaagatggagaac

SEQ ID NO: 221405 - DNA, 435 bp, Homo sapiens
ctgccgggagacagcagcctgagagtcaccaggggcaggggctgggctgctctctacctccccaaccctgccaaggccaggccacagaagaggcccaaggacaggcttgctgacgctggctcactgcctagaggaaagaagaaatgaaccagcacagggctgggtgcaatggctcacgcctgtaatcccagcactttaggagaagggcaaggcaagtggatctcctgaggtcaggagcttgagaccagcctgaccaacatggtgaaaccccatctctactaaaaatacaaaaattagctgggcgtggtggcaggcgcctatagtctcagttactggggaggctgaggcaggagaaccgcttgaacccaggaagaggaggttgcagggagccaagatcacgccactgctgcactccaacctgggtgatagagcaag

SEQ ID NO: 221406 - DNA, 465 bp, Homo sapiens
ctcttatagatgaacctgagataatctgtcaagctgctgataaaaattctttatgaagttaaagattgcacagaacttacaaattaaattgggagaattgaatttcctgtaatattgaagtttctcaaccaaaatattgttacccatttctatttttcactttttaaaaaatgtatgaaacaacatttatagcctttttaaatagaacttctactcttctcattaggattatttctcattttgtgtttttttgctgctattttgagttttttttttctctatttcattctaattgatggttagatggttagtagatggttagaaaattatttatttttatatgatgatattgaatctagccactttgaactcttgtgccattttataaaaatttgttttcttaagtatctagaaaaataatgaaatagtgtctgaaaataataaattttgcctctgtttttcaat

SEQ ID NO: 221407 - DNA, 544 bp, Homo sapiens
ccaacataattaattcaactttattattaaaccatgtgttcatttgaagagttttgtgatttttactttttcaaaagcaattccaaactttctccagaatctgcaatagcaaaatcacacatgtatacacagttatttttcctttcacccaccatcaatttacttgaggggtatagtgagatatagactggaagtaggacaccattggtggacagatgaaaatgagataatcagattccaccctctttggatgtgtatttttggctcctttgaattcaaatggcagatacttatattgttgcatgtttttgttaaatattaacttatagtggcccaaatcaccaagagttgaattgcaaatgaatacaaaaatgatgaaaagtgaacttaattcgagaaatttagggaagggataggagtaagtacatttatgagagagctgaaacgttgaaggccagggatttccttgactctggaaataagagaaaattctaaaggccaattcatttgagcctggtcaatatattgcgagggaactagatag

SEQ ID NO: 221408 - DNA, 408 bp, Homo sapiens
cattttgtaatgtattgttactcgttagaagaaaccagatcaattatgtaagaaataaaacattttgtagcgtaaacaatagcaccactagacaaagctctgattctgatttctaaaattcctcaagtcaattctgagagtgacagcagggaagaaagcttgtggctagacagcagccctgctcacctgggcagtggtgagggcaaggtggtctgacagcccttgctcctggcagggagcccccaacccacagaggggccggccctccagcacctgccacagaccctgagagtggccactgtcccgggggcctcgaagagactctcaaaccacgtcacgggatgagaaacaaaatgacaactcaaactatgtcacgtgatgagaaatgacataaatattttgacgatg

SEQ ID NO: 221409 - DNA, 325 bp, Homo sapiens
ctagctttatttggtgtggtcctgagcgggtgagggcacccagaaaaatctttcttctgtaaactacatttaagcagaaagctgcagataattacaaaagaaaaatgggctaagtgggaggagcccttgaggaaaggccttgaagtggagggaagtgggatcaggtcaagggactaaaaattctaggcagaggccagtgagtgagagccaccaaaagtcaagtattgccaccttcaccactctacctgcagagattctttctcttcagatattaaatttgttgttaagatttttttaggttctttttacttaacagattgagaaa

SEQ ID NO: 221410 - DNA, 869 bp, Homo sapiens
agcacgagagagtccatgaaggtccccgcgactcccggactggagaaaacggctcttgcgatggggcgaagtccgagctgcggcgggcgttggtccgtgcagggaagtgggaatcgttaggttcgttctggacccgccgccccatggcccaggcgtctcgctcaggtagcctgcctccactcgttatcgtgcccccgctgagggcgcaacccgggggcactggggaggagcagtgggagagaagtcgaacgggcggtcttcgctgggaggttcactgctggccgagcggaacttctggagggacgccgtggtggccgacgccggcggatgtgagcgaggactacgaggctgatgctgcggcctggaggcgggggcccgcaggtggcggcccgatccctcccgcgctgcagcgtctccgggcggtgttgctgcggctgcatcgcgagcgggagcagctcctccaggcccgagactgcgcctaccacctacagtcggctgtgcgactcatgaagaccctgagtcctggctcgccatccggcggccctagccccttgccccagtggtgccgcgacctgcagctgcacccttcccaaggggcggttctgcgaatcggccctggggagactctcgagccgctgctgctagcgcgccccatcggactagccgcccagtgcctggaggctgtcatcgagatgcagcttcgcgctctcggccgggagcccgccagcccgggcctgtcgtcccaactcgccgagctgctctttgcacttcccgcctaccacacactacagagaaaagccttgagccacgtcccaggggccgcacgtcctttccccacgtcccgtgtgctccgcctcttgacgggggag

SEQ ID NO: 221411 - DNA, 236 bp, Homo sapiens
gccaaactgagttcttctgcgtctagcactgcgaccttggagaaggggcttaacctgtcaggcctcagtttccccatctgtgaaacaaggtagtattgctggcaagaaccttctggcttctaaattcagagctccttaccacagccaaaagaatctcccacgccctcccccttcatcccccctagtgagggactgacagttgatgcccagtggggcttcgagatccgggtgctgtg

SEQ ID NO: 221412 - DNA, 376 bp, Homo sapiens
ttttcttttctgcccaattagcaccaatataaatcgttcattccatctaaggccctgtattacttcagggaatataaatctaagtcccggccagatgcagtggcttacgcctgtaatcccagcactgtgggaggctgaggctgaaggatcacaaggtcaggcgtttgagaccatcctgaccaacatggtgaaaccccatctctactgggaatacaaaaattagtcgggtgtggtgtcacacgcctatagtcacagctgctcgggaggctgaggcaggagaatcacttgaatccgggaggcggaggttgcagtgatccgagatcgcctcactgcactccagcctgggcaagagaccgagactccctctcaaaaaaaa

SEQ ID NO: 221413 - DNA, 448 bp, Homo sapiens
attttaaaattacaccataaagccacaaatacattttgattaaagatttggggaaatggtgagtttctgtctggggacagtctatcatttcttctgttatctcttattccagagaaaaatctgctgtcactagattaaatgcactttttgagttgtcctaatgacatcagtttggttttcattttgaaagaattagggcatctgacatttcagccttatcatagtccattttcaattctgtctttcagtttcttgttacacgggtaggaattgagttattaggtgttcatgggggagtgtcaaaagatctcctttccttctgaagagattccagcagtaggagggtttatgatttcaattgcaggaaatttgacataaaatgtataaaagtaaatgtggaaaacattttgggatttcctgtgacctcacagtaacttgcaaatcaagg

SEQ ID NO: 221414 - DNA, 458 bp, Homo sapiens
ctgacaaagctttacttcatcctcaacccagaaatctctacgtggccttctcatctggttttatacttcggtatttactatgttgatttccccacagttctcttggtttaggagagtaccttttgaaatttccaatcctacttggctgaatggaggtgtccccatcacagccaacatagctaggcagaacacagcatccttagcggctgtcctagctggacagcacagcaaaatgtggggctgttagaatgctcacagatgtacagttcctcctgtttccccagtggtgggcattccaggagaccctgcctggagcagggtccagtagattccctttggaggcaccacacataatcataattccttaaatgtacacttgtaggagtgttgttttctcacaagcatttgctaagcatagagattgttgtaagtatctcatatattcaagatgtggccat

SEQ ID NO: 221415 - DNA, 609 bp, Homo sapiens
cagagctccatttttcttttttttaaatttatttttattattattttttagattgggtcttgcattgttgcccaggcggaggttgcagtgagccgagattgcgcccctgcactccagccagggcaacggtgtgagactccatctcaaaaaaaaaaagaaaagacggtcaaagttttctccccagaaatggtaccaggtccagttggtattctggaagttctggtatgatggaaattctagcaaatcttgaaagatcagataataggaaaagatagatagcttcccagttcatcccataaggctagtataactagacaggtttaaacaaaataaaaaaaaaacaacaactatagcctaatgccacatattaatagagcaacaactattttcaataaaagattatcaaatggaatccatcagtgtattaaaagaagaatatattgtgacaaatgaaagtttgccccaagagtgcagggattgttcaacattaggaaatgttattgtaatttattgtattaagatattaaagagaaaatatcatataatcatctccataaatgctgaaaagtgatctgattaaattatacatctattctgctgtattggggt

SEQ ID NO: 221416 - DNA, 426 bp, Homo sapiens
tggcacgagcgagcagctgggatgtatatattcctgcaaggaaagaaaaggaaatggcttcacattgctggatgggagcagtatgtgtgttgtttctgggtataatcttcctagctgcacttttcccatacatttctttctactaaaaatcatgaaagtttgaattatagttcctctcacaggattgaaagcaagtatcagaggagtcatccattcaaaacacagttcttccactgcagtatccgatatgttttgtatgtgcgctaggctgtcttttcattcagtctacaatacagttcaccagtgtggagaccttttgccctgcctgatttgttttgttttgttttactcactcttttcaatgacttttggttttggccagtatgaagagtaatggatgttggaataccttctgccagttaaaaa

SEQ ID NO: 221417 - DNA, 239 bp, Homo sapiens
tagttcccctttaaaggctcaatctttaagcctttcaggtagtgcaaattttattcatcattagaaacttagtctggattttttatagttacttattacgcaggtatttctttctagatcattgtgccagacaatgggaagtatggctctctcagagcctgcattcaaggataagaaggtaccaacttaaatttgtaccaatgagtcaaaagtgttcgtttaacactgtgtgtcccact

SEQ ID NO: 221418 - DNA, 466 bp, Homo sapiens
tcagtaggttgattatagttaacattaatctaatatacatttcaaaatagctagaagacagaatttaaatgttcctagtaaaaagtaaagataaatagttaatgtggtggatactccaaataacctgctttgatctttacacattatatgaatgtatcaaattatcacaagtacccccaaagtatgtacatctattatggatcaataaaaaataagtaaatataaatagatttataaaaatatatgaggctaatatcagtaaagataagtcttataaagggatttataacaagataatgtttacatatacattatgcatacagacaaatacacattttcaaaccactcaataaatcttctcagtacaaactcctttgttttttgttttgttttgttttgttttgttttttgttttgagacggagtcttgctctatcacccaggctggagtgcagtggtgcaatctt

SEQ ID NO: 221419 - DNA, 590 bp, Homo sapiens
agtttagaggttttgcttaccacagattatacagtaacggccagatgaagaggagaaatcttgaaacgtggctgaatttggatgagtgggtatggaaaaaggtggtatgatataaaaaaaaaagctgtaaatattttgattgggaggattctgaataaaataatattttaggctatcccttggttgaaatggaggaacaataggagatatagttggagataaggaaatgcaaggccaggtactgtgggctttcactcctcgttctggaatagttagaaggactaataaacattaatgtggctccaagcatcagatgaatctactgctttccccatcgaacttacaggatataccttgtgaagactagcatggatataaatgacagtggttcagaaacacttcctaagtttgtcacataggtgatgagttgactttttgacaaactttagggatggaaataaagggctctgatactgctagtattcatgccacaaaaatgggactgtgactctctgtggaacccagagggcaactgggactcaggctagcaatgtggtcactgacatctatgtaattgtttcttctcttct

SEQ ID NO: 221420 - DNA, 464 bp, Homo sapiens
cagtgaggcttatcctgccaccttttaaaatattgtcatcatcctacagtgctttccttctctgtaacaataccttctaacatactgtatttatttacttatcatatgtacttatttactgtttattgtctccttcctatcattctatgctttgtgaaagtggatgtcttcgttttgttcactaatgtatctcaagtgtatggaaagtgcctggtgcatcctaggcactcagtaaatatttgttgagtggcagtaggtcttagctgtaaagaggtggagtacagaaattcagagtgactccatgaaagaaaaaagaatgactccaagcttttttaggctggataatgcctttaacttaatgagtaatttggcacgaggattaaggggagacgaattctggtttaagcatgttgagtttgaggtgaaggtagccaaataaaattgctcagtagtcagcaaagatt

SEQ ID NO: 221421 - DNA, 376 bp, Homo sapiens
agttgtttgggaacctttattagacaaatacaagattgtcaattgagtttagttttaatagaagattaggaaattctaaaatgaaatggttttcttttttttaagatggagtctcgctccagcctgggtgacacagtgagaccctgtctcaaaaagggaaaaaaaaaagcagctgttactctttccccttccatctgccgcagatggagttttgcttttgttgcccaggctggaatgcaatggtgtgatcttggctcatggtaacctctgcctcccaggagaatcacctgaatctgggaggcggaggttgcagtgagccgagatcccatcagtcactccagcctctgtgacaagagcgagactccgtctaaaaaaa

SEQ ID NO: 221422 - DNA, 517 bp, Homo sapiens
cttcattagacaagtgaccatcacctattctggtagatcagaaaacagagtcaaagaaaaacttaaaaactaggttgatcccagcatacctttcataacaaagctgtctaagtcacttgaaatccaagtcttaaattcctaagagaacgtaccctgaatttcatgttatatctgacatatactcttcctctatccatttattttttaaaggggttaagcccccttttagtgcatgcgtgaaatattaggagaatttaaaccaggactaatattcaatggcagagtcaaaacagggatgcctcacagcttctactcaggagaacagggtatcccttcatggaaacactaatgtcaacagacttatttacatataaacacgtccgtgaagaatatttttcaaagatttgaagcatattctcacaaaattctgaagtcctttagacattttcctgtctctgctaaaagaaaggtcacacaattatttcataatcgtgatttaagctgaagttctggcatg

SEQ ID NO: 221423 - DNA, 501 bp, Homo sapiens
atctgtattgatgagatattgatctttagttttctcatcttgtgatggctttgtctggttttggtattggagtaatactggcttcacaatgaattgggaagtgttccttcttttttttttttttttttttttaaaaccagtttttgtaaattctgtaaatgtttgaagtgatctggtccagggcttttatttgtgagaaatttttcatttctaatttagtctttttactttttataggtctgttcaaattcttaatttcttcttgatgagtcgattttgataatttgtttctttttaggaatttgtctgtgtcatctcagtcatctaatttgttgatgtacagttgttaacagtattctcttatcctttttatttctgaaaggttggtgtaattgctcccttttgaattcttgaatttagttatttgtgttttccctcttctttttttgattagctaaaagtttgttagttttgttgatcttttcaaagggccaatttttg

SEQ ID NO: 221424 - DNA, 413 bp, Homo sapiens
agtgctcagcaggcagaactgtcacactgcgcacctgggacctgactggaagcaaagagaagctattcttcagaacccagcaaaacaccttccttggactttataggcacctcagtgtttgctgactgagccaggcaactgatcaacatatttcattattttcctgaagaattaccactaccctttgaggtgaacccctaagctgggatggactgtcgcatggccgtcggtgcctgtgtctccccgtctccaagcctcctctctccctcccagtgccccgtcatcttcatcccactagaagcccaagcctcttctagtgaccctacattctcagagccccgaagcagagaacagaagctgcttctacagccgctccagacccagaggccagacctcacttgtgagctgtttac

SEQ ID NO: 221425 - DNA, 307 bp, Homo sapiens
gtgtcaggaagagatccttcagtcatgggagaacctttcttggccgagttcgtagtcagagggagatgtgactacagaagaatggttggacacgtgcaacactgtgggctttacagaggaaggaaggggacatgagccaaggaactctggcagcctctagaagctaaaaaaggtaatcaggaagtctcctaggataaggttattatattcaagtcctgccaaaaaatgtaagaaaagaagctcctatttgagtggaccaaaaagaacaattatacctcctaaaaataaaatgaacctaagctaagaa

SEQ ID NO: 221426 - DNA, 124 bp, Homo sapiens
tcgtggctgcacagtgatgttctgatgtctataacatatagttatcagttcagtgtacttggcacgtctctcatcttcaacatttatcacttctttgggttgggagattcaatatccatctgac

SEQ ID NO: 221427 - DNA, 422 bp, Homo sapiens
ttgggagttgttactagaaaaatagtcaactaaagagtccattcatagggtcaagctacagaagaagaaatattcaaagtataaaaatatgacttaatatttctaaatatcacataagggtccagaccaggcactttggagtagacaagcttagatagatcccagacttttccacagtgactagtcatgtgactttaagaaagtaactgagcttctctaggcctcagtttcctcatctgtgaaatgggactaagaggatctcctgcataggtctgatgaggaaggagataaagcattgaaactatttagcatggtgtctggctctcaataaactttgctaatattaattttctccttaaaaggacaatattgggtcattttatcaaatcctcccaccaaacgcaatacatagatcttataag

SEQ ID NO: 221428 - DNA, 425 bp, Homo sapiens
gagagttaaagattttgtgatatacttgtttgcttaattacgaggaaagccgcaaatgttttaaatataaatttaacctactatgcttttcttgggtttggtgaccacagtaacattttaggaattttaaaatccttgggccatcaaagtttcacacagtgactgaagccatagtttgggactcagtatactaaagagtaagttctcatcacttatgcatttgaaatgttaaagactttattttgaatgcactgaggcatattaaaaataaaatggaattttttatgctagagatacagccaaggagttatgttcaatgtcattttgaatttttcccaaatctgaggagggaatccctcaggtaacatttgaaacattttgagcacttgtatttctaaaagaggtacttaaaataaacaaccaaa

SEQ ID NO: 221429 - DNA, 410 bp, Homo sapiens
ataagaagtatttgtgaagaatatatgaataaacctgtgacatcttactgagagatataaaggaaggtttcaataaatgagatgtctttctttctcatttttgtaatatgaaaaaattgttctaagttctatttgaaaggataaatcagcaaaaatacctagcaatttttgacaaaacatgggaaatgaatgtctgactgaaccaattattaaaatgttttataattctacaatagcgtgaagaattatgcggcctaatgttgacattggactaagtatgagagaagaaacaaactgctcaggcacagacccaacttaaagaaaaattgtgtatgttttaaataaaaccaagcaaattaatagtgaagtaatagattattcagcttctatgctaaaataggtaaacagtt

SEQ ID NO: 221430 - DNA, 337 bp, Homo sapiens
tagacttgtgtcaagttctgtgttgtgtcaagtttgaaagtactgcctttgcagtagcctggaagaagtcaaaatctagtggatggtcttaattagattgaagttctttgactcttaacttcatgaccagaccaccaaatactacaggtagtattatcagttaatactatttgctgcagtaaactgaattaagctagcttaattaaaaagaggacttggctaggcacaatggctaatgcctaatctcagcattttgggaagctgaagcaggagaattcatttgagcctgggagtttgagaccaacccaggcaacttagtgagaccttgtctctacta

SEQ ID NO: 221431 - DNA, 523 bp, Homo sapiens
atttttgtatttttagtagagacggggtttcaccatgttggccaggctggtctcaaactcctgatctcaggtgatccacctgcctcagcctcccaaagtgctgggattacaggcgtgagccactgtgcccagccacatgtgcgtgtttgtgtatattgcgtactggtggggattgggcttctgtcatacctatcacccaaatagtgaacattgtactcaggtagcatttcaacccttgccccccctcccactcacccccttttggagtgcccagtgtttgctatttccatctttatgtccataggtacccattatttagctcccacttataagtgagaacatgtgctatttgattttctgtttccgaggttaggataattacctcaagctccatccatgtggctgcaaagcacatgatttcattgtattttatgactgctcatgtatattatttcagcctccaaaattttgtatgttatttataatgatataaattatgtggttttatcgtgtaaaaaaaaaa

SEQ ID NO: 221432 - DNA, 664 bp, Homo sapiens
tcatcttttgactatcatttttaaactcccacttgaaataaattgctctgatttttaattactcttgtatttaaaaagctttaattcttcactgttatctaaattacactcttaattttaaattccaagccttttacctctaactacaatgtagttttatattttactgttcccccacttacacattctagattctgccccatcacatatgtacgttattccctgaacatgtctgccttttcctagtcttgtgttttaatcatgctcttctacccgtagcttcatgaagatgacattttcatgttatctcccatgtctttccaacaagaagaaatgtctccttccttggaatccctcagcagtttttctctcggacatgtcactttttctctctgctttttttggtagttacttgtaaacttgacatttttcatcaccagagtaaatttatggagtgcagagttgatgtcttaaatttgtatcccatggtgagtcaggcacagtgttggcatttaggaagtactctagaaattctttttttgcactgaattatatttgaaagtagaaaccaatattggcttcaaggaaaatgcagatctctgctaactaaaactttattatccagggcaaaagagacttgattttgcctgcctgccgtgttgta

SEQ ID NO: 221433 - DNA, 508 bp, Homo sapiens
cacacatggggttaaagggcagaagaggaactggaagagcccaaagcctgtgtaaagttggatttaggaatctggagcatagagtagaatcacaatcaccttggacttataagaaataattcaaagactttatagaatcagtctctagtcccagaattttatgtttttaccatgttcgtggctcatgctttcttgatttctggcatcctgtctgatttctgagtttgggctagctagagtcttgtttgtctatcttcttgatgcccaataagatcagcccctttactgtgcctggatttctatatccagcattacctaaatccaactttacacaggctttgggctcttccagttcctcttctgccctttaaccccatgtgtgccccagaaccatccacaaggagatgccaagaatagagaagatgaacaacaacaacaacaaaacagaactgcagcccttctgtatgcttcagtctctagcaggctcagcccaagccactaccgatcc

SEQ ID NO: 221434 - DNA, 426 bp, Homo sapiens
tctttctgctctttgctctggtcccagggaagcaggtcctttcactcctttccttcccgggcttgtgcatgctgggtcaggccccatctcacggagactgcttatcttttcaggtaccagagcaatgaggaagcaggacccagacccctgactcctaactccaggtgaagcccaccctgagctcaggagcagagctgcctccatcgggtgtggagagacagagcctcctccccagccatgcctcctcatcggcccacgggagctgctgtgactctgacccctgtacctggctctgtcgaccggaatagtcagtgggcagccagcacacctttgggtgctctgtatgagtgggattttctcctgattagacattttaaaagattgtcaacaaaaagaacaaactctgtaaaatattggagagattta

SEQ ID NO: 221435 - DNA, 594 bp, Homo sapiens
agcaatattccgccagcttcatttcatgcagtgagtggaacaagagtcagaacaccagggcggctgagcctatcgatcaagcctccacctaatgacagacatacttgagtcccacagtcataaggaggatgaagtctctctctggctggacctggactgcagtcacactctaagagctcctctttctacacctctgccagtgggcgttcggtcagagacaagctatggcaccggctcccggacgcacgggaggactcctaccagggacagagtccgcacaggtaccagagcaatgaggaagcaggacccagacccctgactcctaactccaggtgaagcccaccctgagctcaggagcagagctgcctccatcgggtgtggagagacagagcctcctccccagccatgcctcctcatcggcccacgggagctgctgtgactctgacccctgtacctggctctgtcgaccggaatagtcagtgggcagccagcacacctttgggtgctctgtatgagtgggattttctcctgattagacattttaaaagattgtcaacaaaaagaacaaactctgtaaaatattggagagattta

SEQ ID NO: 221436 - DNA, 537 bp, Homo sapiens
gactccagaggatctcgattttgacgcgtctccctaaagtgctagggttataggcgtgagccacttcgcctagccacaaagcagtctttaaacttgatggtttaaaaaaaaaaagtcttactccatattacaggcagaaataagcacagtagtgggcagaggctatgaaggtccccaaaccagagctccattttaacaagaaagagcaccacccatgctaaattatcaaaggcataaagctggtttacaaaataaagacagtaatagtatttggtgactgaaactatcaaagctcctctgaaataagacctgtacaagatcccaagcatgctgacaataggatgcttaagctgagaagatcttctatatttaagaatccataactcagcggaggttgcagtgagccgagattgcaccattgcactccagcctgggcaacagagcatgggaagacagaagttaaaggcattaagtataaacaatacattgattttttttttcttttgaggaattttgctaaaggagagcaaggagctg

SEQ ID NO: 221437 - DNA, 530 bp, Homo sapiens
attctgaaacttttctgtgagattggatctttcctaaaacatacacaagagatgtagaaatagttaatataaaccttgtcatttactgagagctgctgaaaacataatcattattgacaactaagttcaagtaaaaccataattaaaatttgggggattcttcttgctatggacattaattgataaatttggactttagttatatgtgtatataaatgaggtagtccacatagcatagagattatagtaaccagcttgatagcttcttaatatagaaaggtcttcatagacaataaatttcatatggtctattttcttttttggtcctaattaagaagtgtcattttagagagagggagaaggaagaaagagggcaaattaatttatgctaagcaacaggactaggctgcttgctttttgtacactgataaaaatacattaaatccaagagagaacctaaatgtaaaaattctgactcttacttgggaaaatttgacattagagcaatctattcatggaatttgagacct

SEQ ID NO: 221438 - DNA, 557 bp, Homo sapiens
acacaactcaaaaagttaactaaaaatcattgaatgatatactaaaaatgggtaaattttgtgatacataaagtatacctcaataaagtcgtttttaaaaaattgatgaaggccgggcatggtggttcatgccctgtaatcccagcacttttgagaggctgaggtgggcagatcacctgagctcaggagttcgagaccagcctggccaacatggccatctctactaaaaatacaaaatttaactgggtgtggtgggaggctgaggtaggaaaatcacttgaacccaggaggtagaggttgcagtgagccaagatcgtgccattgcaccccagcctgggcaacagagtgagactgtatctcaaaaacaaaaacaaaacacacatagggaattaccggggagtggcatagcagagttgagagcatggaccctggagtcaggcggacaggatggagttcaggcttagccctgatcagcaagttccttagcttcttcaagcctaggtttcctcatctatagaatgagggcagtaagaccttccttccttgtattactgacc

SEQ ID NO: 221439 - DNA, 806 bp, Homo sapiens
tttttttttcctggcagctccatcatcttggggtttgtatagaactttcctttactagaagtactgacaggaaaaattttaaaatcataatattgtttatcttcattttgatttggggaacttcttgtgtatttcccaagactgttgtgccctctatgtaggaaaagcattggccaagggtgaaaaaaaaaaaaaaaagtgtgttctaactcccagtgcctgacattgggaaagacacttcctctcttgaggctgcagtttcccaaactgttaaatagagtttctaagctagatgatttcccaggcacccttctaactctgaagtcctataaacctaaatcccagataccgcttttattcaaaggaatagcttgcctgcatttttaacaccgccttactgcacccccagttgaaaagaaaacaagaaaagatgggctaggggatcttgagttgcataaccatcatgctgtaatccttatccatctgtagagatttgtcaatcaacagtgtggctggggtttgctattcatgagagcagctttccttgctgaaaacaagctataaataagaaagaatggtgaaggaaaggaaagagctgaggatgtgaggtaaacagtagaatatttggcttttgaagttgtttatgtaggtagataaatatgcagagataaacagggacaggtacaaacccatagggatgaagagtataaacatcgatttcatcaacaggcacccactggctcagctaaaaataagtgcctcattacaggagcagacacagaaagaggggtccgagccgattgtaa

SEQ ID NO: 221440 - DNA, 446 bp, Homo sapiens
ggtttgctattcatgagagcagctttccttgctgaaaacaagctataaataagaaagaatggtgaaggaaaggaaagagctgaggatgtgaggtaaacagtagaatatttggcttttgaagttgtttatgtaggtagataaatatgcagagataaacagggacaggtacaaacccatagggatgaagagtataaacatcgatttcatcaacaggcacccactggctcagctaaaaataagtgcctcattacaggagcagacacagaaagtcattcactcacacacctcttcctggatgacaatgatttacagacaagttccaggaatatatctcaatgaatgtgaaaattctgaccctcgcctattacaggctgaaacagacagatgctaagtcaggctgtatgtaacttacacagacatgccatcaggtatacaaacacacaccg

SEQ ID NO: 221441 - DNA, 433 bp, Homo sapiens
acattatattcaagcattccacaagtatttgtcaggcacttaggatctaggtgcaggaaaagtaaaaataaacaccacaggcgatcatacttgagtatgtgacaacagataaaaattttaaaaaataataaattaaacaatacaggcaaggtccctgctcttcagggtttacattctagttggagagaaggaaagagaaaacaaaattgaaatctagtactaatcaatgctatgattttttttttaaagtgatttttaaaagaaactgagagctattcagactacatggtcaggaaaggcctttctacaatgttgtcatttcagctgtactagatggacagacataagaaggggtaaggataggggagaatattccagacaaaaggagtaactgcaaaggccctaaaacaggaaaagacattggcactttaaa

SEQ ID NO: 221442 - DNA, 707 bp, Homo sapiens
tgcagaccatctgagtcccctttccttgctctacaagcatttaatgagcacctcctattggccagccctgaactggcggccagggatccagcaatcaacacaacaggatcagccaggcccggtgactcatgcctataatcccagcactttgagaggctgaggcgggcagatcacttgaggtcaggagtttgagaccagcttggccaacatggtgaaaccccatctctactaaaatacataacttagctgggtgctgtggctcacgcctgtaatcccagcagtttgggaggttgaggcgggtggatcacttgaggtcaggagttcaagaccagtctagccaacatggcaaaaccccgtctctactaaaaatacaaaaaatgagctgggcattttttgtatgaggcgggcgcctgtagtcccagctactcaggaggcacgagaatcacttgagcccgggaggtggaggttgcaatgagctgagatggcaccactgcactccagcctgggcgacagagcgagactctgcctcaaaaacaaacaaacatacaacacagtaggctcactgctgctgtgaaagttcacagtctgttgggagatggctaagtaacaggtggtcatggtgccaaaggagaagtggggcaggtgtccaaaggaagggtggggagggcttcccaaaagacgtggcttctaaactgtgtcccaggagg

SEQ ID NO: 221443 - DNA, 391 bp, Homo sapiens
tcgacagcaagctctgtccagctgctatttttatgtattatcttactttaaaaaaatactatcagtccaaaagtagggcagacagagcaatgcttctgcaagagcacatttgggaaaatctgttaattaataaatagttaagccacatgcaccggatttgtagtattgaaacagatgctctatcttaaaaatgttttaatacagtagatgcagcagtcctgagagtaattgtctcctgtaacacacagaagaatatctccaggaataagaaaatggtaaatggcatcactgatctctttcttaccttttatcatcagctatttctatcactttatcagtgaatgttcagggtctcacctgaattaacagagcagccctgtgtgctgattgt

SEQ ID NO: 221444 - DNA, 1114 bp, Homo sapiens
agcaacccactctctgtgctatgacttcattactctttcccagcccagccctggcaagccccttacgaagtctcaggctacctggatgaccaccctttcttatgatgctgcaaggagggcaggtggcagagccccgtgcatcctgggctcaggccagggacccaagagcttgggagaagctggttctcagactgaaggccagagcccagcaccttgtcaccatcctggggagcatcatggcacacaacaaccagagccaaggtgattgggcttgggggctcaggaggaggcagaaaagagagaagagctcaatatgggcctgaagatgtgcagctgcattcgttattgttcagctaagatgcattgagctctgcgtggggcactgtgctaggcactcagataccatcccacttcactgagatcctgatgctatctcctcctgcctgggggagttcatccctgactcaaaccttgttttatgtacccagtggtgccaaaaggactgggtcttaggtattagcaagagtaggacagaagtataagaccctctggcgtgagccaccgcacccggccaggtgaaaaaaatttatccaactttctcaaatccaggaaatgggaaaaactggcctttttctgacattcacctctcgccaccaccagtagttaataagaaacctggtgacctgagcaaaatatatttctaaccaatatcattttttttcatctagcaaacatttaagcctagtaagtgctgttcattttgctgttaccaataatacaccttacaatagcagctactagttcttgaattcttcttggtaggtcctacattaacactggcaaggattatctcatgttatctttacttgtgtggtagagactataattgtgtccagttgccaaatgaggaaagcaaggcttggagaggttccattacatttgccgtgggcatatagccagtagctgatgtgtagatcagggatttaaacacaatgctgtctgtgctgggccttcaggagggtgggtgagtatatgtggctgaacagtgcatgctgggtacatgggagggagccacatgctgcaggggagggagagcgggtgcagtgtgactttg

SEQ ID NO: 221445 - DNA, 368 bp, Homo sapiens
aaagtcacacagcaatccaagaggtactttaaatcttccccacctctttcccctccagaagaggaaacatttcttaagtaccaaacaatataattagtaccattaccaaaactggaatagtagaaatatttaattcattcaaatgtgcctctggtgattttgtaaatactgaggtattcatttcctacctactgcaaatctgtgaattctaccctggacaaaaggtcatccaaacatgatccttgttcagagttatggaaatgtatgcagcctaaaagaaaatgggccaaatgcagggtaaaaatatccatgtaactcccagtgccatttactcttgctgcctcaaatccttttcgaaattaggcagg

SEQ ID NO: 221446 - DNA, 373 bp, Homo sapiens
atatacaattctctttctagtgatgagtaactgtttactcctactctttgttaagacctcagggtatgtatgttcagtattccatggtaaggaagtctgaattcgatggaggatcacatgggtttcttttttatttttttccctctaatgaatcttgaatgacatttctttttctttaagagcattttccctacttattaaagcaataagttcttgtggaaaagtgcttaacataacagtttcacggccagctttcccttccagctgataacatcgcagagaaagacgaacacaaggcttggaaatttgggactaaatgctaacatgattttttagataaaaatgaatagtaataaaagaagtttgaaatttt

SEQ ID NO: 221447 - DNA, 611 bp, Homo sapiens
caccgctgggcctgcaggttctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgatttttcagatacagacaataa

SEQ ID NO: 221448 - DNA, 992 bp, Homo sapiens
caccgctgggcctgcaggttctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgatttttcagatacagacaataa

SEQ ID NO: 221449 - DNA, 275 bp, Homo sapiens
ggcatcagctaagtctggaacctgaggacacgtggttctaaaccaagctggcccttgggcagggagggtctgacggggtctgggctgctctgggatggcgggtggcacttcatgggggagggtgccggcacagcgaaggcttctgtcctgggatatggtggccttctgggtccttgcacggggagcctgtgggtgtggggggcccaggctgaccccagctgcattggtttcccagggctgctggaacaaacaccgcaaacggggtggctacaaac

SEQ ID NO: 221450 - DNA, 376 bp, Homo sapiens
tgttttaaaacaaaggaaatgttgtgccatatttagaaaaattgctggtttttaattctactgaaaagtatttttaattggcaattacataatatatacatcttcatttgaatggacgcaaatcgcactctgagtattgcaggaattttatagaaatattgcctgcatgttaacaggatgttaagggtttacagcttttttagaagtcagggaaaacaaaccctatacacgatgagaagattgtgcagcgacaatgagaaacaaacaagtaaacacagacgaagcacagacaacggagcgagacactgtgagatattttacaatttcaggacctcaaagataaactgctcctaccaatgctcaaataaaaggtgct

SEQ ID NO: 221451 - DNA, 137 bp, Homo sapiens
tcccaccattgcgctccagcctggtgacaagaaaaaaaactgtcttaaaaaaaaagaaactgggaggtggaggttgcagtgagcttagatttcaccgctgcactccagcctgaataacagaggtgagactctgtctc

SEQ ID NO: 221452 - DNA, 528 bp, Homo sapiens
ccaaggacaggacttctccttatctttctatactgaatatctgccattatccttcaccctgttgtactgtgaatgcttgagatagtgctgtcattcccccggttcttgtggaccactaccaggccattacggttcccattttgctgtgaaaaaaccttcctcttttccagctcataccatttgtatttaccacctcttctcctttttcattttccttcaactacaagtgatatctgcggttgaagtccacagtcttcctttcctccatcatgatgtgtgacttgcatatgttgcttgactcatgttttctgaccttctggagtctaatggtcttcattcactctacttccttagggcacattcagggttataccctggatcttattatatcctagaatttttccctccttggctgggcgcagtggctcacacctgtaatcccagtgctttgggaagccaaggtcagaatatggtttgagcccaggagttcaagccagcttgggcaacacagcaagaccctgtctctgt

SEQ ID NO: 221453 - DNA, 1243 bp, Homo sapiens
aagcctcaccccccatccccacctccccactccccacctgtctgagctggaatgagaagggcagcttagcaaaaggccaaggtagatgagctcaccatctaccaagagcagtgtggggcctgcttgcagggttaactttccaagttgaagccagacacccccaaactagagaatcaccccacatacaaacagcaggaccagaccttggtatctgtgttcccccaaccccaacaaataatggcaaaacctaagccagcactgcaatgaatgttggccatttaggtaagtgtccccttattgtggggtttcatgtatgtttccacctcccccaccaggctgtgagcaccagaagggagagctgggcctgtcttggtcacccctgggtcctcagagcccagcacgtagatgggctctccactgatgttcgtcgaatgaatacatgaaaatatcttgtatctctgtattcccaccacccagagcaaactgtagccctgatccaaatgaattgctgagcccctcaacgtgagacttttccttacctggaaaacatggaaaattcaccctaacactgatgatgatgaaagaatgagtgttgggctgaggcctgatgaatgagtgaatgaatcaatcaatcgatcaatcaattgaaagaaggaacaggttcttgctacatatgaagaggcccagagaggttaagggatgtgcccaaagtcacacagcaaagaaggaggccacctggaagtgaagggtcaccctcaccccatactcttccttggggccattttacctacgaggctgagggcacagggcccacaaactcttttcaaggggccccaaaattttcaaacctgaaaaaaaaacttgattccagtccaggcgcagtggctcatgcctgtaatcccagcactttgggaggcccagtgggtggatcagttgagcttaagagttccagatgagcctggacaacatagtaagaccccatcgctacaaaaaaattaattaattaatttaaaatagagaaaggatttgaatagacatttctccaaagaagatatatgaacagccaaaaagcccatgaaaagatgcttaacatcattagttattagggaaatgcaaataaaaaccacaatgagatattactttataagcatcagaatgactattatcagggaggaggaggctgggtgtggtggctcactctgtaatcccccagcacttcaggaggctgaggtgagaggatcac

SEQ ID NO: 221454 - DNA, 484 bp, Homo sapiens
ctggcattcctctttatagtgcagcccaaggactgatgctcataatgatgttcgtgagtaattaagaaaagataaaagcgaatggaatgaactctgcctaatgataatggcaattgtcagaacataggcttccctcaagaactcaaaatcgcactctgggagccattttaagatctgaaaagagatacctaataagttgtgccagagaaatcaataaataaagtcaccagaggggggaaaaagaccctcaaaccagcaggacttgattagataaaatatcttttaaaacaatcagtatatttggaattttcttcaggctaatatgggagataagggaagtgaagtgtgggtgtagataaaaccagactgaccacatgtggataaggatttcagctgggtgatgagtacgagttcatgatcttatatgtgtgtttttatatgtttttgaaatctccacaataaaaaattacaaaaaaagtttaaa

SEQ ID NO: 221455 - DNA, 502 bp, Homo sapiens
agcccagacatactccttagtatttaaataaacatctgttaagctccaggccatgttcaacgttggaattgttatgatcaattttaaaaagttagttttcctacaccaaacagcttacagtcttaatgaggaaatgttttagcatttattaattcaggaaacatttctggcactgtgctaataactatataagaaaatcattgtaagatataaagaccagatatagtccctgccctcaacctatacacttgaaactattggaaactattgaaactattagacaaaatggccacggtcatttagtgcataattaacacaccatgccttgttgttcttgctcaattgccttattcctgtgtcaacatcagcttcaaaaaagtgtattcaatgcaacaagaaacttcaaaatcacagttttgtaaaacggcagattatgttaaatgagtgaacctgtatattgtatttgttttctattgctgtcctaacaaattatcacaaactt

SEQ ID NO: 221456 - DNA, 412 bp, Homo sapiens
cagatcacttgagcccaggagttcaagaccagcctgggcaatatggtgaaaccctgtctctacaaaaaatacaaaatttagcccagctgtggtggcatgtgcctgtagtagtagctactccagagcctgaagtgtgaggattgcttgagcctgggaggtcaaggctgcagtcagctgtgatcatgccactgcactccagcctgggcgacagaaggagactctgtcttaaaaaacaaacaaagcagaaggaacaaatatggctggacctaggtgagagttatatccatatcaaaagatgactgtagaaggtgtctttaaaatggcttgacctattaacacatccctagacccttcagcaatgcgtgacaatgacctggctatgagataagtgatggttattacctagatacat

SEQ ID NO: 221457 - DNA, 466 bp, Homo sapiens
aagctgatagcactttctggctggattcctgcagtatcttcctaattataatctctgactttactccttttcctgtctgttctccatgctgtggcagagataccctctttcaatacaggtatgggtctcctgtctcctgtcttccagcccttttcatccttggcccctagacctacctagaagcagcacacttagctctgcctggggcagaggtggcaaactctgatgaatttagaggccaggcagctgatacagttgagggagtcaaagggagatgacatggcccatgataaatcggagtgtatgtccacttaagggcattaaaatttaaaattagttaaaatgatttcctgggcaagcaaaacatggctgtgggctaaaacaaggtagccagtttgagactggggataaagggtggattttagtaaaagatgaattaaaataaatatataattcttatactgag

SEQ ID NO: 221458 - DNA, 1340 bp, Homo sapiens
ccagaacattctcatgccccccaaaggaaatcccatccccagttactccccatccctccacccccagcccctggcaaccactattctgcttcctgcctctatgatttgcctgttctggacatttcagatcaatggagtcagacactgtcgccttttgtgtctggtaagcattgtttttaagtgacagtgatatctcagtgtcatcaggaatctgggcagtggctcaattctgtctcacaatgtcaaaaatgtgttttttcttatttccataattaaatacacaaccagcattatgactggttgatgtgtcttgtaagaattcttggctgagcgcaatggctcatgcctgtaatcccagcactttgggaagccgaggcgggaggatcgcttgagcccaagagttgtagaccagcctgggcaacatagtgagtccctcatctctacaaaaaaattgaaaatctagctggttgtggtggtttgtgcctgtagtcccagctgcttgggaggctgaggtgggaggattgcttgagcccaggaggtcaaggctgctgtcagccgtgattgtgccagtgtactctagcctgggcaacagagcaagcccctatctcaaaaaaataaaaaaaagaaaagaaaagaaaagaaaatatttcatctgtaggtgccttttctctttctgtctgtctctcttccctcttggaatttatttattacagaaattgagatagtgtccagaccaggtttgactcttaacatttggggctggatcattccctggggtgggacgtgtcctgtgcattgtagcatatatttagcaacatccctggcctccctgcaccagatgccagtagcagtccccttcccccaagttgtgacaattaaaaaaatgtgtctagatgttgctagtgtccctgggggacagaatggtccccgcttgagaatcgctggtctatatattttatcggcttcaaactcaacttttttggcaaagattccttatgggtggtgtggtgtcctcccactgggaagcccgtcatgtctgatggtctctctttgtccttgacacaccatcttgcattggttactacttactgtctcctgggccttggaagctcattctgtcagtttcctagaagtggaatttctgtgtcaaataaggcaccagctgaacattgagaggctttttaagaaatagaggatgggaaattagctaggcatggtgggcgcctatagtcccagttatttgggaggctgaggcgggagaatcctgtgaacccaggaggtggaggttgcagtgagccgagatcgcaccactgcactccagcctgggtgacaagagtgag

SEQ ID NO: 221459 - DNA, 763 bp, Homo sapiens
ccagaacattctcatgccccccaaaggaaatcccatccccagttactccccatccctccacccccagcccctggcaaccactattctgcttcctgcctctatgatttgcctgttctggacatttcagatcaatggagtcagacactgtcgccttttgtgtctggtaagcattgtttttaagtgacagtgatatctcagtgtcatcaggaatctgggcagtggctcaattctgtctcacaatgtcaaaaatgtgttttttcttatttccataattaaatacacaaccagcattatgactggttgatgtgtcttgtaagaattcttggctgagcgcaatggctcatgcctgtaatcccagcactttgggaagccgaggcgggaggatcgcttgagcccaagagttgtagaccagcctgggcaacatagtgagtccctcatctctacaaaaaaattgaaaatctagctggttgtggtggtttgtgcctgtagtcccagctgcttgggaggctgaggtgggaggattgcttgagcccaggaggtcaaggctgctgtcagccgtgattgtgccagtgtactctagcctgggcaacagagcaagcccctatctcaaaaaaataaaaaaaagaaaagaaaagaaaagaaaatatttcatctgtaggtgccttttctctttctgtctgtctctcttccctcttggaatttatttattacacctggggggggacgggccttggcattgacatatatttagaacaccccggcc

SEQ ID NO: 221460 - DNA, 481 bp, Homo sapiens
cccattctgaaccccctctccaacatcacagggaatcccgtgatagctggtgtggcccagccatgtttctgagtagtcacgtggtttggggtgttcaggagaagcaggatccagtcatctcagtcagacctaagacacagagttaaccttgcccctggatagagatccacagcacaggaggggtaagtgagtcagttagattcaaaaatcattaatgatgcaccaaattaagtgataataaaaaattgcaaccatttgttatcataaagtgccaaatatcatgttaaatgctttttatacactttctcctttaatttgctcaactgcactgtgaaataagtactcctattatccctgttttctagatgggattctttgctgcacagagcagtaaagtaacttgcccgagattacacagcttgtagtaagtagctgctataccacaagcttctggagggtagaatcatcatatgcccagtgc

SEQ ID NO: 221461 - DNA, 492 bp, Homo sapiens
atggtgagttctttttgttttatggcacttttggcacatgatcagccaattggaagacacacagccaacttaaaaatcagacataacttcacctcctgtcagggcagtgtggtcaagaccaacactgcatagccttagccaaaactttagagaaagggtgatgaagaaaaccacacagaggctgtgaggctactagaaaagtctgtcctggtcgggagtgatgcctcatgcctgtaatttctgcactttgggaggctaaggcaggaggatcactggaggccagcagtttgagaccagcctggccaacatggaaaaacctcatctctactgaaaatacaaaagttagccaagtatggtggtgcatacttatagtctcagctacttaggaggcaaaggcatgaaaatcacttgaactcaggaggtggaggttgcagtgagttgagatcacgcagctgtactccagcctgggcgacagagcaacactctgtctca

SEQ ID NO: 221462 - DNA, 373 bp, Homo sapiens
gtggtctcatttctctgacctgatagctaagctaatggaaccaattctcattgtctaacatggacttgaacactagcaaaagctcaacattaaataagatattgaattaggaaaaaaagagggggaagtatggggccagtcaacaaaggaatgtgaaaaataatttcaaggaggcttggatagttgcctgccttctccagaacagtgggattaaaggacttcaaagttcaacttctgccccaaactgtccagatacacctaaactcatagaagcagagttctcttccagggagagaaggttcaactgcaacttatgtagacctgatgaacctatttgactggtctaagatgcttagatctaatggtgtgttcc

SEQ ID NO: 221463 - DNA, 252 bp, Homo sapiens
taggtgggacctttacaaggtcatgacggctctgcaatcatgaatagatcagtgatgttactgcaggagtaggttcgttattctgagagtgggattgttaggaaaaaaagttgggtcctcttgctgtatctcctgtactctcttgttatgtgatgccttcagccacaggatgaagcagccagaaggtcctcacaagaagcagccacttccagcctcaagaactatgagccaaataaattgccatgttttata

SEQ ID NO: 221464 - DNA, 403 bp, Homo sapiens
gaagccattggatgagtttgaggcagaggaactgacatgatctgatagcatcacactggttacttactgtgtagagagtagatacacaaaagttgagcaagagtggaagctggcagaccagacagaagctattgaaattattcaagtggaattaaatagtcaaatagcagtgtcagagatgagacatatttggattccagataaattctgaagttggagacaataggatttcccactggattagctattttgcgtaagagaaagacaagttaaaatgatcccaatatcccaatatattaatatctagctttaacaatgagagaggtgaaattactattaaatgatatgtggaaatggaatagcaagtttgggggtcaggagtggaaatcagtattgattttgg

SEQ ID NO: 221465 - DNA, 548 bp, Homo sapiens
  misc_feature (41)..(41): n is a, c, g, or t
ctctcgaggagttaagtttacagcgcagggggcagggcatntcccagccctctgacctggcgtccaggccagcacctgtgcaggacagggttcaggaaaggagaagtcagggggctgtacccacctcagggaagaagaacgtaagaggccttcgacgaggcagtagttttcctagcttcaggggttgttactcagccagtttgaaaaaataaatgtggtcagaacattatctcccacatcgggctgcgaccttccatcgggtcataatcttctccttggccgggcacacagcctgcctgactctgtctaccgtctgtggtcagcgcacgtgagaagttggaatagtttggaacttagaggaccctgcgtgtcacgtgggaaacggggaactgtcttctccctccttgggcttccagtgtgttgtccttcctcctggcccctgacccactgtcttcccatacacacaggtgaagacacacctctcacatcacactcaggtacactgtgtcttgaagacacacgtgtggggctgtatagtctctgtttct

SEQ ID NO: 221466 - DNA, 669 bp, Homo sapiens
ccctcaggaaagaggaaatgggagacgaggggaggtgagggaaggttcataaggagagagtccagagggagaaaatgagaccccaggcagggacaaggggtgctagagagaacccagagagccaggagccaggagggtggaagggggcatgcaggggccaagtcccagccctctgacctggcgtccaggccagcacctgtgcaggacagggttcaggaaaggagaagtcagggggctgtacccacctcagggaagaagaacgtaagaggccttcgacgaggcagtagttttcctagcttcaggggttgttactcagccagtttgaaaaaataaatgtggtcagaacattatctcccacatcgggctgcgaccttccatcgggtcataatcttctccttggccgggcacacagcctgcctgactctgtctaccgtctgtggtcagcgcacgtgagaagttggaatagtttggaacttagaggaccctgcgtgtcacgtgggaaacggggaactgtcttctccctccttgggcttccagtgtgttgtccttcctcctggcccctgacccactgtcttcccatacacacaggtgaagacacacctctcacatcacactcaggtacactgtgtcttgaagacacacgtgtggggctgtatagtctctgtttct

SEQ ID NO: 221467 - DNA, 570 bp, Homo sapiens
gtatttgtgaaatctgtgaattattcagtatattaccaaatgtatcttgacactttattccactctttttttttcctgtctataatcattgtccctaatttcccatttataatctatatgactataattcttaatcctggctgcataataaaatctccagaagagcttttaaaaaagtgtgccacacctcacccaagccaattaagtcagactttctagaggttaaggcttgagcatgtgtatttttttgaaagctctctgggagattctaatgtgcaccataattgagaagcctggtttataactactattggatactcaactttttcatgatttgtaattaaagtggtagcatcttcctacatacatttgttctttctaaaatgaaattttcaactaacacatcttcctgtctctattcaaagaggtttctactaatggatttgggggtatgatgtatctgtataagttccaagtttgatttcccctcttcagaacttgaagggtaattttgactcattgcataactcataattattattattcttttgtacatttgtagaattttta

SEQ ID NO: 221468 - DNA, 368 bp, Homo sapiens
cttaaacagggtatttgtacctatcacatgttcttcttccttaatgcttgtatttttgtaaggtgaacacaggcctttaaaacacattagttaaaaatgatgatcacaagtctcccaatcttctcttggaaggtatagaaggtctcaggtctcatttaaaggatagacctgacatctggcataaaagatattgtcatatggaccttgagcctgccattgtccacaaagggaagggccaggccacatgctggaagctggcactaacacatatgtgagaaaattaattgcttgggcaatttgctctctttggctctggtgactaggttgggaattaaataaccacagttctctgagtcaaggaacggggg

SEQ ID NO: 221469 - DNA, 537 bp, Homo sapiens
atataatctcccagaatcatattttgaatactgtcttgattaaacaccagagcaaggggagggaggatgcagccctgctctctttggctgagcctgctggtgcccacagacagctggactgtgaactctgcaaagtaaatgttggtaaatgcagaaagttgaggttctcaggtttgtaggatgtatacaagctggacctccaaactccttctatggctaaagtggcccttccctcagctgcacagcaaccaggggctaggccctctggaggtgaggagaagccacccaggggagctcccccccacccccagcacacccagtgtcttccttatctctttcctgccagtgtcactagatggacactggattcattagatgatctctgtgatcacttctagttttaagattctatgatcctgttaatgataataagaacttctagagcccttaccatgtgtcagactcaatgccatgtgtcttagtctgtttggactgctattttacagagtaccataaattgagtgtctcataaaaaac

SEQ ID NO: 221470 - DNA, 270 bp, Homo sapiens
tgctggaattagaggcatgaaccaccacacccggccacctagaaggttttttaaacatatgagccacaccccacacactgtgcaggcaaaaaagtggaaagcctatcacagtgaacacctttgtcctctagagtcagtaattataaacattgttacagttcttttctttctcttctttttttcctgaccactgggagttgcagatatcatgacactgcatccttaacgacttcagtaggcatctggcgaaatcagggccttctcccgcat

SEQ ID NO: 221471 - DNA, 432 bp, Homo sapiens
cagtagaatggacataaattcgaatgtatttatgtgtggactattatacagcaatgagaataagcatattagaactatacacaacaacatggatgaatctcatgagcatgaagttagggaacttaagaagccagctacaaagagcacatgctgtgttatttcatgtacataaagttcaaaaacaggcagcactaacctatggcattaaaagccaagaaagtcaaaagatacccttggggtggtggtgacaggaagcagcatgagggtccttctgtgttggtgacattctctttcttcaagagctcgctatgtgggtggtttgctttgtaaaaattcagcaatgtgtacagttgtgtacatttttaatgtatacttttatatgttttaaccttcaaaaagtgaaacaaatataaaacttcatgtgttcaaatt

SEQ ID NO: 221472 - DNA, 436 bp, Homo sapiens
aaggacgcttattaccataatttttgaggggggaaggacaatggttggaaatgctttgtatagccacatcttagaatattaggtgactaggaaaaaggattaagatctgaaaccactgcctcgaagggatgataaatgcgcaagacaagaagcagcaagatgagaggaatacccatcaggatcccacattctaaaaactaggttgaaacttcaagcacatttgcatttgtacatgactacttcctagtgacgagagcaacctgttgaatcaagcttagcctaaagctgcctccttccatgttttgaatgtggcctcaaggtttttctgtacctcatgaactataacaagtggaggtataaacagaccgtagcctactcttgtgccaatcactgagttttggccaatccaatatagctgactgttcaaaccatgttc

SEQ ID NO: 221473 - DNA, 520 bp, Homo sapiens
catgtccaggattaaggccacacagctctcctaggagaccctcaggatggcttttctctgtggcagctgctcgtgtttgatttgcaggccgctaatacaaatccactgtttagtgacgagggagtacttgccttactagtaagtaaccctccttgagcccgtggtatgttctagttctgggctgcgtgcttcaattgcactgtgtcatctggctcctgagcctggagctggactcccattttacagacaagcaaacagaggtggcaagagggtcccatagctagtaaggtgccaagacaggactgtgacccaggcatgtcagacttcaaaacacacgactgcaagctgtgctgggaaatgattgctctggggaggacactgtcctcaggctcctgtggatgactgacaggaagtccagggccacctccaggctcccggttgccacttgtctctttctggtacaggtgaatcagtgatggctttggggactccctcaacgcttaggtgtcctcttctctca

SEQ ID NO: 221474 - DNA, 359 bp, Homo sapiens
tcttggaacaaccctcccggctcagtgctcataaaacacacagatacccaagcataagactacagttgtgactgaaatctattttgtaaaagatgcacttctatgctctgataggtagcatagagagatagcagcatgagaagtgatcggcctgacattgctggctttggagactgaggcaggaagccacaagctaaggaagtgggtaacctctggaagctgcaaaagacgagggaatggattctctagcagaccattcagaaggaacctagcactgctgacaccttaatttttgcccagtaagacccatttcagactctgaactacagaataataaagtaacaaatgtgtattgtttc

SEQ ID NO: 221475 - DNA, 457 bp, Homo sapiens
  misc_feature (427)..(427): n is a, c, g, or t
gacggccgtagatagagcacgaccgaccgctcatttacttggctcagtgcttaattatataccttctattgttctttgataatgtcttatgtgttagtcttctcttaacaaccagataataacctgttaaaggcagggtccatggaaattaaatgctatggattgaatgtacaatactttcttggtgaccactcaagtatggagatcaggaacagacatgtaagacatgttgtggtttattagtgagttttactatataatgaagagcaaggcaagtgtttctttgacaaaaaaaaaaaaaggggggaattttggggtaaaattaaaaaaacttttgggggggcccaattaaaatggcgggcccaaaaaggaattaaacctttggtaaaaaaattttaggctttaataaaaaggcttcccttggggnaggaaaaagagaaaaaaaggtttttttttt

SEQ ID NO: 221476 - DNA, 498 bp, Homo sapiens
  misc_feature (468)..(468): n is a, c, g, or t
gtgaataggtgagttactataacccattacctgatgtgtcctttccagaactactgaatttataatcggcaccatttacttggctcagtgcttaattatataccttctattgttctttgataatgtcttatgtgttagtcttctcttaacaaccagataataacctgttaaaggcagggtccatggaaattaaatgctatggattgaatgtacaatactttcttggtgaccactcaagtatggagatcaggaacagacatgtaagacatgttgtggtttattagtgagttttactatataatgaagagcaaggcaagtgtttctttgacaaaaaaaaaaaaaggggggaattttggggtaaaattaaaaaaacttttgggggggcccaattaaaatggcgggcccaaaaaggaattaaacctttggtaaaaaaattttaggctttaataaaaaggcttcccttggggnaggaaaaagagaaaaaaaggtttttttttt

SEQ ID NO: 221477 - DNA, 132 bp, Homo sapiens
tgctgggattacaggtgtgagccaccgcgcctggcccaataattgctttctttatcacagtagttctaagcatttttcccagtatgactaatgatgtttatgcgcatctttgtgcacatgtcatctcagcta

SEQ ID NO: 221478 - DNA, 1329 bp, Homo sapiens
gagagagagagagagagagagagactgagacagagagagatagagtgagagagagctctgacggccatcgtgggtgcctggcttgaccacattcttacccatgggattcggttcagcctgcagggagcgctgcagctcaaacaagactttggagtggtcagggagttgctggaagaggagcagtggagcctgtcccctgatctccgccagaccctgctcatgctcagcatcttccagcagctggatggggccctgctgtgtctgttgcagcagcccctgcccaagtctcaagtccacaggaggcccccctgttgctgtgcttgtcaggaggtccagaccacgaaattgcccagcagctgcctcaatagcctggagagcttggagcccccgctccagcctggaacatctccagcccagacaggtcagctgcaaagcacactaggaggaaggggacctagcccggagggctacctggtgggaaatcagcaggcctggcttgccctcaggcaacaccagcgaccccgttggcacctgccgtttttttcctgcctgggaaccagtcctgaatcctaaggagcctgggaccaggagccagaaagttaagagctccccatctctagctggaaaatccagacatttggaattgcatattaaggaagcccagaactggaagcttggaggaaagcatactggagaataagctacaaagagcctgggcttaagaatccaagattaggggctgggcgaggtggctcacgcctgtaatccagcactttgggagaccgaggcaggcggatcatgaggtcaggagatcaagaccatcctggctaacacggtgaaaccctgtttccactaaaaatacaaaaaattagccgggcgtggtggcgggtgcctgtagtcccagctactcgggaggctgaggcaggagaatggtgtgaacctgggaggcggagcttgcagtgagctgagatccagccacagcactccagcctgggtgacagagcaagactctgtctcaaaaaaaaaaaaaaaaaaaatccaagattaggcagggcatggtggctcacacctataatcccagcactttgggaggctgaggcaggcggatcacctgaggtcgggagttccagaccagcctgaccaacatggagaaaccccgtctctactaaaaatacaaaattagccaggtgtggtggcgcatgcctgtaaccccagctactcaggaggctgaggcaggagaatcgcttgaacctaggaggcgaaggttgcggagagccgagattgtgccattgcactccagcctgggcaacaagggcaaaacttcgtctc

SEQ ID NO: 221479 - DNA, 1579 bp, Homo sapiens
gtcataaacaagccatgcaaggtttcaagctctacatgccacggggtcggtactggcggcttcgtctctgtcctgaacctcccagtgctcctagtgagtatgctggtttagtggtccgcaccgtactggagcctgtgttgcaaggattgcaagggttgccacctcaagcccaggcccctgcccttggtcaggctctgacggccatcgtgggtgcctggcttgaccacattcttacccatgggattcggttcagcctgcagggagcgctgcagctcaaacaagactttggagtggtcagggagttgctggaagaggagcagtggagcctgtcccctgatctccgccagaccctgctcatgctcagcatcttccagcagctggatggggccctgctgtgtctgttgcagcagcccctgcccaagtctcaagtccacaggaggcccccctgttgctgtgagttactccccttcgctcactgctttgtgtgtcccaaaccctattctcaccattaatctggcttcagtatatccccagcagccacctaccttccactcctgccttaccaggtgcttgtcaggaggtccagaccacgaaattgcccagcagctgcctcaatagcctggagagcttggagcccccgctccagcctggaacatctccagcccagacaggtcagctgcaaagcacactaggaggaaggggacctagcccggagggctacctggtgggaaatcagcaggcctggcttgccctcaggcaacaccagcgaccccgttggcacctgccgtttttttcctgcctgggaaccagtcctgaatcctaaggagcctgggaccaggagccagaaagttaagagctccccatctctagctggaaaatccagacatttggaattgcatattaaggaagcccagaactggaagcttggaggaaagcatactggagaataagctacaaagagcctgggcttaagaatccaagattaggggctgggcgaggtggctcacgcctgtaatccagcactttgggagaccgaggcaggcggatcatgaggtcaggagatcaagaccatcctggctaacacggtgaaaccctgtttccactaaaaatacaaaaaattagccgggcgtggtggcgggtgcctgtagtcccagctactcgggaggctgaggcaggagaatggtgtgaacctgggaggcggagcttgcagtgagctgagatccagccacagcactccagcctgggtgacagagcaagactctgtctcaaaaaaaaaaaaaaaaaaaatccaagattaggcagggcatggtggctcacacctataatcccagcactttgggaggctgaggcaggcggatcacctgaggtcgggagttccagaccagcctgaccaacatggagaaaccccgtctctactaaaaatacaaaattagccaggtgtggtggcgcatgcctgtaaccccagctactcaggaggctgaggcaggagaatcgcttgaacctaggaggcgaaggttgcggagagccgagattgtgccattgcactccagcctgggcaacaagggcaaaacttcgtctc

SEQ ID NO: 221480 - DNA, 1466 bp, Homo sapiens
gtcataaacaagccatgcaaggtttcaagctctacatgccacggggtcggtactggcggcttcgtctctgtcctgaacctcccagtgctcctagtgagtatgctggtttagtggtccgcaccgtactggagcctgtgttgcaaggattgcaagggttgccacctcaagcccaggcccctgcccttggtcaggctctgacggccatcgtgggtgcctggcttgaccacattcttacccatgggattcggttcagcctgcagggagcgctgcagctcaaacaagactttggagtggtcagggagttgctggaagaggagcagtggagcctgtcccctgatctccgccagaccctgctcatgctcagcatcttccagcagctggatggggccctgctgtgtctgttgcagcagcccctgcccaagtctcaagtccacaggaggcccccctgttgctgtgcttgtcaggaggtccagaccacgaaattgcccagcagctgcctcaatagcctggagagcttggagcccccgctccagcctggaacatctccagcccagacaggtcagctgcaaagcacactaggaggaaggggacctagcccggagggctacctggtgggaaatcagcaggcctggcttgccctcaggcaacaccagcgaccccgttggcacctgccgtttttttcctgcctgggaaccagtcctgaatcctaaggagcctgggaccaggagccagaaagttaagagctccccatctctagctggaaaatccagacatttggaattgcatattaaggaagcccagaactggaagcttggaggaaagcatactggagaataagctacaaagagcctgggcttaagaatccaagattaggggctgggcgaggtggctcacgcctgtaatccagcactttgggagaccgaggcaggcggatcatgaggtcaggagatcaagaccatcctggctaacacggtgaaaccctgtttccactaaaaatacaaaaaattagccgggcgtggtggcgggtgcctgtagtcccagctactcgggaggctgaggcaggagaatggtgtgaacctgggaggcggagcttgcagtgagctgagatccagccacagcactccagcctgggtgacagagcaagactctgtctcaaaaaaaaaaaaaaaaaaaatccaagattaggcagggcatggtggctcacacctataatcccagcactttgggaggctgaggcaggcggatcacctgaggtcgggagttccagaccagcctgaccaacatggagaaaccccgtctctactaaaaatacaaaattagccaggtgtggtggcgcatgcctgtaaccccagctactcaggaggctgaggcaggagaatcgcttgaacctaggaggcgaaggttgcggagagccgagattgtgccattgcactccagcctgggcaacaagggcaaaacttcgtctc

SEQ ID NO: 221481 - DNA, 575 bp, Homo sapiens
ctgtattacccacaggagacataaaaataaattaagtaccaaatctgctttagaaaatctctcatttctattatggaaagtagactctaaaaataccaataggatatagtcataatgccattataaatgtgtatgcagaatattgtggaagcatgattaaaaaattagtaaattcaaggagaggtgagaaatgttaactgataaactgggctttgaagaatgggtaagaatttatcctataaacgagaaagggaacgacagttaacagaaggaacagacagggccataaaaacacacagcttgttctgaaaagaatgaatactcttatagaacaggagcatgtgatcagttgaaggaaatggttggtaatgaaactgaaaatgaagcctggagccaggttacaaactttctttgatgacttgttgagaaaagtataccttatcctgtaaccaaatttgggctgggggagcagtgtttggagaaggtcgggggagtggggcacagaggtttttaagccagaggtggtacaacagggtagatgttttaggaaggttgttctgatatcaggataaagt

SEQ ID NO: 221482 - DNA, 377 bp, Homo sapiens
atattgtcaggaggccgggaacacaccacctcattgacagctgaaggaagcaagagaatcagcctaggttttgcctgtaataggaaaaagggtcttcttttgctcccatcagtgattctgcatactttttgtgaatggaaacatgcattttttggagactcagttagagggggaaaagggagaggttgagaagggaacacccttggttttatgggggacatcttcttcacgtacctcctctcccttcctcctccttgcccctgcccagaagaaagtgcccgggggaggtgacatcttctgcagtcagggaggcaggcttggctggggcccagccgctctgcccttagaagcagccacccctccttacgaaggtgcag

SEQ ID NO: 221483 - DNA, 349 bp, Homo sapiens
ctattgagtaatacacaattctgccgatccgacactaacacatctaggaggctgtcctatgccatattactatccatcctcatcctagcaataatccccatcctccatatatccatagacaacaaagcatagtattgtcgcccactaagccaatcacttgtatagactcctagcccaccacctcatctgcctcatctgcacctctttcactggggtcactcttctgctccaaacccatcaatgggtttggatgccctttgaatgaatacccaacatcctacagggccttcctgaccaggcctgtgccaatccccctccaaagcccctcacacactacctcagcctcaaa

SEQ ID NO: 221484 - DNA, 558 bp, Homo sapiens
ctctcaggcttgctttgtaagactcctggactccttaggttttatcaatcctggtgcccttccattgtatcacatccttggatcacagtgatgggttcaggaatagacacatgacccaagggaggctaatcaggtgaatatagggagatgttctttctttcttaaggtggctacgtttaggacatgagccagggttgccagtgtcacccatcacatgtaccatatgaataactcttgtctaagatctggcaagagatggtggagcctaatgacattgttaaagatcctggatacagccatacctgaagcgtatccagaattccggctgagtatctgtactagtcaatgttctccaaataatatacacaggcataactcagagatactgtaggtttggttgcaggccacctcaataaaacaaatattgcaataaagtgggtcataggaatttttgatttcccagtgcacgtaaaagttacactatagtgtattaagtgtgcaataccattacatctaaaaaccactgtacataccttaattaaaaatactttattgcta

SEQ ID NO: 221485 - DNA, 613 bp, Homo sapiens
ctctcaggcttgctttgtaagactcctggactccttaggttttatcaatcctggtgcccttccattgtatcacatccttggatcacagtgatgggttcaggaatagacacatgacccaagggaggctaatcaggtgaatatagggagatgttctttctttcttaaggtggctacgtttaggacatgagccagggttgccagtgtcacccatcacatgtaccatatgaataactcttgtctaagatctggcaagagatggtggagcctaatgacattgttaaagatcctggatacagccatacctgaagcgtatccagaattccggctgagtatctgtactagtcaatgttctccaaataatatacacaggcataactcagagatactgtaggtttggttgcaggccacctcaataaaacaaatattgcaataaagtgggtcataggaatttttgatttcccagtgcacgtaaaagttacactatagtgtattaagtgtgcaataccattacatctaaaaaccactgtacataccttaattaaaaatactttattgctagcaatcatctgagccttctgcaaattgtaatctttttgctcgtggagggtcatgc

SEQ ID NO: 221486 - DNA, 322 bp, Homo sapiens
tgaggaaactgaagctgagagggagaatgtgccttgctcaagggcacacagagtaatggcagagccaggactcaagtccaggcacatgaaataatgttcttgatcttaacccctagcctgggatggtgcaggctgaacggtgagctccagcacatcagcaattactatatgtaaggaaaaaggagtagcttagcagcaggaatgaagcccaagaaaaatactccaagttgccttccaagattgaagcaatgatatctgagaccctattggttctcttcttctggagaacgctaatagagaggctctgtccacgcagaaatga

SEQ ID NO: 221487 - DNA, 219 bp, Homo sapiens
catcagtttttagctgctttccaatctgaactgaaaaactcagctctcctgggtctctctggtttgttgactgcagatcttggagcttagcagcctccataatcatgagtcaattccttaaatacatcccgatctctctctctcttcccccacgcagaccctattggttctcttcttctggagaacgctaatagagaggctctgtccacgcagaaatga

SEQ ID NO: 221488 - DNA, 717 bp, Homo sapiens
  misc_feature (48)..(48): n is a, c, g, or t
  misc_feature (50)..(50): n is a, c, g, or t
atgagcctggcccggatttacgcacgtcctcttcgtaggactcacagntncataaccacgtgatgggtgatcgtgggttcccatgtctcctcctccctggtcctcagacctcttcgtaggactcacagtccactaaccacgtgatgggtgatcgtgggttcccatgtctcctcctccctggtcctcagacctcttcgtaggactcacagtccactaaccacgtgatgggtgatcgtgggttcccatgtctcctcctccctggtcctcagacctcttcgtaggactcacagtccactaaccacgtgatgggtgatcgtgggttcccatgtctcctcctccctggtcctcagacctcttcgtaggactcacagtccacttagcctcccgtcctccatcgctacccaccagtagggtcctgtacccttggggacagctgcacttgtgttgacgggacaccgtgtgaggagtggtgctggctgtacctcagcagctggggcccaccttttttgtgacacgccacagcctcctgtgtgttttgcatgacacgctgtgttgtaatttctttgtgcacagtcttcaggcctcaccacgtgctactggagtaacacccgtgtcagttatggagcctcacacagcagatgtgtctagtaaatactgtgaatagcgtatactgtgttttgcttttgttttctttagtaatgaggtctcgttatgttg

SEQ ID NO: 221489 - DNA, 1247 bp, Homo sapiens
gctggtgtgtataagtggttttttttttaaaacaaatcagaagacataaaattgaaaaggcactccatttatatatgagggaaaatagattgtaaatagctaaggggccttgtgagaacttggaaaatgtgctgatacttagtaactacctcagttgtgaggaatttcctttttagcttagactgctattacttttacttggtagaaatgaatctggtctccaaaatatggctcagagagttatccccatagaccttgttagattgtttttaatttaaaaccttgaactctgcccagctgttttcttccagtcaaattctctaaaccaataacattttccaaattaagtattcttgaaggttcttctgaactcttactgatttgttttctttctttgcattttttcctgttactcttttattatttaaattgtctcttgcttttgaacttcaactatgaaataaacaaatcatagatttttccattcaggtctgactggataactcttggcttctaagcagctggcaagctcacccccactccccaaaaaagaagaaaggcaagttgaatattttaaaaccttaagagtttggagtatgaagtagaataaaagccttgttaggagaagacctgacttttccaaagttaacagcatgtgaagggcttgtgttttacaaagtcatttataaattatttttctttaaaacacatcacctactctgtaccttaaagattttacaactcttagatttatattttatttcaaaaatcgtaactagcacctgttattttgattaaaagacactgcgaagaattgacgtaaatttctaaagtttagttactgagtgttcaaaacctaacagttcacatgaagtaaaaattgtcatttgtgattacagaatcaaaataaaaataggtatgaatggtgctacacaaatttctgcttcccctttgttagcagaatatgtctatttacatagctaaagggtagtaggttattaggttagtgcaaaagtaactgcagtttttgccattactttcaatggcaaaatactaacagttatctactagaggagggtgtgtgtgtgtgtgtgtgcgtgtgcacgcacacgcgcatgcacatgtaatgtcactgctaagccaaatgtaactttctaccttttttgaaacaacaacaaagtactcaaaattcttctgactttgaacttcatgggaaaaaatataactgcataccgtgatacacttca

SEQ ID NO: 221490 - DNA, 607 bp, Homo sapiens
ccctcatgattacctcaaagtgggctaaaaaatataaaagagagagagagtcccagccctgaaagagttcataatctagataggcgggtagataaggaaacaaacaaattataaatctgtgaaatcaaagacatttcacagaatcaaacaaaacagtgtgggagtgaaaaaagtggcaattaaccaactgcctttgccttgcagagtcaaagagaattcactgagagatgatatttaaactggttctcaaaagataaaaccactaaggtgcaaaactacctggtatatataagaaagggtgaaaagctcagtgtgttaagaactttggataaacagtgtgcatggctaggaaaaaaaagcatttactaagttagagaatctggatttttctgtaagctctgagtcaaaacctttttttaaatacgttttctttaaaataaaataagtctggtaaacagtgtgggagatacatttttgtgtcaggaggctaattagagaaatgttaacattgattcaatggaaaagcaagatatgatagtttaacacaataggaagaaggagggaatggactgaaagatatttgaggtcaaattgaggtaatctggtg

SEQ ID NO: 221491 - DNA, 317 bp, Homo sapiens
aggctcatattctcaccactctataaccagcagaaaaagctggtttgtctagcttcgagatgaaaaaccctaggggaagaattcagtgatttatactggctcattacccattccttagaccagtccctgtggtcaaggaaacattaggtactgcatttagcccagctacccctgtggctggagtgagcaaagtctgttcccagaagaagactgtcacaggaagattctggacaaatatagttaccttactaaataactttgctttctttctaatttgtgtaaaatatataataaataaatccaatttttctgcagca

SEQ ID NO: 221492 - DNA, 217 bp, Homo sapiens
agtggtggtgatgatgacagtgacagtgatgctgctgttgattgtggtggtggtgatgatgtgatcagagcagcctccactacgaccaagtacttctcaagcttcaccaaatttaatacctgctctgacacttccattttacagatgagaacaccaaggcttagagaggtactgggacatctcaaagctacacagctagaaagtcatgggagtggga

SEQ ID NO: 221493 - DNA, 552 bp, Homo sapiens
ttcggcacgagaatgcatttgggtgaatattagcgctgaggttgtcacaggatcatagagaagtgttctcaatatatgattccttcaccagcagcatcagattcacctgggaacttagacatacggatttttggctctaccccacatccactcagccagaaactctgggggtggtgcccagcaatttgtgtttttataagcccctcagatgatttctagtgtgtactaagtgagagaaccactggcataggaaacagatgccctcactcagacttctgggttagaaaatcttcctagagtaggttgtgcctgagccgagttctgaaaaaggcattatccaagggaaaatgtggtaagtgtttaggcagaagacaactgcttttgcaagacaagaaagtgagagaaggcatggatcatgagaatgtgacaacctctgtactagacatgctacatagattacctctaattctcagcaaaacaattgaaagggtccgtgatgatttaacacaccctttagtacatcctgtagtatgacagtagagaggttaacga

SEQ ID NO: 221494 - DNA, 252 bp, Homo sapiens
tatatattagcctcactcagaaccacagggaacatactcaattgaatcacacctctatgagtagtgtataaagtgtaacattttaaaacaccagggaccagggctggcaaggtccacggggaatcctgaaggctggtttccagccacaactgtgctggaatgaaaatagaaaacaatgaggcatgtgcagagtcagcttttctttgtgtcacagctcagcagttttcctgctgtcctaaactttcctaaaaa

SEQ ID NO: 221495 - DNA, 417 bp, Homo sapiens
tctctgacgtcaacccaatcaactaccatctctgaaattccattgttatcatctactggcttcaattgctcttcctattgtgtgggaaggacaggaagacaggggacatagagctgccttcctcatatgtgtctcagtcttgggccttgccccttcccctagtcattctgtgaccactcttcacatgaacagttatgtcattcatactgtcatttggaaccagctttagaggcttctttttttctttccttgtcaaatgaaactgttatttattgttaatacaaactaatagagggtagtagtacagataaaaccaagtagattttttatatggtcaatattgtttccatttctaagggcataatagctgatcatttagaagtatcacttgtggttgattgggtgattacgattgta

SEQ ID NO: 221496 - DNA, 158 bp, Homo sapiens
ccaggaagcctagaactcaagcttgtttccaatcctactaaacatactacttccagccacctagtgcctgctctactctgtgggaactttctgtttccacacagggagttcacgagtgctgaaagtgtgatgccataagatttctttgagatggagaa

SEQ ID NO: 221497 - DNA, 349 bp, Homo sapiens
gacccccttattcctttttttaaacacacccaccgtcctcttctctacagtgttcctaattcctgacaatcactaatctgttctccatttccgtaatttttaaagtcaattttgacaaagggtatggagatagctgagagaaaaattaaacttataaagaaagaaatagtgccttttgttattgttttctcagtaaatggaattcatattctcctaaatgttaactttaagttagattgctagattatctataaatatgcatttatctgttgatattccttataagtaaaacttctttattgtttacattttcagtaaaatttctagattttaagagaaaatgttataa

SEQ ID NO: 221498 - DNA, 124 bp, Homo sapiens
aatgcccactactcccaggcttcgtgcgaggagctgtgggggatgcggtggtaagacactgccgtcccatcttctcctgtttggaggacagatttgtatgtaaataataaaaggcagtgaatta

SEQ ID NO: 221499 - DNA, 486 bp, Homo sapiens
gttttttttcccacatgtcatatttgtgaaggtttacaaaatctctagggtttacaacatctccagagttgttgtagaaagtgaagaaaactagagaaagggagatcatataaaaaactataatgaccattatccataataaatgaagtagtttaatctcaagtccaaggggcagtatagaaagtgatgggtttgaggctgggtatggtggtttgcgcctataatcccagcactttgggaggctgaagcgagagtatcacttcaggttgggagttcaataccagcctgggcaacatagcaagacccctgtctccacaaaaatagaaaattgagtgggtgtgttggtatgtacctatagtcatagctattagggaggccgaggcaggagggttgcctgagcctgggtgttcaaggttacaatgagctataattggtcccactgtacttcagcccagggtgacagagcaagataccatctctttttaa

SEQ ID NO: 221500 - DNA, 585 bp, Homo sapiens
taggagatattttatattcaaaacattttgaatacactatacttcttttagattagaaatttatatttcagtacattgcttctgagataaacttgaaataccagttaaattttaccctatttattgttagaataaaactgtcatcttagattggtcaacagatatttgctttataagcacagaaattaggctttttagacctagttattctatagaaattagtggttcagctggtttggtggctcaccatggtcatacatagactcattgttcctttggcagtccataacatgccaagctcatagttttaccccaccatgacccaagaatagcaacttgatgttctaagagaaaccaataatacagattccttgatagtgctatttataggtggtatggtttagttcatcagcataaggacaatggaaactttctataagtgaatggcatttaactgagaagatgcatccatttgagtgtgtctttcaagatgcatcttctaaactttgaagggattcagatactccctccaaagatgtactagttacctccacttaccaagtaataggctgcctacatttttta

SEQ ID NO: 221501 - DNA, 455 bp, Homo sapiens
aggaagcccaacaccaacagcaacgtagtaagtttcaagctatgcttccttcctctactggcaaatggcatgaatatgtaaagaggatatgttttatctagtcacagaaaatgtttagagtatttacaaaacaacagatatacatttttaaggccagaaaagcactgaccagtctgagaagcatcttgagaaaccgaagtcctgaagaacattctcattttcccatggattgacaaagaggagcaagagaagtatgacggtactctgatgtcttagtttaaaggaggcttaatattgatgctatataactacctacattcagaattaacagactgtaagtgctttgaaatcttgaaaaaaaggcattatgattttccatgagtagtttaatcaagatatacatgcaaattattcaacaaataaatataatagattacaaataaatatacatttgg

SEQ ID NO: 221502 - DNA, 350 bp, Homo sapiens
gcacgagaaagaaatgacagaatttgaaaatcaccattttgcaaacaccataatctaggcaatgattattgctgataatattgtaaaaatagaaacaacctttttcataattacagaatacacaataccacctttgaagtaggcttacactcaaaattgaatctgaatcttatcaatcctccagatctctgaatttagaagatacagatgcaaaacattaaataacaccacagggatgcaatcaaccaaacccagaccgctggcatatctacgggacacctgatttagtttctgcaacaaaaccaaaaatttttcctcaagggcaaattggaagtggaaacaatgtatta

SEQ ID NO: 221503 - DNA, 335 bp, Homo sapiens
aggtctctcattaccagagattgcacccacccttcaatctccatttcacctttcctgctctgcacccacacacagctcccttcatcttttagtaaacttcttgtatctccatctgaacagagactcgcaatccagtgatcacagcagctatgcacaatccttcaacttctccacttattacaaccctccttacccagcacagtctccttggaccatgagtttaatccttccctttcatattccctccactccttggaacttttcactcttcaccacgcttggatggcaaagtcccacctgggtaaaaacctgtctcctactaccccgtgcctgct

SEQ ID NO: 221504 - DNA, 466 bp, Homo sapiens
ccacctattgggtaccacattgattacccaggtaacaaaattatctgtacaccaaacccccatgacatacaatgtacctatataacaaacctgggccaggcgcagtggctcacacttgtaatccaagcactttgggaggccgaggcaggcagatcatttgaggtcaggatttccagaccagcctggacaacatggtgaaaccccatctctactgaaaatacaaaaattagctggtcgtggtggtgcacacctgtaatctcagctactcaggaggctgaggcaggagaattgtttgaacccaggagacagaagtcgtagtgagcagagatcatgccactacactccagcctaggagaccgagcaagactccatctccaaaataaataaataaaaataaataaataaaaataaataaataaaacaaaacaaaagaacctgcacatgtatccctgaacctaaaataaaa

SEQ ID NO: 221505 - DNA, 348 bp, Homo sapiens
gaccttaaacactgtacagtattttggctttatgccccctcccacctaatatcaaccttgagagagataaagctttgtctgagggggtgatttcccttttctattcaattccctcccttggagatagacacatggcatttatagtacctacttactatggaacctaatcgacattgtgttgaaatgttatgtaactcaaacacaaaagtatgcctttccagacacatcataaagtcttaaaatttatgctttctatctttactctctctactaggcccctaaacttcaactattatattatgcagacagtaggaacttaacaaatatttaagtagatgggtagctgga

SEQ ID NO: 221506 - DNA, 461 bp, Homo sapiens
gcttttggcatttctggcctggcatagtcatttaaaaccttggtttggggtctttttatttttctttccacacttcctggaatcactggtcagcttcagagccaggctgttgctctgaaagtcctgggagaggggaagagagcaagatggacgagtgcaatgaaactgtgaccctccttcctatgacggggcgagcgttatcatgctaaggccaggaattaggtattcttcatgcccagagaagacagacgagggggaagatgggacagccaggtggaagctgggagactgaaagattatagcttttaagaggatcctgtccagatttgatggcctctgaggggcctccttgttttctacatacaaagtttttctcccatgcaatattgaaatcgtgctttaaggcattcatgttaatccattctttatttcttaatttcacatcatgttccttagcctta

SEQ ID NO: 221507 - DNA, 650 bp, Homo sapiens
tgcctgacttatttctttaacgcatacctagcacttcctgtatgtccagtgccttataatattaactactatcatcctcagggctacccgtgaggtcggcactgtccccaccctttgtgcaaaggaaggatagggaggcgctgccagatgggttgagggcagaccggggcagcttgcctcaggcctccctggccttagcaggctttaagtttgatgccctgtgctccttccctaggaagctcagtttgccagttttttgctttatcttagtctcattcagattacaaggactgggactggactcctgttgccagtttctcaatttggaataggaaggaggtgaggaacaacaggcccatgctgggcagaagccctgcagaccaggccaacagtgggcctctcctcactgcctggccctgtctgtgcaccttcgtcctggccacagcctctcagagcccctcctttatgaagaggttacgctttaggggagggagtgcctctcccaagacccagagctggtgagtggctaggttggaatttgagcccaggtccctcctcccctgtctgcttcctgccaggcccagctgcctgccccagcacacgccttctcccaggcaccctggcctccactgccaggacgtgcctgtttg

SEQ ID NO: 221508 - DNA, 334 bp, Homo sapiens
taatgacttatcatttgaaaaatgctttgaagaaaatatgaaaataggtggaaatgcagaactctgcctaaagcagaaatgctaacataaaagaagtaacccactgcttttctcagactgactcgccccagccctctgttctcacccctacgtgctctgtctgatcctacctacctccgggaacaactgtgaggactaacggtgtaatctatgaagtgcacagggctccctggaaaagcatggctgttaaaagcccggatgtcatcactagaggcagctgagagaacatgccaacagtcgactgctaatataaaaatgtaaaaaagaaataaca

SEQ ID NO: 221509 - DNA, 373 bp, Homo sapiens
gagacagagtcttgctctgtcgccagcttggagtgcagtggcatgatcttggctcactgcaacctctgcctcctgggttcaagcgattcttctgcctcagcctcctgagtagctgggactacaggagcatggcaccacgcccagctaatttttgtatttttagtagagatgggttttcaccattttggccaggatggtcttgatctcttgacctcatgatccacccacctcggcctcccagagtgctgggattacaggcatgagccaccgcacccggcctcttcttttttcttttttttttaagagtttagtatgcatagggcaaaatcaaagccttgctgttactgtaccaccctcacccttcacaattctc

SEQ ID NO: 221510 - DNA, 400 bp, Homo sapiens
gaaagcggtgtcttgcaaacacaatcacattttgcttcttcatgctaaatcaagattgcagggtcattcagaagtgaaattaaatgagggaatgataacaatatgcttgagtagttttatttgtgccagtctggaaaagtatattacaccccaaagaaagaaataatagtacagctgaatgacagcatatttattgcttattgcaagaaaaaaaatgaattatttcaaagccataaaactatatttgataaatatgtttaagacaataaacataaacaaatctttgtttataatatgaccttactcaaactatagttcatccatgcttctgtgatggttagttaaagctagactctgattgaataagcaaaagagatttttcaaaggatggtaagtagtt

SEQ ID NO: 221511 - DNA, 726 bp, Homo sapiens
cgcaataagcagagacctcgggacgatgaatgacgttgctgacaaagaaaatgatttttttaattgctttaacaaaggagactgctagtctcgaaagcagacccgaactggacccttgtgcctgttcgaactgtagccttgcaaaggaatggacttactgataactggaatacgggacttcaccccaggcttgtttctcgacagcagcagcagccaatgagcattgaggacggagcctaggagaggtgcctcccctataggggaacagtgtttgggggaaatcactgcaaacgtacagctggagttttgtacctgaactttggctcccagaaggcaggaaaggaaatgaatgaagcaagctgagtatggcggggagggcccctgtgggtacacctacggagcaccttgagctcagtagggggacagtctgagttttccagaaagaacagaaatataaagtgatgattaaatctcgggatttttaatttttgagtgttgacaactaattagaacatttttaaagcaggtcaaagcacaggcaggctaactggccccacgcacaacttgcaaggtggggcgcaccaggctcactgcacagcccatacccacagacccctcagattggagtcggggcagaagcagaacgcaggactcgcaggaaacagaccaggttccaaggcccccagggtcccaaaggctggggtaactgaaggttcccacgctcag

SEQ ID NO: 221512 - DNA, 562 bp, Homo sapiens
ccggggtagcagtgctggcactccgtgggagatgggaggggctgccggagagccccaccccagaaggcagccctggcctggacccccgcccaggcacccctcgatgtcctcccttcctttgggggcagcggtaggaggctccgcctgccccttacgcacctggctcagcagaggggcacatgcctgtcccaccctcctcgtggctcccaggctccatctctgttccaagggtatttattcaagttcaggagaaggtggtgtctgacgacaaggcaggggaggaggtatctgggtttaaagtccctgaaggactcagtttgggcaaagcagatcattctttatcaagtattggagtgaaggaaactcaccagatgctgggaaagaccggctaaggaaagagcagaggtttcagaggaggaggtgcaaagggccaacaagcaaccgcttctttttttttttgagacagagtctcgctctgtcgccaggctggagtgtagtggtacgatcttggctcaccacaacctctgcctcctgcattcaagcaattctcctgcctcagcct

SEQ ID NO: 221513 - DNA, 526 bp, Homo sapiens
gaccctacccagactgatagacctacattggaattcttgggtttagagcagagaatcagtactttttcttttttctagggcatttgcctcatttttctgatgaagtagaaagaccctagcaagtctggggttttccagtagatcagaagagtgaagctttgatgtgatggaaattaccaagaaagaactcccatccccatcctgttcatgcatgtggttttcctgggctgagcttcatgtgtattgcatgccctccagtttgcatccaagtattctagcctttctgccgacatcctaaatttgcatgaaccccttctcagattccatgtccttctccttaatctggttctcttattcatgatacccaaaatctgctgtttcttcccagctccctgacctccctatctcatgttagatctgcagtttcaccccttacctctggatccttgttttattcccctagaaagtgtgagaacaacgttggtgcctaccctactgggattctgtttatttttccatgagacat

SEQ ID NO: 221514 - DNA, 751 bp, Homo sapiens
gaccctacccagactgatagacctacattggaattcttgggtttagagcagagaatcagtactttttcttttttctagggcatttgcctcatttttctgatgaagtagaaagaccctagcaagtctggggttttccagtagatcagaagagtgaagctttgatgtgatggaaattaccaagaaagaactcccatccccatcctgttcatgcatgtggttttcctgggctgagcttcatgtgtattgcatgccctccagtttgcatccaagtattctagcctttctgccgacatcctaaatttgcatgaaccccttctcagattccatgtccttctccttaatctggttctcttattcatgatacccaaaatctgctgtttcttcccagctccctgacctcccaaagtgctggtttacaggcatgagccaccacacccagctggaaaaatatcttatattttattattattattgagacagagtttcactccagcctgggtgacagagcgagactccatctcaaaaaaaaaaaggataattgcataggccaactaaacatcatagaaatatcactcctgaattctaaagttttcattgaaaaatacacaaccaagaacagtgaagaatgagtggggtgcggtggctcacatatgtaatcccagcaactctagaggctgaggcaggaggattgttgagtccaggagttcaagactagcctgtgcaacatagtgagacccccatctctccagaa

SEQ ID NO: 221515 - DNA, 1030 bp, Homo sapiens
agtccagacgcatctcctggcagcttaggaagctccatcttcacccaccccacatctgagggtcccgtgccttgtctccctccatcctcactgtacatgccaggcttcagcctgttctaactccgggcctaaattgtccctaagagagctgtaggcacacaaaggggctgggtgtctgcaggcaccactgtgagctaccgtcgccagatggtccccagggaggtgcagacagggtggttccggaggccggctggcagggctgggttcaagccccaacatccacaccagtgttgttcacagtggccccaggtgtcatctccgcagaggcctgtgatgtggccctgaccccgtaccccaacaacctccttccctgtgtcagagcccgtgtgagtaacccaatagcaggcctggggaccacagtgtggctggccccctcctctgcaggcctgggctccgggggcaggtggcccctgcatgtaacttatgttagaaatgcacaatgcttgttctctggtgccacaaagaaatagtgctcgaacattaattttctcagcaaggcagtttttactttctgcagaaagggtgcccctcgcagatggagcaatggcaagagcacacctgaacaagggaggggaaggggttcttattcctgacacaggtagccctactgctgtgttgttcccctgttggctaaggttggaccacacagtctaagccaattccaattggctattttaaagagggcagggtaagagtcagagtggtggggtgagtagtttgacgggaaggacggttaggaacaggtaactcaaggtgacttaggtcagagcaggtgaccgggatgagtcaggatggagcaggtgaccagggaacagatgtgaactactgattaggactggcgggaaaattgtttactgaaactagaagcaaggggcgaagagaaccaggaattttaaatggagaatcaaagaagagatctggccgggtgcagtgggtcacgcctgtaatcccagtactttgggaggccgag

SEQ ID NO: 221516 - DNA, 624 bp, Homo sapiens
gaaccagccaggttggtaaggacagaccaagggtaagagacagaaacctgttattttcattcacagatgtttgagtgcttgctgtgtgctggtacagacaagactttctggaagggaaacagagacagaagtcaaggtatagcatgagagacttggaaaagtcctagcagtagaaatggggtccaagaagtccttggttagtaagccttagcaattcagccttccactgggttcctctgttgcctccttgccatcatcgtttacatacatgtgaatatttagtgagtctgcagcaagcaggctactcagttcacactggaacatttgcattgatggggaagcgcagggtagcccaatcaaattccagacatgtatatttgaaattcttctttattttggattgaaaatcagctttctctcactttacccactgattctagtgctgctcccttgagcaacagataaacacagataaaatctttcatatgacagtttttcaaacatgtgaagccaggtatcatgtttaccctttgttgtttccatcataatatgcataccttgaattccaggtttttttcaggccatttagtctgttaaactagttcatgctaaacaaaacagaaa

SEQ ID NO: 221517 - DNA, 336 bp, Homo sapiens
tctttgtggagacagagtcttgcttggttggtcacccagtctggaatgcagtggtgcaatcttggctcactggagcctccacctcctgggctaaagtaatcctcccacctcagcctcctgagtagctgggacatctggggtctggcaccacacctggctaatttctgtaattttagtggagacagggtttcgccctgtttctctggctggtctcaaaatcctgggctcaagtgattcgcctctcttagcctcccaaagtgctaggattttagggatgagccactgcaccccacttcaattgtcgtattttaaaattatttttgaaaatgtgttcta

SEQ ID NO: 221518 - DNA, 460 bp, Homo sapiens
tagaactgtggacctacgggcacttggcgtctgatagaatcattggaggaatcatggactatttagtaaatggtgctgggaagcttgactcttcatgtgggatcatttaggaatgctcatttttaactaaaggtggcttaaaccagagcttgttaaatttgaatgtgcacgaggataacctgggtcttgttaaattgtagattctgattcagtacatctggggcagggtctgattctgcagttctaatgagatcccagttcttggcgatgttgctactctgtgaattgcactttgattaacaagctcttaaatcatcagaatattaagtgctcatttaacaaagagttggtctctgggatattctgggagctcagtgacagcagcagaaatccaggtgccttttatctttctgcttggtggcacaggttgactttttgttttaatatttgtgaccttatt

SEQ ID NO: 221519 - DNA, 583 bp, Homo sapiens
tggcttctgggtgatggaggagggaggtgagagaggacccgggttgtgaactcctttcctggggattctcctcggctacctgtgtctttgatcaggaatgagaagcctggtccaggctacagacctagggtggggagggaggacgtgtggacaaggacgatgaagattcaggtgagggatcacagcacttgagagtccaagctgccacctgagcctgctcctctcctaagccttccatctgctgtgtctgtgaaacccagcttttctccccaccccatttgcttataggcaccatgatctggggtgaaaacactcactaactcaacattttcttgtttaatttattttttttattttatttaaaaaaatttttttttgagatggaatctcgctgtgttgcccaggctggggtgcagtggcacaatctcggctcactgcaatctctgcctcctggattccagagattctcctgcctcagcctcctgagtagctgggactacaggcatgtgccaccacgcccagctaatttttttgtatttttagtagagacggggtttcaccgtgttcacaggatggtctccat

SEQ ID NO: 221520 - DNA, 224 bp, Homo sapiens
tctgagttttagatcatactaaggatgttggacttcatcctgtggtgttactggaaccataaagactctggaaacaaagactcatggcatggtcagatctgcacttaggagcagagtggaggaaggatttatggctgcaaaaacagtaggaaggtcagcttgaaaaatactgaaggaccctctcagttgaaagatggcaaggcactggcatggggggaaagaac

SEQ ID NO: 221521 - DNA, 814 bp, Homo sapiens
taaaatattctcccagttttcgtgcacagacagatttgggaattactgttataatggaaaatggagaataaccacccacatttaatatggttattggttttgttcttgagatttattgctaagattcatgatagcccaggcaaggtcagataatgtatttttattttacactgtatagttgattcttctcaatcccactagatcagactctttgggatactaggattggcctatttgatggtgagctcactacatccatttagatgttgtgtccatgcaatcattttagttctcctagtttctacctatcacgttgtcattttcccttctttatcatcctgggtagctgagaccccacataaatatataccagaaaaatgttgtggtcttttctaaactctctgaggcatctgttgtcaatgtgatgttgttttttgtttccagtccaaaatatatcaaagtaaaatttaactccacttttgctaagtattcatcttgccttgagtactaagattccaaaaatgactttcccctctgaaaaacacaggatttccttgcgaaaacttgctgggccactgccaatcttcccagaaactcctttttccttatcgttgaggggaattggggaagtgatcactgacggttgaaattcagtagttttggtctttaagctgagaccctgagtcttctgaggagtctactgctccccagtgggaaacacctgctgtcaaaattttcctgcttgcaaagagcacttttgaaattaatggcaggggatgaatatctggctagtgctgtgctcagctgagttatt

SEQ ID NO: 221522 - DNA, 818 bp, Homo sapiens
tccctgtggttcgctgcgctgacagtttttgggaattgctggttatggtggcaaccatggagtgagtagcctgccgctttttatgtggttatgggttaagtccttgcacgatccgtgctgggatgcgtggtcgcccaggcaacgttctgctcgtgtctgtgtattgtgtagcgactgtgtccttgattcttctcaatcccactagatcagactctttgggatactaggattggcctatttgatggtgagctcactacatccatttagatgttgtgtccatgcaatcattttagttctcctagtttctacctatcacgttgtcattttcccttctttatcatcctgggtagctgagaccccacataaatatataccagaaaaatgttgtggtcttttctaaactctctgaggcatctgttgtcaatgtgatgttgttttttgtttccagtccaaaatatatcaaagtaaaatttaactccacttttgctaagtattcatcttgccttgagtactaagattccaaaaatgactttcccctctgaaaaacacaggatttccttgcgaaaacttgctgggccactgccaatcttcccagaaactcctttttccttatcgttgaggggaattggggaagtgatcactgacggttgaaattcagtagttttggtctttaagctgagaccctgagtcttctgaggagtctactgctccccagtgggaaacacctgctgtcaaaattttcctgcttgcaaagagcacttttgaaattaatggcaggggatgaatatctggctagtgctgtgctcagctgagttatt

SEQ ID NO: 221523 - DNA, 1050 bp, Homo sapiens
gcctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggttgctgctgagaaggcagtgaccaaggaggaatttccagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaaacatcagtttctaaaaaaaaaaaagaaaaaaagaaagtgg

SEQ ID NO: 221524 - DNA, 379 bp, Homo sapiens
tgagacagagtcttgctctgttgcctaggctggagtgcagtggtgcaatctcaactcactgcaacctctgcctcctgggttcaagccattctcctgcttcagcctcctgagtagctgggactacaggtgcccgccaccgcgcccggctaatttttcattgttttagtagagacagggtttcacagcgttagccaggatggtctcgatctcctgaccttgagatccgcccgccttggcctcccaaagtgctgggattacaggcatgagccaccgcgtctggccaaaattagtgatttttaaggccctttcctggtctaagctcttcaaggtgataacccagttaatatcacctccattttgctcaaggggagccaggctg

SEQ ID NO: 221525 - DNA, 340 bp, Homo sapiens
agtgagccgagattgtaccactgcactccagcctgggtgacaagagtgaaactctgtctccaaataataattaaagaaagataataattccaatggactgctgaaggaataacacaaggagcttacctttacctaccttgaaacctctctcaaaggagattgttgaaaacatttaaagacaaatgaactatccacaagtgtctggggaaaagcatatgagtagtggtaaatgatggacacgctgacatgtcttggaagaaaggctgtggagtgagatatttgggacatatgactttgaaaatttctcacgtattcctgggaatgtagaggtgaagctctg

SEQ ID NO: 221526 - DNA, 487 bp, Homo sapiens
ctgcacagagccatacagctaactagttacagataagatttaaacacattccgtttgacagtaaaatttgcactcttaaccattaggctgtactacttagaaacatttgcctgttaatatgtatctcatgcaataacaaaaaataaatcccgagtatctccaagtaaatttccacttggcttgaagaatctagcttccctttccaatgtacaagcagtgggtctggtttgcagagatgcaacctgcatggtgttcttgaagctggtcattgtgaggcagatgagagcctctgctttctttccaaagagtgggtgtaacagcaacagaaaaaaatggcatcacaacagagctgcttcttacattcttggattagattgactttgtaatatgttatgaccaagagagggaggctgaaagttatgctgtttttgagataatgcagtaaactggaatgcttaagtgcttatcagggaaattacttaccaaa

SEQ ID NO: 221527 - DNA, 487 bp, Homo sapiens
agtgagtgggagcggccagtgagggtgctcaggtggggtgggcagcaccatctctgagccctgaagctaatgctcctgctcctgggacatggaccccagactcgcccccttcgccctcttctcttctaatctgggctttctcggtccccaggagcacttggtagactcaaggttggaaattgtgccctaaaccgtgccagaccctggctttctccaaaggtggaaaatgggagccctactatttgccggagtgtggttgctatgccttgggtactggcgccagactgtctgagttccaatcttaccatccccattcaggcaagttacctaacctttctgggcctctatttcctcatctataaaatgggatgaaagttataatacctacctgccaggattgttgagatgattaatgcaataatttacatgaagcattttgcacagtggctggcacatagtaagaactcaataaatgttcactactata

SEQ ID NO: 221528 - DNA, 461 bp, Homo sapiens
agaaccagggggctcaaggaccagaaaaaggaatgtttgaccttggttttgccacatgtactagtcccacccagaagccattcctcccactccctcaccttcactgcagtcaaagaaagtatcattaaagagagtcaaacagaaagaaagaaaagaataaggcaaccatgtgagtaagtgattgggacagaacaagaggccagcaaaaaggaaagaggcgggtctggggctggacagtggctgccaaggccaagtggagaaacgaggccatttctcgactcctcagccctgcctccagtctcctggggtgggtggcaaagctagctactctggagcctgcgcctccacgggctccagtccctttaccaccggagacctgggtcagcccagagacgccaagaggcctgaggagcagccaaagagaacctgaaagccttcgagaagagggacagaaaaagaga

SEQ ID NO: 221529 - DNA, 463 bp, Homo sapiens
tcagcccaaaacataacatggaaacatatttccaaagaaaaggctttgagacagtggaaccatttgggtgccatttaaatttaaagaaggaaatagaagaaaaagaagatcaaagatggagactccaagtcttggcaattgattgaacgtgaagtcctgtgaagaccaaaggctccccactctggtgattagaatgaggggctattggctggagaaggaatctactaactagtgaggtaccaacagaatggagacccaaactaggacatttaaaacctgggatttttcttcacgggattgcatgttttctgaatcagtcattctgtttgacaccaaaagtagcttttattgctttccccaccatgggcccttgatttaaaaggcttcatctaccaaacactctcttttgctaaataagaatatttccccatttttattcattaaagtccttttgatcagtgtc

SEQ ID NO: 221530 - DNA, 398 bp, Homo sapiens
tgagccagggtcttgctctgtcaccaggctggagtgcagtggcgcaatctcagctcactgcaacctctgacactccctggttcaagcgattctcctgtctcagtctccggagaagctgggattacaggcatgtaccatcatgcccagctaattttcatgtttagtagagacggggtttcaccattggccatgatggtcctgatcttttgaccttgtgatctgcctgctccagcctcccaaaatgctgggattagaggtgtgagccaccacacttgtccttatttttatcttttaaaacaatgctatgagaacgtcttccttgattctgcatgtctttccccagataaacaggtacctccttccttgaggctgccttagtacttcactgatttttctac

SEQ ID NO: 221531 - DNA, 507 bp, Homo sapiens
tgccagtgattaaatggttaagattcttttgcatttgtatctgctcatccatgactcaagaatattatagaatatttgagcagcttttccctctattgttatattatatgattcattttagtattaaaagtagttcacaggaatgcacttcgtatgattacatagaaaattacaataaaaaatcttgaaagttaaaaaaataggtggtattatttaggtgaatcattagttaaataagaacttttttattcttaggttattttgtctttcatctttcaactttctgatacttaaatttgccttgttaacattcacagttgctgttcatattcttagatactttatgttttctgaaatatatctttagaagacaaatgacataatttcactttcatagaggaatttaaaaaattaatttgatctaaaagaaactgaagtttgtcaatctatacaagtaagaatgtgactaaaataaaataaatatattttagtaaaatttctggtaaa

SEQ ID NO: 221532 - DNA, 362 bp, Homo sapiens
atcaagtctctagtttggttaagagtattataccaatgttaatttcttagttttgacaaatgtactgtggttatgtacccagtgggctgggtgaagagtatacaagaattctaggtatactctgtattatttttgcagcttttctgtaaatctaaaattattccagaataagaagctacacatcaactggcatctaccatattaacatagtaaaaatgaaaacctgtaatatcatctcaatagatttagaaaaaaagcatttgaaaatattcaatatcaattcatgatgaaaactaacagcaaactagaagtagaagggaatctactcaatctgataaagggtgtatgtgtattttttttaa

SEQ ID NO: 221533 - DNA, 428 bp, Homo sapiens
tcgccctgggagcagctactgtgatagagccagattcccaagttctcattcatggtattttgaaatgacataaagggactgccaccaaacaaggcaggatagcagcagccaagatgggaaaaccttgccttccccccgggagaacagagggagcctccccacacaccgtgtaatttccagaaaacactggtgcttctccatggctctgctggccgaccacatcctcctaaccctttaagaatccagcccccctttcttctgactttaagcaccaggtagtgcttaaaagatagttgccaagccaggcgtggtggctcatgcctgtaatcccagcactttgggaggccaagtctggtggatcacttgagcccaagagttggagactagcctggccaacacggtgaaaccccatctctactaaaaaaaaa

SEQ ID NO: 221534 - DNA, 259 bp, Homo sapiens
tggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttattagaaaataaaaaaaaagaa

SEQ ID NO: 221535 - DNA, 606 bp, Homo sapiens
gtggtgtagaaatgcaagtattttggcttaacagcatgaagtctgggttgcacattgtatcagaggtgctgtaatctttccagtatctctgatatacggctttctggttgaatgtcaccctgggccctcttgactggataaacaaccatgagggctcttctctgtggagctgccgagagcttggtggtagaaagcgatgtttctaaacaactgcagcggctctttcctgtctgaactgcatcgtgtgtctgactgccttgctgtccatacatacagactccttcccaggcccggctctgtgcagaacttccatgttttaccacatttttctctcctgaactccctttgtcagccccagggtgttgaggctgggtcctctctagcaatctctaccttcagaagagacttttctaaatattttgcttttccagttcttgttgcttttgtcattgtgaagagtcacccaggatgctggcgcttggtaccctaagatcagaagtggtgtgtgtgtgagctgtgagacatgcacaccctttcagagtgatactgtgtggtggaaggactgttagaactcaaagaatagttaataaatccagtgtattattc

SEQ ID NO: 221536 - DNA, 532 bp, Homo sapiens
agggaaagtagtctttctcagaaaaacaaaaatggagataattcattaccactagactagccccacaagaaatatttaagggagccctacaccaggaaacaaaaggacaacatctaccatcatgaaaacttaacaaaagtagtgtagagcagatacacaaaacaggaataggagtgttgttactctaaaaaaaaaaaaaaaaaaaaaacccaccagatcataaaagaaagtaaaagaagaataaaggaagaaaggaataaaatagtcaaagtactgagagaaaaaaaaaaaaagaaactgtcaaccaagaatcctgtgtccagcaaaggtatcctggaaaaatgaagggaaagtagtctttctcagaaaaacaaaaatggagataattcattaccactagactagccccccaagaaatatttaagggagccctacaccaggaaacaaaaggacaacatctaccatcatgaaaacttaacaaaagtagtgtagagcagatacacaaaacaggaataggagtgttgttactcta

SEQ ID NO: 221537 - DNA, 408 bp, Homo sapiens
aggtatttgtagtgggtatgtgactgacaaaggattcgtatccagaatgtattctacttcaaaatcctccaaagaatccacaagagaaaaaatctggggcattcagcgcagtggatcaggtgagaggccagttcctagtttccagatgggcaagaactaaaaagatgatgaatacaaagtttaggcgaaaccacagactgccaaggagaggaaaggaagagaagaggcttccgtagtacatgtgaaatgtgtttctaaacaagaaatagacaacagatctgaagctttttaaaaatgaaacaaatctttttgacttgctaaagctgggtaataagttcaaaggcattcattagactattatctacatgtttctgtatatttaacattttttataattaaaaaaagcaa

SEQ ID NO: 221538 - DNA, 406 bp, Homo sapiens
tctgctttctttatggttttcaggctatgaagatattctgttggtttttgagacagctctgcttttatgtttttctaagaagtcatctatttcatttgtggttaaaagtaatataggtggtctgccaggcgcagtggctcaggcctgtaatcccagcactttgggaggctgaggcgagtggatcgcgaggtcaagagatcgagaccagcctgaccaacatggtgaaaccccgtctctactaaaaatacaaaaattagccaggcgtggtggcgggcgcctgtagtcccagctactcaagaggctgaggcaggagaatcgcttgaacccgggaggtggaggttgcagtgagccgagatcccaccactgcactccagcctgggcaacagagtaagactctgtttcaaaa

SEQ ID NO: 221539 - DNA, 380 bp, Homo sapiens
tgtacataaacactcaaatcaaaaaggagattggcagaatgaattttaaaaaaacatggtccaactatatgttgtctataagagactctacatagaaaaacacaaataggttgaaagtgaaagaatgggcaacaatgccggagaggttatattcatatagacaaaagtttaagtcaaaaattgttatgagagacaaataagaacattgtataatgactaaaaggacaattcaccaagaagatataacaactgtaatcatacatacacctaaaaacataggctcaaaatgtaagaagcacattctctaatcacaatggaatgaagcaaaaaagcaatagcagaagagaaacaagaaaattcacgaatacatgaaaattaac

SEQ ID NO: 221540 - DNA, 519 bp, Homo sapiens
acaggagagatggatcaaattccagttaaaggcaaagaaatgtgatctttgcagtccctgtgctgataaaagtacaatttcattacatttctgtagtatcccaaggactcgcatgatgaccttcactggttccagaggtcaaggaactttattgatggtgctgatagtacagaatctatcgtttcatagctaggaacactggcgcatgcctgtggtcccagctacttgggaggctgaggcggggggatcgctggagcccaggagttggaggctgcgatggagcctgtgaatagtcactgcaactccacctggggcacacagttgagaccctttctcctttaaaagtcaatcactgtatctctcttatcatttcatgattttcagatgcttctcttataactaatgttgtcatccacaaaattaaataaaacaaaggagatgaccaatatacttaattttttttgggaagtgtccatatgttgtagtaggtctcatcattcacctttgccgggtaccgag

SEQ ID NO: 221541 - DNA, 111 bp, Homo sapiens
ggtcttccttgcagtccagactttttctgtaaatggccagtagtaaatatgttagacttcactagccatatagtctctgttgcaacaacttaacccttctgtcgtcttctc

SEQ ID NO: 221542 - DNA, 261 bp, Homo sapiens
tcaagtgttggagttgtctgctctccctccacagccatgaaattggttagtcttgtgtctagcaatcttaattcttactttgtagaatctgtcggagttttttttaatatggacagttaattgttcacaaataataccagtttgttttttttttttttttttttgagaaggaatcttgctgactcccagggtgcagtgcagtggcacgatcttggctcactgcaagctccgcctcccgggttcatgccattctcctgcctc

SEQ ID NO: 221543 - DNA, 543 bp, Homo sapiens
ccaaatatgttaactgttctactttatttatgtaattatattttcattagtattttagtagatggggctgtatagaaaaacaaatgtatcatatgtagccaaatgaatctttttcttaaatgatattattatagtaggctacagtaatttcaacaattttacaatagagttttgatcctcttctttgcgatttgtttcagagacacctcatgaatcacacaagaaaattagtctcagtacttatagccctatttcatttttcaattcagttttatcacaccatggcttcgaagtgactttgattgtgacccctaagcaattatctgattaggggataaaaattcataattccaagatgtttctgaaaatgttctgaacaatgacaacatatttggaatgagggcgtaatttcactaagtgatgcttcgaagaacaatattcatttggatatgcaaacacacattttcaaaagttatattactgtgttaccatacctgttataaaataataaaaatatataagtatttattaagtcaaacttca

SEQ ID NO: 221544 - DNA, 404 bp, Homo sapiens
tctttttttttttgagacggggtctcgttttgttgcctaggctggagtgcagtggcatgatctctgctcactgcagcctccccctcccaggttcaagcgattctcctgcctcagcctcccaagtagcttgaattacaagtgcccaccaccatacccagataaatttttttgtatttttagtagagacagggtttcaccatgatggccaggctggtctcaaaatcctgacctcaggtgatccgcccacctcagcctcccaaactgctgagattacaggagtgagccacacacccagcctctatcttctctgtagaaggcaagatttagataggaataatcttgctttattgtaatttcccttatacattgtttcgtcgacgcggccgcgaatttagtagtaatag

SEQ ID NO: 221545 - DNA, 277 bp, Homo sapiens
agcagacagacttgaagggattgaagggtgacacattttggtgtgggtgtgggctggtggtggtgatggggaagcacattctcacaattcttggacacttgattggcctactgcactccagcctgtgcaacaagagcgaaactccgtgtcaaaaaaaaaaagaagaaaatgatcatattggtaagttgcaccgaggattagtggagggtattgggagccactcatatggaacttgatttttaaattggggcttggcatggtagctcaagcctgtaat

SEQ ID NO: 221546 - DNA, 565 bp, Homo sapiens
aggctgatctagaggatcccgataactggtaggagtgtttcctcaccaggcacctctgctgtacattatggtctttcctaatatgtgatagcaagattacacttgtccagagatctcttctctggccacctcaaatttcccccaaaagactagagaactgcagagcatatgaaaaagttgagagtccagaatgaaacagatgtgggtgactcgaagaggggactttggtgtcccaggcacttttttctttatgggacagcgccccttgcttggaggctttggactcagttctaacaagcacggttatccagtttcccagaccacggcagatgcagaggaaacccaaggaggtgaaagaggtgccactcgctgctggaggctatgatggtggctggctagggtgcaggctgaaaatgacccagtgacagtttatggccattaggggtggggcaagcagcttggacacctccatacctgagctcagcaccgagggctcctaatcatgacttgcagtcatcaagatggattggactgtattagattacattcaatactcggttgagca

SEQ ID NO: 221547 - DNA, 655 bp, Homo sapiens
atttcaaaaatggtagtggcaaatgcaaaaataattagagcaatttcctagtcttggtatgacctaggaacaacaggttatttctatcaaaggaccatagttaagggtcagctctctctatcaaggctagtttatccttctgggttgttctgcctgaggaccctaatagggtagaactgtcagggtgaagagggagagccgcggtcttcagagactacagaccacagctggagctactagtcatacaacatactacatacacgagaccatcatagagcttatttttgtctagctaaactgtagcctctctagtagcagtcttttttgccctctgtggtttctaatgttcagagcattaagagtacacacacacttcatgcctgtaaactgaatcttttggaaggttgaaaccctgtaaaatctaagtggttgtttttaataattaaataataattattattataactagaatcagaagctgcacatgtatgtggcactcagcaaacactactgtcccaagaaagcttaaagaatttcctttttaagttcaggaaaaacacctttgcaaaaataaaaccaaggccgggcaggggctcacgcctgtaatcccagcactttgggaggccgaggtggacagatcacttgaacccaggag

SEQ ID NO: 221548 - DNA, 806 bp, Homo sapiens
aggttcatcatttctcaagccatgttatctacgcattattagtctgatggccagtgtgccatttgacttgtagttttatttatagcattttggggcacaggaaattgtccttattcaatgtttagaaaagtcttcagctcttgaactccaggattctcaccagtggccaacagtttctcagaccttaggttttgaattgagttacgtcatcagctttcctggttttaaggctttcaaacatggattggcttctctgattctccagtttgctgacaacctatcctgggactttcctgccatcataattccaggacctgtgaagaattctaccttcagacaactgctcaactggattgaatctgggagaagaagatgggggcattatttcttgacagccacctagattccaacagcatcatgcaacaaatggtactaagaccttcagaacccttgaagagctaatcagcacttatgcatgaaggcaatgttctaaaccttagtggtcaggaaatgtttgagatttgaaacagttgtttgaagttgaggcagaaagtaataaagaatactaaaattatcaaagaaacaccaaacacaaatcaatagcatccaaatgagctttacctttatagctggtactctttctgtcctcttttctgcttcctaagagatgttttttggtgatttggtcctcctaagtgcatgcacattggacaggatagtatgagtatgattagagtgtaagcatgactagaagcacaagttaatttatgagtgattgaataaaagtaattttgtgaaaaataaga

SEQ ID NO: 221549 - DNA, 724 bp, Homo sapiens
cagcctccacggtctcccttatgactgtggctctctgtgactcacacgcccacaccgaagagggctgacctgtgtaagcattggaacgttgcagcagtgatggagcgtgacttctgaggctgggtcataaaatacgttgcacctttttgccttgctctttcttgggccactcactgtgggatgccggctgccatgtcatgaggttatcaagcagtcctgggaagattccatgtggagaggaactgaggctccctgtcaactgccagtacaaacttgccagccttgcaaggcagccacacgggcagcagatcctgcagccccctcaagtgactgtagccccagccaccaactggatggcaacctcacaagagatcctgagctaggaccacctagcccagctgcttctgaatctctgacacacagaaactgtgagataataaatgtgttttgcagccaggtgcggtggctcacatctcagcactttgggaggccgaggcagccagatcacaaggtcaagagatcgagaccatcctggccaacatggtgaaaccccgtctctactaaacatacaaaaattagctgggcgtggtggcgcgtgcctgtagtcccagctactcagaaggctgaggcaggagaatcgcttgaacccgggaggcggaggttgtagtgagctgagatcacaccactgcacgccagcctggtgacacagcgagactctgtctca

SEQ ID NO: 221550 - DNA, 269 bp, Homo sapiens
aagctggatacagtaaataatgagcattttgcgtacagtccagttgttctcaagcagagacagttttaacccccagagatatctggcaatgtttggagatatttttgattgtaacaactggggaagaggtgctactgacatctagtgggtagatgagagggatactgctaaacatcctacactgcaggacagcccctcacagcaaagaattatctggaccaaatgtcaatagtgctgtggtgagaaaccctgatctgatcttgtatgaa

SEQ ID NO: 221551 - DNA, 623 bp, Homo sapiens
ggaaaggcaaaatggtaaagccggtctggaaaacaatatgccagtctcaaaaagttacacatccaatatgacccagcaatcccacttataagtacttatcctagagaaatgaaaaattatgtgcacacagaaacctgtacatgagtgtttgtaagtattatttataattaaaaaaaaaactagagacaagcaaatgttcttcagtgtgtaaatggatacactgtggtacattcccaagatggaattctactcaacgataacaataatgagctactgaaacatgcagctacatagatgaacctcaaatgcattacgctaaaggaaagaacccagtcccaaaaagttacatactgtatgattccatttatatgacatgctggaaaaggtgaaaatataacaacagaaaacagatcaaatgttgctgagtgtctggggtggggtggggtctgaatacagaggggttgcacgaggcaattctttgaggtgttggaattgttttgtatcctgcttgtggtcatagataaaaaatctatgcatgtgtaaaaaatagaagtatacatacaaaaaagtgaattgtactgtctgtaatttttttaaataaataaaaatccctagctctgctt

SEQ ID NO: 221552 - DNA, 596 bp, Homo sapiens
tgaaaagctagacatccagctacgtacatccctggagatacccagacgatggaatggaatgttcactgtggctctaagtcagagcatctcatttaagctttatggacagtctgcgcaggatgtgtctgtgtggggacttctcctgtgcatcatgggaggtttagcagcatccttggcctcactcgccagatgccaatagcatccccctctcctagttgtgacaattgcaaacatatccagacattgccaaatgtcctctggggggcaaagttgccacagctgggagccactgctctgcaggtttggacgctgtgcctgcaattccatgcagcatcacgggctattgatcatgtgtcagacggagcttaaattggtcgatcgcatcctcaagtagccactccagagcgtgattatctgacacctgtaatttaccatcctggttacatggggggcaaacgtggaattatgcacatcagcgggcccagggcctgttttccatggacttagtgttcctgctgagcatggcctcggtctccccgagttgttaaagacattgacgcctcagaactgactctgcctccacttaatcagctcac

SEQ ID NO: 221553 - DNA, 269 bp, Homo sapiens
taaggcaagagcagaggtagcatgcctgagtgtgcatttcaccttgttcctcactccttactggtgggctaatcctatgcccataccctcctttttctttgtaattattaacaatgccctctttgactcttagaagagtctaggtgtgcataatagactatatggttgctgtatccatgggctctgcagctgctagtgacaaggaatcctgctggaattgagaacaaatctaccttaagaatatatattcaggtttttatcacctgaga

SEQ ID NO: 221554 - DNA, 450 bp, Homo sapiens
cagggactatagtcaactgatttcataatcaattaaaccactaatatcatgtatatattgcattatgggattttttttgtgaaatgctgtatcagaagagaatctggacctattctcaaggtgaaatagcactttattctgctattctcaaaccagtaagtcattaattatctttcataaatgtaagcagtaagtaaactcttaggaacagaatggcagcctttttctataaatcttatattttaaaatattatttctgttaagagatacttactgtcattgaacctgtgaccattgaagatatataagggttcattccattattttcctgtgaaattttgaacttacttggaggaattattggctctggtcataatcctaaattataactctgtagctcttatgtgttcaaaattgttgggagacttcatttcattaatttagcaagat

SEQ ID NO: 221555 - DNA, 369 bp, Homo sapiens
gaaatatgaaagtctgtgttttcttccaggactcgactctctttggcctactggatgtacaggaagtggtaaaagctgtatggtgtctccttaggaattgaaaggccttgggcaaatcaatcaggtcctggctttccacatcagcaagtcaagataatcatgttggctaaacttatttgaataccatctggattcacttactggcaagtgtaaagtgttttcagaataccaaatattatatagggcatccaagcagcttaaatttcagtgccctccattccttcccttcctgtacttcagtctactactgaatgcaatgagatataataaaaccaagatctcagggctcctagcccttttcctgaaact

SEQ ID NO: 221556 - DNA, 866 bp, Homo sapiens
gaacacttacattagtatatagttgggcaaaattatctaacacaaaagcttacttcacaataaagtgttgaatatctcatataatttcttgaatactgtagtggaaatgaaaaacaatggttgtatgggtaccatcgtaaagtcagaaaatcaagttgacccatcctaagtcagggactgtctgtattcgaaatgtcaaataggaatgagattttgtgaatatagtttaaaatacattgccagtttgttctgatggggaatggagaaaggaaagcaggaagataaaacacctgatagaaaaatgtcacccacagtccctttactttgaaggtgataaacaatgttaacattttgtttatcctttgagcctttattccctactaatgtttaaacaaaattaggataaccatgtacacgctgttttacaacctgctccccccttaatgttaaataaattttcccatttgattaacatcttcttacaaaatggaaaactgtgttcattaagaccttagagaggatgatgaactgtttcataccatagagtatgttatcaaagagagttaagtgcatgttatcacatcacttgccatttggactgataggaaaaagattaaaaaggcagtaaaacaatgtcactggttaatgaaatagatcaagaaaagatgaactgagagctatgcaagcagttctcattcttaatatcagctgagattggacaaactggcaactcttgcagatacttttatcatgtgtatgttagtgggactgttgatgtttagctgatttactcatactattgttgcttctcattgatggaagaatttttttttttagtgcattatcccggtcaatgtttgtttaaa

SEQ ID NO: 221557 - DNA, 361 bp, Homo sapiens
cttttcttccaggaacagcacgggctatccgtcaatctactggcaagccgctcatcaagttcactcgacaaagggttagggcagcaagcccccacaataatgtggaaacagaaatattacaaagtaaaggcttataaaataataaaaattctacttacttcagatacctccctgtgcctttggcaaaataccttaagcattccacataaggcgggcattgtctttataagatggcacctcataaaatggtattaaatatcaccaacggggcttcatatttcatccagcagggtttaggccaggcatgttctatatcacacattattagaatgacatctgctttgcaagttgtgtacccagg

SEQ ID NO: 221558 - DNA, 298 bp, Homo sapiens
aagtaactcctgttttatctttttcttggtttatgagtgtttttaaagttttacgtttcttgaagatcacagctgtagccccaattccatggttctggctacttacatttatcatacttattaatatcatgaatgtaattggaatacccctttgattttactggtgacgtatacccactagtgtactgagacggaaaaaaaagtctttagaactcagataaatatacagttcatatttactatttatgtatgtgtgatctcattattaaattactctatcatgtttgtggaattagca

SEQ ID NO: 221559 - DNA, 446 bp, Homo sapiens
caacgtcccctaccagagtagtacacctgctgcaactgatgagcctatactgactcctctctgtaattaatttattttttgttttgtaatttcaactatattttagattcagggagtacaggtgtgagtttgttacatgtagaattcattgttggtgttggacattctatcagtttggacaaatttataatgacacggatccaccattatagtatcatactgactatttgcactcccctaaaatcctctgtcctccacctattcatccctccccaacacactgccacagccactggcagccacacagtctgccattctttttgccattactgcagggtcacctgagtaatgtgccatctctttgagctaaagttttatttgttgaaagaactttggcatttacttagtattagaccttcagatagaatgttgatggatttttattg

SEQ ID NO: 221560 - DNA, 372 bp, Homo sapiens
gttgactggggtgattgatccagactatcaagatgaaatcagtctaccactccacaacggaggtaagaaagagtatgcatggaatacaagagatgtgggaggatcacttgagcccaggtgtttaagtccagtctgggaaacatagtgagaccctgtcactaaactaaaaacaaaaataagtattgttcagaatttgtggaggggtgaaattaaagacttttaaaacttaaaaaaaaaaaaaagatccattagggcatctcttagtattgctgtgctctgtgattaaggtcaatgggaaactacagcagcccaatctaggcaggactacacatggccagacgcttcaggaatgaaggtttgggtcactccacc

SEQ ID NO: 221561 - DNA, 536 bp, Homo sapiens
ccagataacagagtgaaaaccagtaaagtctcaaaaagttgtgatcgtgggccaaatgtaatggaaggagttcactagagacccatgaagagtctcgtagtgtaggtccgaaaacccaactgtgttggatggaatggaagaggcgtggaataacagcaggagacaggaaagaaggcggctgtaggtgagtaagtcaatgacgtgatctgactatttaaacggagctatgtggggagaggatttcttgtggatggtttagcagcttccccgtggtgctgtccttgtgatagcgagtgagtcctcgcgagatctggttgtttaaaggcgtgtggcaccttccgctctttggctttcttgttcctgctctggcattcttgttcctgctctggccatgtgatgagcctgttctggatttgcctccactatgattggaagcttcctgagggctccccagaagcagatgctgccatgcttcctgtacagcctgcagaaccatgagtcaattaaaccttttcttataaattaaaaaaaaaaaa

SEQ ID NO: 221562 - DNA, 420 bp, Homo sapiens
cagttatggcttggaataaggaggaaaggcatgaacattgttcccaggcatcatttaccctactgatgctgatacatggatatgggccagtgagcccaggaacaacagaatccctgaccagtgcttatttccccaaagttcctgattgctataggtgttccggggagtcaaagtaacctcaactgttttcttaattcacctggatttataagggttgatttatataagttgcttagacctgaacagactcaaagcagagtctgtaggaaatactctgcatatcaacatcccgtacccaaacctaagtcatcttttcactggggtgtgcggaagggctgattctcatgtactcttgaagccctaggcaatagaacctgaaatcctgatgcacatataccctaggataatttctctctcaaa

SEQ ID NO: 221563 - DNA, 385 bp, Homo sapiens
agggttttccgaatatggagcctttaagttgtttttctgataagtagaattgtaatattcaaatatgtttatcggaatcccacatttctaatagcctagtagctgtattgttaaacaccagcactggaccttggttctgggtgaaatactcacatgcataactcgtgctttctttaagacaccctttgatcccattatgcttttgccagagttaatattcagagtttgtaaggtcagtagttaggttaattgagttaaggaacgatatcatgacagcctgtaaaaaaggtgtaaatgtgatttaattttagctgtacctctaatgtatgtatatagagatgaaagcactattaaatgtatttttaaagactgatagaattgtaca

SEQ ID NO: 221564 - DNA, 325 bp, Homo sapiens
gaaagaaaagaagctgaaataaatgtttccctgcaaaaccgagggacagccgaggaagccagatgacgtgagcttgcgtggctcgtggacttggcatgcaatgttacagttttactgtggaatgtcctgcacttgggcaagagtcttctgatggagtccacatttttaagttggatatatttatattctggacccaaatggaatgccgttgagacagcctatgattttagagcatttaaatttagtgaaacattggaaagaatcacaaatagagacaactttttggaagagttttgcatgaagatttgtccagtttttttgttta

SEQ ID NO: 221565 - DNA, 335 bp, Homo sapiens
ctgattggatggtgcccacccacattgagggtgggtctgcctcacccagtgcattgactcaaatgttcatctccttggcaacaccctcacagacacacccaggaacaatactttggatccttcaatccaatcaggttgactgacactaagtattaaccatcacaagaccccagagggctcccttatcccttccaccctgttaggcaacagcgagaagatggctgtctgtgaatcagagagcaaaccctcaccacacactgaatctgctggtgctttgatctaggacttttcaggttccagaactgtgataaataaatttgttatttgtaagccac

SEQ ID NO: 221566 - DNA, 534 bp, Homo sapiens
atggtttagttttgcttttactttttcattaaaataggcaatgtgagatcgcagttaatttttttacactttcatttatttgtcataaatcagacaaatgtagaagttcaactgaaaattctctaagtcaaagaagatggggagaaggatctaacatttacaagatgccaattatttatatattgtattcatcctttcaagaattttataaaataaatattattgcagttttatagatgagtaaactacactcagtgggcttaaatatcaccctcaggttcacaaagctagtacattcagagataggagtcaaagtccatactctcaccattctaaccatgctgccgccactcaatgtagacttagccaactttaacaaatagccagttgatccttatccctatgttgtactttaccttttggggggctttacctcttatgtgtacttgaactgtaatttgtggaagatataattttaatttataccagccttattacccgtgtagccaacagcagcttcctttctgaaaaaaa

SEQ ID NO: 221567 - DNA, 502 bp, Homo sapiens
agctgtgggcagggctacctgggaagagggccctaaagggtccatccagagcccccacggggccccggtgggggtctcatgcagcatctgacccgccctctcctctcctggggcatcccctcggcagcctcagcctggcctctatctgcactggtgttgctaggtgactctgagggggttcccagagtgtctcatccttcgtgtgggcaggtctcaggagtggccagcagcaaaccccgtaccgcagtcttcgccagatgcccttggcgtactgtaggaggtttgctttctctgggagccctttagagtccggagggacttggccttggcctgcccttaaggctgagtttagagctttccactcatactcttccttcctctcccacatttcttgatctccaccccacccccatgccagccacccccatgccagccacctccctggaaaccagggatacagaaataaacaagacctggccctggtctgccaggggctcgcaaa

SEQ ID NO: 221568 - DNA, 596 bp, Homo sapiens
ccaatttgtcatttcggggaaatgctcagataagaactaaaaaccatactcagggattagcctcacccagatattaaagttattctaaataaaaaaatttagtcagtactacccaaaacagtttctatattcaacgtaatccctatcaaaataccaatgacattcttcacataaacagaaaaaatttatatggaaccaaaaaagaccccaaatttccaaagcaatcctgaggaaaaagaaaaaagctggaggcatcacactacctgacttaaaaatacattacaaagctgtagtaaccaaatcagcttgatactagcataaaaacacatagaccaatcccagaatagagaatccagatataaatacagatatttacaggcaacttacttttgacaaaggcaccaagaacataaaatgaggaaaggacagtctcttcaataaataatgctgtgaaaaataaactcaaaatggattaaatacttaaatctgagacatgaaactactagaagaaaacattgaagaaacactccaggatgttggtctgtgcaaaatactttctgtttaagatttcaaaatataggcaaccaaaggaagaa

SEQ ID NO: 221569 - DNA, 311 bp, Homo sapiens
acatggataaatctaaaaaacaattttgtggagtgaaaaaatctatatttggccagatctgtaatcccagctctttgttagggcaaggcgggtggatcatctgaggtcaggagtttgagaacagcctggccatcatggtgaaaccctgtctctactaaaaatacaaaaattagctgggcatggtggtgcgttcctgtaatcccagctactcaggagtctgaggcaggagaaccacttgaacccaggaggcggaggttgcagtgagcagagactgtgccattgcactctagcctgggcaacagagcgagact

SEQ ID NO: 221570 - DNA, 102 bp, Homo sapiens
attataaaaacctggggcagggacgaagttctttacatctccgtctccctgtagcatctggcaggtgcccctacctcacaccaggtgcttgatggttgttgg

SEQ ID NO: 221571 - DNA, 449 bp, Homo sapiens
atgactatgtgtaatcatcactagttatttcattaaatttgatagttatgcagctggtcatgaagttattttcttcttctaagttcttttttttccctgaattttactagaagaaattgcggtggcatcatgctgtcttttctctttcttcactacccatgaatctaaaaaccaagccacccctcaatagaaatgcagaatgcccataatcattgacttattcccttttaaagtaaataatatgtatgtactttgccttcagagcctagaaataatgatggattaagatttatgttgtattactttttgctttgacactatattactactgaggcctgtaattaaaatatgatcgatgagtacataaaacactgccttctcataaaatgctagtaaatatggttgttttggttcttgtatgaggtgggaataaatacatttgattgatt

SEQ ID NO: 221572 - DNA, 365 bp, Homo sapiens
cattttttaaaattcaggaatagtggtcttttttaattcagattttgaaggtttggtaagtttattgctaatgttggaccacacgcaagagaaagttagacattattttgtgaccagcattgttaagttgtcacattctgaacaaatcccttaaagacctggaactcatttacattttgcataaaatcctgatgggatttatggtttaaactttgactatactctttgtcttgaatttattaatttccttatcaggcttaaaacttgggggaaagtagacttttgcaaaatatttttttaaaccattaagttttatacaaagtccttctcaaaaaccctgtaaaccctctatctccagagctctt

SEQ ID NO: 221573 - DNA, 151 bp, Homo sapiens
tcttactcattctaattattttttgtacccattaaccatcttcatttctgctcatcctccaccccagcatctggtaaccgtcttttcactctctatctccatgagtttgttttaatttatagctcccacaaataaataagaacatgcaaaa

SEQ ID NO: 221574 - DNA, 478 bp, Homo sapiens
caggcgtggtgtccagtgcctgtaatcccagctactccatgagagattggacaaaacctgggaccagagactgattttcttctaaaatgctttctccaaaatatttttaaaagaaaagggggaaattggaaaggaaaatgttttgagccccccagatcactaagctaaaggggaaagtcaatctgggaactgcttagggcaaacctgcctcccattctattcagagtcatcccctgctcactgagatgaatgcatatcttattgcctcctttggaaaggctaatcagaaactcaaaagaatgcaaccgtttgtctctcacctacctgtgacctggaagccccctcctggcttcgagttgacccgcttttgcttcaggttgtcccggatcaaaccagtgttcatcttacatatgttgattgatgtctcctgtttccctaaaatgtataaagctgtcagatacagtcagtttctcttcca

SEQ ID NO: 221575 - DNA, 213 bp, Homo sapiens
acaatttaagaaacagtccctcttttcatctctcactttcaataatgttttgtagattttagtgtggttaacttggaatgtggttcattaggtttatttctaggtatttgatatttttgatgctattacagttttatgattttcttaaaattttattttcaatttgtttattgctgatatatagaaataaaattgatctttgtatattgatcc

SEQ ID NO: 221576 - DNA, 538 bp, Homo sapiens
ctatgttattgcataagtgtacttcagtgtgtgggtgcttcaattgttattgtttaaatggcacatttgctttactttggattcctgaagtgttggaatgaatatagatgtgggtatatatctgaatgcagaaacagcattcatgagaacactgtgatctgttttttctgccatgtttcacagtgagaagcccagataataagtttcttaatattgccaaacaagcaggtaacatagattccttcaatagggtaagacagtaacgtgctgctggaactgattatatttagcatatgtttaaataataatcatcatcatgataaatgtattctgagttttacatttggtttttattatatcctagtatcaatatcacatttccccacccagttagctacaattccaaataggaatttcagctgcctgctcttggggctcacttaaattttcacgaacactgtttctcagtgtgagaccctgttcatcaacatgtgccccagattgatgtttcatttgtgttctttaaaactcattatat

SEQ ID NO: 221577 - DNA, 529 bp, Homo sapiens
tacctttactgtaaataagacagtggtttcataggactgcgtttttaataatgtccctcagtgtacactaattgcctaatattaagtgcattttcgtgagaggcagaaattatgtgatttcgtatctgctgttcaggcttattctagggtagtgactagtgatctagttgtagaacccttcttcaaaggaaattttatcaggaagccccatgtataatatgggaaaaagtggagttgaagtggggtggtatatctagagtgctactagctcagctctcgccctttctcattttcctgagacagtctgtactacacctgtgcagaatgactagcgccctgagcacattatcagaactactgtccagagaaaattgttgaattgcatagccccagatctctacaaatgtgtctatgggaactgaattctgatttttgtcgtctattagtatttcaactactttattttaaattgtcaccccttttaaaaccccttatttagtatcattatcttactctcagaaactgacca

SEQ ID NO: 221578 - DNA, 727 bp, Homo sapiens
tgttaattatacttggttacagtcactggattggtttctatttgtctttcaagtagccaagtgatggataggaatcaacaatgttttctttcctgctcataaaaaaaaaaacaacaaaaaaaactttattgaggtctaattgaagtaaaaaactgaatgcaaagacaacaatttggtaagttttgacgtatgtaggcacccatgaaattatctccagagtcaagataatgaatatattcagcattcccaaaaagttttgtcatagccctttctaaatctggatgatttttctgtttgcttatgcttgaaatttcaacattagcaaatgttatttttgtgtatcattggtaaatccacttagtttgattgcagtgcttcagccagcctttcctatgtctggtttagagcaaaaccaccgcattaatgttttggcttgaggaataataacagaatcatggtgcatgttcttttttgtttgcttttttataaaattggtgtgaaaagatgcccttggtctccgtttcctttcttgctctttatttgttgtactcattctgcatgaaaattgattcttttgccagttgtaagattactattattgaggcactgctattgtgagaataagtggatccttcaaaatactcaaagacaactcagcaatttgcgtataatggacctacataatctgttctgagcttttaataaattaccactgatttagtttgct

SEQ ID NO: 221579 - DNA, 782 bp, Homo sapiens
ttgagctgaggagttcgaggctgcagtgagccatggacacaccactacactccagcctgagtgacagagtgagagtgagacccttactctaaaaaaaataggccaggtgcggtggctcatgcctgtaatcccagcactttgggaggctgaggcggacggattacctgaggtcaggagtttgagaccagtctggccaacatggtgaaaccccgtctctactaaaaatacaaaaattagccgggcgtggtggcacacgcctgtaatcccagctacttgggaggctgaggcaggagaatttcttgagcccaggagacagaagttgcagtgagccgagatcgtgcctctgcactccagcctggcagaaagagcaagactctgtctcagaaaaaaaaaaaggaaaaatatattgcaaaaagatggtagtaaaaatgctgctaaagtttataaatgtgtcagtatgaataaaaagtggtggctgttttggtagaaccatcaaaagaaataaccaggctgggaacagtgcttcacgcctgtgatcccagcactttgggaagctaagataggtagatcgcttaagcccagaagtttgagactagcctgggcaacatggtgaaaccttgtctctacaaaaaattagctgggcatggtggtgtgcatctgtagtcccatttagttgggagactgaggtgggaggatcatttgagcccctggaggggtggaggctgcattgagccatgattgcaccactgcaccccagcctgggcaacagagtgagaccatgt

SEQ ID NO: 221580 - DNA, 136 bp, Homo sapiens
ggctgttttgttctttttcctagttgaacacccagttctctacaatgtcccacagtgatggagtttctaaacaccttcctattcttatctctcatctgtggtgatcctcagagccactaaaaatcattaggttata

SEQ ID NO: 221581 - DNA, 276 bp, Homo sapiens
ctcaaacaggcagcactaatctctggtaatagaaatcaggatagtggttacctgggggtggtaatgactagaagcgggaattaaggggacttttagggtgtgagtcatatttggtttcttggtctgggtgtatggtatgggatggggttattttgtgaaaattcatcaagctgtacaatgatgccttgtgctcttttctgtatgtatcttatacttcattaaattttttatttaaaaaaacctggatccttacttcaattcttaaaccaaagtaag

SEQ ID NO: 221582 - DNA, 453 bp, Homo sapiens
gtgaggtgggcattgaggcaggtccatttcagtcaaaatgtcaactaagatgtagaaaaagtctttccttctaaactctgcctgaaagttcacttcattcttcacatgtggctaactctgttcaacctgactcttgatcttacatggcagctatactttccaactgatcaaattctctcatggttacatcgagtaatgcttctaagtgcattcttcactattgtattcctaaccgcagtagaagtgaacctctggggctcatcacaagtagaaaattatttgcatttttctccatagtacatgtgtatatgctataatatcaaatgatgtcttaaatatctttgggaaagccttttctattttatagttaatggataagatcactttgttctgaaatatcatgattttgaagtttgggctgcaaaaaggaagtaaacactgattatcagattc

SEQ ID NO: 221583 - DNA, 405 bp, Homo sapiens
atgtccctttgctgtctgatattgaaagtatatacatctggtttcaatataaaacatatctgcaccctacacacttgtcagagagcttaacctggcccactgtgtacaattttattgtatttcatttcaaggtaatttcaggaataagtaggatataaattaccataaataacacaaacttaaaacacagatcctccctcctgctttaggattggtgcactattagataaccctggatcaaatagaaaatattccttgtactttctttgctctgcttaagaaggcaaaaaactgttgtatattttagattttaatccagacacttcacttaaaatataaaagtattggcatgaaaaagtgtcagctctggaaaacgtgtctatgtgggacacctcattccccagc

SEQ ID NO: 221584 - DNA, 399 bp, Homo sapiens
tgatcctcccctcaaacttgctccacacttagttttttcatcttaattgtttgcactgcatcctttcagttgctcaattaactgaaaggatgttcctttcggttaaccttggagtcatcctttacttctctttcataccctatatcaagtcttgtcaggaaatcctgtcatctctacttcaacatgtatccagaatttgattacctctcactacctccactgttaccttcctggtcctagccaccatcatctctggcctgggatactactatagcctcctaacaggtttccctgtgtctaccctttcctcttatggtctgttcttaaaaatcagaacagttcttctaaaacttaagccagatcatgcccttccctctcgccacactcaaatgcttcagt

SEQ ID NO: 221585 - DNA, 439 bp, Homo sapiens
caaaatttgtttatatcctggaccataaagcgaaagtcagatttccaaggattgaaatgacacagattttaataccataataaaattatacctgaaatcagtaactaaaaaataactgaaaaatacctatatgattaaaaattaagaaatattctaggctgggcacggtggctcacgcctgtaatcccagcactttgggaggctgaggtgggcagatcacgaggtcaggatatcgagaccatcctggctaacacggtgaaaccccgtctttactaaaaatacaaaaaagttagccaggcatggtggcaggcccctgtagtcccagctactcaggagggtgaggcaggagaatggtgtgaacccgcgaggcggagcttgcagtgagctgagattgggccactgcactccagcctgggcgacagagtgagactctgtccca

SEQ ID NO: 221586 - DNA, 484 bp, Homo sapiens
  misc_feature (380)..(380): n is a, c, g, or t
  misc_feature (383)..(383): n is a, c, g, or t
  misc_feature (417)..(417): n is a, c, g, or t
  misc_feature (439)..(439): n is a, c, g, or t
ctgatggttttataaggggttccccctttcacttggctctcattctctcttgcctgctgccatgtaagatgtgccttttgccttccaccatgattgtgaggcctccccagccacgtggaactgtgagttcattaaacctctttttcttcataaattacccagtctcgggtatgtctttatcagcagtgtgaaaacagactaatacacaactcctctaccttctttattttctcagtgtggaaaatgcctgatgaaagctttggggccctcacagatgcacaactcaagtgctgattctatcacttatctaccagctctgtgaccttgaacaagccgcttaaccttgctaagcctctgttttctcatatgtcaaatggtgntantaatgcctacctcccgaggttgttgtaagaattntaagcacaaatgtatgtaaagngcctggcacaaagtaggtgctcaataaatggtagctattataata

SEQ ID NO: 221587 - DNA, 526 bp, Homo sapiens
atagcagaactacagttctgctaagacaagggaagtccgttagctgattgaccttgggcaagtagtgtcttgtcttaattacctacctgaagggattctgagattaaacgagctgttaactataaagtacttatttcccagtgagtgtctgacccaaagaagtgttcattaaatagtgatagtagttgttctttaccattttaaactatcaggaggcattatttgagagattcatatttcaatcatcatttttaattcctgtttctatggtatgtgttttccttgtgtcaccaaccatccttcaccccagaccctccatgtgtctgtctctcaagtcacagctaactgtagtaaggcctcatttattggttattgtttgagggaaaaactgtttggcatgagtgcaacaccttctgattaacttcctaaaaggtaaacttgtcttttagccattttagctttaaaaaacatagtttcctgcctgtttaaaacaaagatcctaaacatgactttaacttctcgatga

SEQ ID NO: 221588 - DNA, 524 bp, Homo sapiens
cactcccccagactgaatcccttagttaaatgtgttctcatatactttgaatattactttcttgcagtgcttatcccacactattgtaattagttgtgtatgtgattgtcttcccaactgtaagcagctattactcatgtttgggcccctagtgttcagaagagtgcctggcatccagtaaatatgtaatgtgtttattggctaaaaaagtaaaataattccctatgtgttacctggctacctgttataagaactagaaattatggtgaatgcagagtcaataaactcattgcttttacaggaagagcttaaaacaaacttagggaaacaagttttgttgttttttttttaaaaaggaaaaaaacagttttggatctgctttagggcacttataagaagagttttaacaactgttggtttaaatagttgttgcaggaatgagaactcttgcagggattgaatagcctaggcaaccgcagcattcaaaccctggtgggacggaattcccagaggccaactgggtc

SEQ ID NO: 221589 - DNA, 423 bp, Homo sapiens
ttattttttattaaaaaaatttttttatggctggtgtatggtggcttatgcttgtaatcctagcactttgggatttttatttttattttttagagatgggatcttgttctgttacccaggctggagtgcagtggcatgattatagctcactgcagcctctaactccagggctcaagtgatcctcttgctttagcctctcaagtagttaggaccacaggtgtgcaccactgtgcccagctgatttttgaaagacctttttttttaagacatgggggtcttgctatattgctcaggctggtctcaaactcaagagatcatcttgctttgacctcccaaagtgttgggattacaggcgtgagccaatgtccctggcccatctagtaaatttcatatttcagatattgtatttttcatctctagaag

SEQ ID NO: 221590 - DNA, 238 bp, Homo sapiens
ttggatgtggtgcatactgcatgaatcattatttaaagcatagggtgttcctttcacaaaggtaaaggaaataggggacctctggggtactcattcctccgaaacatttttgctccaagaaaactacacaggattatttattctcctttactttttcatacgcttccatatctggtactaagccagtagatccaaatagaatgggggaaggctgtgctgaatgcaaagatggcaggcc

SEQ ID NO: 221591 - DNA, 443 bp, Homo sapiens
cccatgctgtgggcaaaagaacagtgcccgcccctgggttgtctgagcagaagctggattgtgtgcctggagccctgtcgccctcagccagacccggggtcgaggctgggccggctctccgggagcatcagggatccggttggagagaggctcatacggcggtcccaggggccacctcgagggggttgaccggagctgggtctgggagctgcagcagagggaaggcggcatgaggagagagccgcaggtggggcgtgtgcacaaagtgcaggtgtgtggaggccctgtgggtttacattgccctgaggcaccacttcacgatcaccccattatttttaataaaggttgtggagaggctgcccttgtttgctaattacgccttatatctttaatcattgcattccaacttaacaaagggattttaacaaaggtcaccgtttatc

SEQ ID NO: 221592 - DNA, 417 bp, Homo sapiens
gcacccatcaactcatttacattaggtatttctcctaatgctatccctctcccagtcccccaccccctggcaggccccggtgagtgatgttccccaaccctgtgtccaagtgatctcattgttcaatttccacctacgagtgagaacatgcggtgtttggttttctgtccttgtgatagtttgctgagaatgatggtttccagcttcatccatgtccctgcaaagtacatgaactcatccaaaaagaagtagatgttacagactcatagctttccttgccattgccataactttgtataaactcatctactctgggcatggtggctcacacctgtagtcccggcactttgagaggcttaggcccagtaacttgagaccagcctgagcaacatagtaagacacccccgccgtcgacgc

SEQ ID NO: 221593 - DNA, 369 bp, Homo sapiens
gatgtgtaggtaagaaaggatagccaaccagtacgggccgggacacgagagatcacgtcattattcagatggagaaactgaagggcaggcgtgggaccaagggcccaccacgagcccaaggctccatcctcccaagcacgtaacaaaggtggaggcggaagacggaggagagagaagcgggtgaagttgggagataaaagctccccagtggctggagggcgggatctgcaacaaatgaagccccggggccgctaagcgggccgatttcggggcagggacccaggccctagcaacagtccgaccattggcggagcggggacacgctggcctgtgattggctcttgccatgcccgaggggaaggcggccgc

SEQ ID NO: 221594 - DNA, 484 bp, Homo sapiens
aggagggaaactagctatttacagaagaattgtaataatttcaagtcatcagattattgtatgcctgttaagataatttcatatacgaaaaaaaaagacattcagaaactactaagagatatgcattaaagcagaggtcaatacaaccatataaaaagaaagtaaaccttggctgagtgcaggggcccacgcctgtaatcccaacatttggggaggccaaggcgggaggatcacttgagctcaagagtttaagaccagcctgggcaacagagattttgtctctaaaataaaattaaaattaaaaaattaaccaagcatgatggtgcacacctgtagtcccaactactgaggaggttgaggcaggaggattgcttgagcccagggggtgaaggtttcactgaatggagatggtgcctaggcactccagcctcggtgaaagaatgagaccctgtctcaaaaacaacaacaacaaccaaacaacaac

SEQ ID NO: 221595 - DNA, 537 bp, Homo sapiens
aatgaagcaaaaactgataaactgggaagaatgggtaaatcaacaatcatagttggaaatttctgcattcttttcctaataacttacagaagaagtaaacagaaactcagcaacactatttactgaatagtgaataacactatttaccaacttgactaattgatgtaaatatgtccatgtaatagcaacagaatgttcactcttttccagtgcacatggaacatttgccaagataggccatgtgctgagccaaagaccaagcctcaacaaatttaaaaggattgaaatcataaaaagtttatgttctgcctataatagaatttaataagaagtcaacaacagaagaatctggaaagcccccaaatatgtggaaattaaacaacatatttctaaataacccatgggtcaaagcagaaataacaaggaggatcaaaaatattttgaactaactaagaacaaaaacgcagcatattaaaataggtaagatatggctacaaacagatcaaaacttccacttcaagatgctagaaagaagca

SEQ ID NO: 221596 - DNA, 588 bp, Homo sapiens
gtctgtctctctgtctctctctctctctctctctctctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagt

SEQ ID NO: 221597 - DNA, 524 bp, Homo sapiens
ctgcagaggaatacccagaaaggtagcaggaaaattagtaataaaatcagaacaaatggtgactcgaatattagggaagagaatgtttcaagagacagctacattcaattaggtctgatgttacagacaagtaagactgtggcgttgattctgcaaccttgttggtggccttgggaacagccttgtctgaggatttgtgaacacagaggtcaggctgcagcaggttttggaataagtttaaaggtaaggagggtagacacctcttttgggaaatttggctgtaacttctggagcagtctatatgtaggtaggtgagaattccacacaggttttattttctcaaggtggcaaaaatttggacatgttaaaatgtgactgggaaactgccaaaagtgggagaagttaactataaaagaggacaggaacaattgagagtatatggtctctgaaattcaggatggataagatccaggggctagacagagggtgtgccttagatagacaggacacctcttccagtcaaa

SEQ ID NO: 221598 - DNA, 547 bp, Homo sapiens
ttatggatccagaaatatatcccaagtattatcttacatggttagatatttgcaacaagtgcgattcccaccaatataaatgatttggttcttagtctaggcactaagacccaggggagcaggaaaattagggctgaaagtaatcagcctgtaatcaaaagagacagtaatgaaattaggaagaactgcattttgcaggcatttagcaagcctctaattgtatgctgtctacattctgtcttgcagagccatttgaatcactataattagcctgctttgagaaggcagcattctgagagccagagtttccaagttcaaaggaaaatcttcctaaggaatatatgctggagtgaaaatccaaacacttctacccttaggggttgggaggtagcgtggatagaaggttctctgagagctttttgacacctcaggccaagaggacaagcagagaacaagctgctgggaaagtcaaatttataccaaactttgattccttatttcctaaccagaccctaacatggtcctagaaacacttttctttggcaaa

SEQ ID NO: 221599 - DNA, 819 bp, Homo sapiens
gtcaggcacagtggcttcagcactttgggaggccgaggtgggtggattacttgaggtcgggagttcaagaccagcctgaccaacatggtgaaaccctgtctctactaaaaatagaaaaaaaattagctgggtgtggtggtgtgcgcttgtaatcccaactacttgggaggctgaggcaggagaatcgcctgaacctggaggcggaggtagcagtgagccaagatcacgcccctgcactccagtctgggcaacagagtgaggctccatcttaaaaaaaaaaaaacaacaaaaaaaacaccacacatctgggggccaaatttggcctctccggtttcagccaaactgtagtatggaaactagctttatgtgggtatggaaactagctttatggttatgaagtggcaccacaatgcgatccatgaaatttgttggaaatttttaccccattaatgctggggtttcttaacctcagtgctagtgacattttgggctcgtaggtcattgttttttgtgtggggtccttccgtgcctttagcatggttcaggtaggaagtttagcagtgtccctgcctcgaccctctagatgccagtagcagctccttctccttgctcctgcacctgtcatggcaaccagaaatgcccagtgtctcatgcgggacaaaattgccctaagttgagaacctctgctttatacagatagattttaagtatttgtcaccaggagaatcgcctgaacctggaggcggaggtagcagtgagccaagatcacgcccctgcactccagtctgggcaacagagtgaggctccatcttaaaaaaa

SEQ ID NO: 221600 - DNA, 456 bp, Homo sapiens
cagccagggtgctgtggctctgggtgtctcctgagatgatgtaacgccggtttcgaagctggttgatgacaaaatgtcggcagcgatcactgcccctgcaacacaagtgcttgtggtctggggctgctggtcacaggcagcccagccttggcccagggtctgagctctgtgcctgggtgcaggtgaggggtcccagctcttgatccagaacagacctgcctgacctggggccactgtaccccacttggagccatggtgtgttcatcaggaagctacggagaggttttcaaaccgtggagccctgggatcctgggaagtacctaagcctgctctggtggagtcagggagagcacggctgtgactggagtgaggcaagtgaggcactcatcttaggtgcgaaatttaaaggggcaccaaaaaactcaataaagaaaactaataacgcagtattttaga

SEQ ID NO: 221601 - DNA, 433 bp, Homo sapiens
  misc_feature (432)..(432): n is a, c, g, or t
gggaacaaaaagaatcagggagacttttacccttgaagagttttcagactgaggagctatgctgtctacagactccaagacagggtcaacagtggggtgagatcaacgaacgctgctgttgttatttatgatatggagctggatttcatgttgactgaagtgtggaatatatacaaaatacagccggggtgcagtggctcacacctgtaaccccagcactttgggaggccgaggtgggtggatcacctgagaacatttttgggaagacaagactcttttcccctggtgtcagaagtaaaagacctacagatataccagcagtctctcagcatcggtagcctcattagggagctactgaatagcagctaatggtcttctgtagaacataagttgaaacaatactagatagaatgattattacaaaaacaaccna

SEQ ID NO: 221602 - DNA, 453 bp, Homo sapiens
cttcctgcaggtgctgggacccacctgggtgggcctgtgtgtctgtgtgtgccctgcaaacaggtgtgcagcttgggcctgaggtcatgcacccgctggggagacgggaagcggccctacccggccggcggacctggaggcctctgtgcacccctgggccaccacctcccacctttccagggcaccaggagccccagacccggagcggcctggctggggagccttggaggccgaggatcttcctgagctcaggcctccactggccacccctcacctggcctgcagccccgtgctctcacagcaaacttctccactgctcagcagggcctagagtacctggaagggggccttgggcagcccccctccattgccagccttgcagcccacactcagcacccccatggggtctctgaccagcccccacgcctccccctcctccaagggagggctgca

SEQ ID NO: 221603 - DNA, 861 bp, Homo sapiens
aaagaagcggagggaagcaacacagcgcagcgtgactacgtgcttgatctgtctcctcctaacgggcatgcaggcaacccaggtgccttaggtaagtgaccccattccctgccctgccttggagggccggatgagtcaaagagtaatcttatccctctgctagtgagtacaaatgaagtctgtgggccaacaaggagcgaggagcagtttcctggaagccctgggctggtgtttgacttgctttgagacagaataaatgggagaaggagactttatgggacatctgggcctagggctcctggatgctgtgctgaaaacaccacgtacagaagccagtctaaccttctggatgatgagagcccagatgcagtacagaggtgccccagccaacaatcagctgctatctgaatcccatctggatcccatctgaatcccatgtcaccatgaatgaggccaccttagcccagccagcacagctgaaagccagaagcagccgcatgcacaagcccaggggaagcccacagaggaaccaccagccaacacacagaattgcaagcagttaagcaactaagattaagacaacaattttaaaatgaaccaggtccggccgggtgcggtggctctcaggcctgtaatcccagcactttgggaggccgaagcgagcgggtcaccggaggttgggagttcgagaccagcctgaccaacatggagaaaccccgtctctactaaaaatacaaagttagccaggcgtggtggcgcatgcctgtaatcccagctactcgggaggctgaagtaaggttataacatggcctggcgtgcagtacgtgctcaataaatgctcaccgttattgttgatcaggc

SEQ ID NO: 221604 - DNA, 448 bp, Homo sapiens
tggtttgtagactgtctcccctcctgggtttgtctgatggcattctcacatttagcttttatcccttatatttcctttaaactggaagttagatttaaaagctcaattttgatctaattcgaactgtgtgtggtggttcacacctgtcatcccattactttgggatatgagagagaaaggaagaacgaagaaagatatttgggaggctgaggtaggtggatcacttgagcccaggagttcaagactagcgtgggcaacatggcaagaccctgtctctacaaaaaaaaaaaaagaaaaacaaaattagccaggcatgatagcaggcacctgtagtcctagctactgtggaggttgaggtgggaggatcaattgagtttgcaaggtcaaggtgctggccatgatcgcactactgaactctagcctgagcgacacagcaagaccctatctc

SEQ ID NO: 221605 - DNA, 479 bp, Homo sapiens
tttggctagcaggacaatgatcaattgatctctttctgtgggctgacaagaagataaacataaaggcaggcagttttcaaggcctatcctactgggaattcaagcatctgtgatcccaacacacaccacatatcaaatctggcagagcaatacccaaatcccctgtgctcacgcatacacaaatgtcctttggtgaaatacatgattaggtggaaaacccatcatggaagccagccatcctaagttaattcaaactgatattagaaattgatttatccaaaacaagggattttctttctacagaatgtaatgaggctctggaaaacacagtttgattactaacagcagagcctgtggtttgtgcacagatttgccaacctaccatgaagaatgaagcgttctgctgcatgccctcacagccccagactctgtgtgtgaagggtaggaatgaaatattccatatgttttctttgtcagtg

SEQ ID NO: 221606 - DNA, 640 bp, Homo sapiens
gggagatgtctgtcaaagtgtataaagattcagttagataggagaaagaactttttgagatctatcgcacagcatggtgtctacagttaataattaagtattgtatttttcaaaattgctttaagaatagattttaaatgttcttaccagaaaaaaaaaagtacataagtagatgaggtgatagatatgttaactggcttcatttagtcattccacaatgtatacatatattgaaacattatgttgtattccataaatatatacaacatttgtcaattaaaaatataaataaagtaactgaattaaattggatagggaaacaacaacaataaaaacccatgtccaactaaaatgccaaaatgatccagctatctgctgtcaacaagagacacattttagattcaaagacacaaatagattgaaaataaaaggttggaagaaaacatacagatataccatgaaaacagtaaccaaaaggagagctaaagtggctatactaatatcagaccaaaacgttattagagacaaaaaaattttataacggtaaagggttatccatcaaaaagatataaccattataagcatatatgaatttgataacagagcccccaaaatacatgaacaaaaattggccgaattt

SEQ ID NO: 221607 - DNA, 441 bp, Homo sapiens
attttttgtaaagtctgactttattgcttgggctggtaatcagtgtagtaaaattttgatgtttaatgaaatgaattttaataagcagccatttaagatctatttgaagttttaaaaaatatatagtaaaatatgattctactatagtaaaatatgatcttcctcaaggtctgaatgttactgattttttgtgaatcaccagaatttagtgtattgtctagtatttagtggttagtcaaaaaagatttgattttaatgattgttatttattgaaacttagaatgtttcagtcattttactaaagttatttccttatatttaatcctcctaacaactctatgatataggttaaatggtttgcccaaagtcatacagcaaagaagtggcagatacaggactccaactcatggctttatataataaagagcctattttaaattg

SEQ ID NO: 221608 - DNA, 459 bp, Homo sapiens
acccacactcaccacacaaacaactttgtttttacctgaatcatttgaaagtttcagatgtcatgacacttcacccctaaattcttttgtacaaatcttataaggataaattttcctacagaaccacaattccattgtcatacctaagaaaactaacatgattgaagaataatttaaatatggtttatattcaaattttctcagttctaccaaaagtgtcttttataagttgtctttcctcctgatatattacattggtttatggtatctttttaaaatctagaacaatcaccccacctctcttttttctttaaaaccacatcaggctatgctataatttttgtttcaatcatcaaacataatgtagaaaacttaagaggaaaaggaaagtctattacatttacctatacttttgcttactgtgttcattcttccttcctgaagtaccaagattcttta

SEQ ID NO: 221609 - DNA, 510 bp, Homo sapiens
tctggagatgactggaattgtgtaagccttggtgaaacctgaatgaaatgtactgaccaatgattagtataatcctgtgctagggactggtactcccaagggggtaacctctattaacttgtcaacattgtttatgcaagatggtcagattgatggtctgcacctggtttgtaaggtttttgttgttgttgttgttgttgttgttgttgttgttgttgttgttttggcttctgctgttgagtctgatcttgtaacttttataccctccgtgggtataaaagacccctcaccagatgagacgtcggctcccctgtgacaagggcatctctcacatttcttggtggttcattatctgaagatgaaggatgtcctgttgactgggacagcaccctgggagctatgtttggaagtctcagtcaactgtttttactgtatcagagacagatatttctcctgcagtcctgtgtcctttgccttcattaaagattttcatgagcataccctatagaa

SEQ ID NO: 221610 - DNA, 483 bp, Homo sapiens
cagagatgtgtcccggggcctggagggtgacggactagcccaaggctaggagtgcgagggctcctggaggacggcccctgggtaggaagtgaggccctgcgtgggatcgggcctgggcgaggcatgcccaaccttcaccgcctggctctgcctggtagcaaccgcagctgtcctgggacaccggggccccccggcttcttccttcttggtctgtgctgatttcaatactgtcgggtacagccggggcacgggtagcgccacttcccacacatctggagaagttgctgccgaggagtctttaccccagggaagaggacgaccccaggacatttgggtgcctgattgatgattaaacacaggcctggccgggcgcggtgcctcacgactataatcccagcactttgggaggccgaggcgggtggatcacctgaggtcgggagttctagaccagcttgaccaacatggagaaaccccgtctctact

SEQ ID NO: 221611 - DNA, 592 bp, Homo sapiens
tcccaggttcaagcaattgtcttgcctcagcctcccgagtagctgggattacaggcgcccggctctacatctggctaattttttttgaattttttttagtagagacggggtttctccatgttggtcaagctggtctagaactcccgacctcaggtgatccacccgcctcggcctcccaaagtgctgggattatagaagtgaggccctgcgtgggatcgggcctgggcgaggcatgcccaaccttcaccgcctggctctgcctggtagcaaccgcagctgtcctgggacaccggggccccccggcttcttccttcttggtctgtgctgatttcaatactgtcgggtacagccggggcacgggtagcgccacttcccacacatctggagaagttgctgccgaggagtctttaccccagggaagaggacgaccccaggacatttgggtgcctgattgatgattaaacacaggcctggccgggcgcggtgcctcacgactataatcccagcactttgggaggccgaggcgggtggatcacctgaggtcgggagttctagaccagcttgaccaacatggagaaaccccgtctctact

SEQ ID NO: 221612 - DNA, 402 bp, Homo sapiens
cactttccttctgttgctgcagtttggaagtagtttgttatcaggattatcaaagcatcattgctatttatgacaatgactttaagaaatgcaagaatatttggaacactgtagaaaaaatattttagcctggaaggcaaatactaatttcaggaactattgatctgttataaaacaggaccactcagacatttagctctaagacttttgcatatctgttgttagaggcgtatagtggggggcatgactcagcttctgcttaagtacaagttgttgtctgcagcgaaggaagaatttgattgtagtatcaacagaaccagacagaactctttgaatataattatatatcttggaaactgactcatcaaagctattagattacatagcatcatttaagcatca

SEQ ID NO: 221613 - DNA, 466 bp, Homo sapiens
ttttgcattaacctaatacaattgtatgtgtctgcatggaaacttttgtagaaaaagggtaaatcaatcatttgcttgttcataggctttaatttcttcctgagtcagcatggtataatctgaagagcttgggagtcggactcacatgtccttgtgtgcaaaaacccagttctgggctgggcgtggtggctcacgcctgtaatcccagcactttgggaggcctaggcgggcggatcacgaggtcaggagatcgagaccatcctggctaacatggtgaaaccccatctctactaaaaatacaaaaaattagccgggcgcagtggcaggcgcctgtagtccaagctactcaggagactgaggcaggagaatggcgcgaacccgggaggcagagcttgcagtgagccgagatcgcaccactgcactccagcctgggtgacagagcgagagtccaactcaaaaaaacaaa

SEQ ID NO: 221614 - DNA, 328 bp, Homo sapiens
caggaaaaaacattaaccccagcatcgacactttttaggttcactgtaaatgttccccgcttcctaaagagcattcccaatggagtagacagaagctgagaagcatctctcagttctacaatcattggccctcagctgtagacctagacctcattaagtgttattaactgaaaatgtctacactgtgtttgtcttagtatttctgtaagcttcggtccatttgtggctctggtcttacaaacttgtatatttgtctaaatgttgtctttgattttgtaatttcccatcgtgtacattttaaagtaaatcattggaatgtagtcggtgt

SEQ ID NO: 221615 - DNA, 166 bp, Homo sapiens
attcttttaaaagaacatctgttgaaactggcaatttacattcttcttaaaatacggagcgacataattaaccctctggggagactaatattagtttattagagacaatttctagttctgtttatttttaacactaaacgatttgttcagattggggaaaaaattt

SEQ ID NO: 221616 - DNA, 427 bp, Homo sapiens
aagcacattactggatgaactcattgacttcgcactaccaccctatggggtcaatttcttttctcatccccattttacagacagggaagccaaggcccagagaggttcagcaacttgcccaaagtcacacagcccccatggagggagatgacaccaccatgagacctggggaggagtgggggcagatggtgggtacgaggagggggtgaggctgtcaccatgcctgctctctgacctgcagtgacagacaggaagaggaacctctaccaggacagagaggagatgggtacagacagttggtctccccatgcctgctcccacttctcttttccctgggacggctgtgaccctcccactggaactcttcagccctagcccatgtgcagcaggaagtgagacctggaaagggaagaggacacacttctgc

SEQ ID NO: 221617 - DNA, 161 bp, Homo sapiens
agtcaggtgtgtgtgtacagcgggggacgcgcgctgccggctcctgggctggcgacagattgtgcaggaatgcgaggaatgcaccaggggcagagtccacacagcccgccgcggctgccctagcgccttccctccccagctctcgccgcgcagccagaggt

SEQ ID NO: 221618 - DNA, 205 bp, Homo sapiens
aggaacttgcttaatatgaagtccccagagcctgactagaacagtgcttaacagaataagccatggttgaatgaacaattgaatgaattaatgaacaagggagatgatttttaggacacatgtgaaactggggctctcagttccttgctccacaacacccttgctcctcttggcatatccactctcttctctctcttccttgctc

SEQ ID NO: 221619 - DNA, 342 bp, Homo sapiens
attctaaccctgacatgccatgatttggatttctttaaaattatgtactattcatcacatcagtattatgtgattcactatttagactgagccatgtgaagttaccatttttataggtcagaatggttctatctattatcatgtgactgtcccatttgccctgtttagttttcagatctttccttgccattccatccttccgaataaaagagatatgaaaaggccgggcacaatggctcacgcctgtaatcccagcactttgggaggccgaggcaggaggattgcctgagcccaggagttcgagactggtctgggcaacatggcaagaccctgtctgtattt

SEQ ID NO: 221620 - DNA, 327 bp, Homo sapiens
agcacaggcaaaaagagggtcatggtgccatccagaaaataccaaaaatcaccctctctcagctaaaatgagcaactgctactttaccagtgacagctttgtcccagctctagtctgccttccctatagagaagatgtattgagataatcatgaaattctccttctttctgatagtatccaatctggagcaaacccgtttccttagaccctctcccaatcccaaattctatactaggttcttctaaacactctcatactgagacaccccatggttccctatgttgtgtgttcttctttgctgcaatgagtaataaactcaacttgtt

SEQ ID NO: 221621 - DNA, 407 bp, Homo sapiens
cattagtgtattttatgtgtggcccaagacaatgcttcttccattgtgggccatggaagccagaagatctgcaacacccctgatctgtaacatgaaagacagagacctgagaacataaaagacaatttggaattaacagactaagtaggaagaaaaaaaatcttaaaaaagattaaaatcctctgagggataatataagatacccatgaggcaagaataggatgctacaaaagaaacattcaaagggaggaaagaaagctcttgaaataactgaaatagaaataaaactcagtagaggaagataaaataaggacatgaattggaaagaagcagagaaaaactgagtatgtttcacatctgaaaagcagaattctggaaaaacagagggaattgttatcaataatata

SEQ ID NO: 221622 - DNA, 602 bp, Homo sapiens
agctatcacatacccagtagctccaatatgattatcagcaaatttctaggcagaaacattgcaggctagaagagagtggaatgatatattcaaactactgacagaaaataaactgacaaccaagaatattataactggtaaaaacggtcctttaaaaataaaggagaaataagattttcccaggtaaacatagggcgagaaagtgcatcaccactagactggccctataagaaatgctgaagagagttcttcaaattgaaatgaaaaaaatgttaaacagcaacacaaaatgatacaaaagtataaaactctctggtaaaggtcaacatatagacaattatagaattctgtcatattataagcaaaaaaattacttttaaatctggcataaaagtatttaaacaatagcacagaaagtaactctaaatctatgttaatggatatgcaattaagaagcagtattatgcatcatcaagaacgtaaaagtggatgtggatgaagtaatacaaagtagagtttttctatgcagttgaagttaaattgttatcagtttaaaatagattcttatacatttaagatatttgatgtaattgcaatgttaa

SEQ ID NO: 221623 - DNA, 394 bp, Homo sapiens
gcacgaggcaagaccctgtctccaaataaataaataaacaaacaaacaaacaaataaagcaagagagagagggagagggttagggagagagagagagaacaattttaatagtatttaaagaaaaaaaagctgggcgtagtggctcacaccgtaatcccagcactttgggaggctgaggcaggaggatcattggagcccaggagttcaagacctgcctaggcaacatggcaaaaccctgtttctactaaaaatacaaaaaaagtagctggacgtggtggtgtgcctgtagtcccaaccactcgggaggctgaggcaggagaattgcttgaacctgggaggtagaggttgcagtgagccaagatcgcgccactttactccagcctgggcaacagag

SEQ ID NO: 221624 - DNA, 317 bp, Homo sapiens
gtagagagacttggagtggtggaataaaagtctctttgaagaccaagctctccatcgttagtgctcagagtcagccacttgaattttcatgacttttctggaaaacatgttggtgctactccatcactcttttcttagccattgtagtcaacttagagggcattgtacagcagataggaaggttgaaacagaaggtaagacctggagtattgctctaggaaagtatgtttgcattgagttattaaatctgtgtaagttcctggctggagttccggttgcagttgcaaaggtccagcctttttcctggccctagggag

SEQ ID NO: 221625 - DNA, 480 bp, Homo sapiens
catctactgagagcaaggctttaggagaattgtctcccttaagctcatgaaaattataaatttagtaccgtgatttctatgatagtgttttggagcttacagaggtaaacaggaccaaggtaccagaattcgagctcaggtctctctgacaccaaaatccaccataccatggtgcttctgatgtaaggtgtaaaaaagacaatagccacctctcccagtctgcctccttccaacctcccacacaattgattacgatggaatcaaacattgtcagctgagagctataataaggtcagagttacttgttgtaatttattttgactgaaatatgtacatatctagatatagttggaaggtatatgtgattgccagagtatataaagatcaacttagactacctaatgattatgaatggagcacatacccaaagctatgtgtgatgatatattttagtggattaaatatattaaaagttctctt

SEQ ID NO: 221626 - DNA, 556 bp, Homo sapiens
agaatagaagacctttgcaccagagaatttctaaggcccctgctagccctactctgtgtatgtgtgtgtataattgctttaaaacttagccccatctcagacttacctagaggaccactgggcattagctagctgtcctaggagcttaatctgtgtatgggacattggatagtcacagttggcctcctacaattgggaattctaccaagctccaagttgacctgggattccgacagctttcccttccactttgagggattaaaacattctactggctgggcgcagtggctcacgcctgtaatcccagcactttgggaggctgaagcaggtggatcacaaggtcaggagttcaagaccagcctggccaatatggtgaaaccccatctctactaaaagtacgaaaattagccaggcatggtgatgcacgcctgtagtcccagctacttgggaggccgaggcagaagaatcacttgaacctgggaggcggaggttgcagtgagctaagatcgtgccactggactccagcctgggcgacagagcgagactctgtctcaga

SEQ ID NO: 221627 - DNA, 356 bp, Homo sapiens
tggggattcaaaggtaaatcaggcatagtatctgcccttaagaaactcagttcactggatatcttgatgtggaaacagatacttaatggccagcacagagatgaggaaagcccagagcaggggtatgtagccccaaggctgggaatttagggagactctcccagaagaaatgatctgaacagaatcaggaaagactcccagaagaagtgatctgaacagaatcaggaaagaagagagtgattggaagggctcaggatttgtgtttatttgggcattaagatgcagcttgcctcctgttgttgcatttcttgtttcattgtatttttccaataaagatattttcagaaacctcacat

SEQ ID NO: 221628 - DNA, 488 bp, Homo sapiens
aattacaaaataaatataaatccatgcatttacagccaattccattttttgacaaagacaccgggaacatacaaccgggaaagaacagtctcttcaatatgtgttacgagaaaactggatagccacgtgcataagaatgagactagacccttgtctcttaccatacacaaaaatcaaatcaaaatggattaaaaacttaaatctaagacatgaaactacaaaactactagaagaaaacattgggggagaactccaggacattagtctgagcaaagaatttttgtgtgtaagacttcaaaagcacaggcaacaaaaagaaaattagacaaatgagattacatcaagctaaaagctttctgcacagcaaagaaacaataaacaaagtgaggccataacccacagaatgggagaaaatatttgcaaattatccatctaacaagagattaataacaagaatatataagaagctcaaatagctcaatagcaaa

SEQ ID NO: 221629 - DNA, 450 bp, Homo sapiens
aagaataaaagtgtaaataacattagaaaaaagtataacagggcctgtgttatgggctaaattgtgtccctccaaattcacatgttgaatactagcccgcagtactatgtggagagataatgtgactatatttagagatggggactttaaagagacacttaagtttaaatgaggtcatgggggtgggtcctaattcaaaatgactggtgtccttatgagaaatgggagagccactgggaatgcgcccccacggaggaaaggttatgtgaggacacagcaggaaggcagccatctgccagccaaggagagagaagccagaagaaaccaaaccttccattaccttcattttgaaattctagcctccagaactgtgagaaaattattcctctggtttaagccagtcagtatatagtattacgttatggcagccctagtaaactatggcggccg

SEQ ID NO: 221630 - DNA, 292 bp, Homo sapiens
ttgcaggccaggtgcagtggttcacacctgtaatcctagtgctttgggaggcaaatgcaggcagatcacttgagtccaggagttcaagaccagtctgggcaacacggcaaaacaccatctctataaaacattttaaaattagctgggtgtagctatgcatgcctacagtcccaactactagggaggctgaggcaagagaattgcttgagcccaggaggtggatgttgcagtgagctgagatcgtgccattgcactccagcctgggtgacagagagagaccctagaagatttg

SEQ ID NO: 221631 - DNA, 299 bp, Homo sapiens
gcctaaaatctgagacaccttcttgactcttcctctttccttcaaacccaccaagtctcattcattttatcttatcaatctctctcaatctgtctgctccattttattttcctgctgcctcaactcagaatctgtcatgcctaggttactgcagcagtccctttcatctcttcctacaggcttttaagtttttacctgctgggtactgtattgcctgtaggtagtcattataaatgcaaacctatgcagatttcttccaggggaatttagggctttgtgctttgaatagtttctactta

SEQ ID NO: 221632 - DNA, 449 bp, Homo sapiens
agtaattattgtagtaggttgtagcggattcagtaaatatatccagttcctattctatattctttctaggtgttaggaatgctcccaggaggtacaaaagctatcagtcgctgcaccgaaggactctaggatgctatgacttagttttggaccatggagattgcccagcaagccgagaatattccagccctccaacattgttgttaaaaagtccactgctgtatgttaggtgacttcccaaagctgctcactacttcttcttattctgttttctcaaccccacaaaaatccaatcactgaaatcctgaactcttttgatagtggcatgagtgttaagtaaattgcacacctcttgtggaattcattttcacttaatcatgctaattatgtggagacttgtttgttgttgttctttgtttttttaagtaaatcaatacctaaatttcctg

SEQ ID NO: 221633 - DNA, 1027 bp, Homo sapiens
tttgctttctgataataaaatgtttgtagttttacaataacttccctcaagttcttaattgattttaaaatatggtctattcagtattaaacccagtttttagagaggatctgtgatgcaaaaattatttgcttggcattttcacttctgtccaaaaagactgctgttttttactcacaggcaggtgaagtctctgtaggcccatactccctctccccagcagcttttgtttctagcttaccttaccttacagggtaactcaatctgtagggtttattccagagcacctccttttacctcaaggatggtatttctggttcccttaaagtaaagcctcctcagaatgttttattcctgggccatgagctgtcactctcagggaccagcctgtgcacaagtcatatattgtgtgcacccgtctttttggtctgctgctgagtctctgttttccatgccgctgtccccttgtcccatgaccacaatcactctagctcctccccgtggagcagcaggggcttaagaaattcaaacaaaacatgtatccacataaataatactgtcataagaaaaaggaagttgaaaaaaatggaaaacccacttcaatagatacgcttttgactcctttgaactctgcacagtgtgaatggagcccttatgcttgggctgaaaacttttcctctacttctgagcacatgtgtgacttaacattctccttgctgagttgaagaattctcagtatgtatcacccaaagccaaaaataagttatgattgaaatttgggcacataaagtgattttgatactcattttttcctaaaatgaaaacttagatgaatattaggtaggggtttgaacaatgtggaaatcttttaactgttctttgagtcaggtcatgtaaagtatctttgtttgccttccccaggatggggtgggggctcttaggcccttacatcttcgggtggtgtaaccagtctggataataggcatagaggactgcagatcaggagatggaaaagtactggaagtga

SEQ ID NO: 221634 - DNA, 485 bp, Homo sapiens
tcagatcatttataaaatgcctgcagctgtttggtagggtacacaggtactaatttaaagtctgattccaccctactcatacacacaagtgttgtatgcatgtatatgtgtgcacacacagcaccagaacagccaaaggcctagggaggcggaaagcttgttcactgtgtgtctgtgtacgtgcacaatatcaccatttccccaaaaggatgaaaccttgagcagcagcttctgcataacactaggtggcatttcatgtagaaaagaacaggcaggcacactgcaagtgtgaaggtcactgttcgtggttacatttaccctccttgaatctcgagatctcctggagtgtgaccgctgttggtgagccattcctgcttcggagactaaatcagcattgaacccatttgcatcaagatgtaatgaactagatgaatgggtgcctagagatgatgcggcgggtgagaagtgcgctaaggcgggccggc

SEQ ID NO: 221635 - DNA, 512 bp, Homo sapiens
cattgcaagtatggatcaatattcattgaaaagttccctcttaaatctcctttcagagcccagcatactcctaagttctagtaagtaaatggaaaaatagggcaaaactctcaacttagatccttaatattccctcttatatctcctttcagagtccagcatactcctaagttctggtaagtaaatggaaacatagggcaaaactctcaactcagatccttgataaagttttcctgtgcttctgaattttcttttcaagggttcttttcttggcccggcatcgtggctcaggcctgtaatcccaacactttgggaagtcgaggtggatcatctggggtcaggagttcaagaccagcttggccaacatggtgaaaccccatctctactaaaaatacaaaaattagccaggtgtggtggcacatgcctgtaatcccagctactcaggaggctgaggcaggagaaccccttgaacctgggaggcggaggttgcagtgagccaagatcgagccatt

SEQ ID NO: 221636 - DNA, 377 bp, Homo sapiens
aaaactggttcatttgtcctgtagagtttcttagagtcttgatttctgtggtaatttagcatgttcctccatcctctgtatttgatataaattggtaacttaatcaaatttagatttcttttggcaaaactaatttgtagatggttttagcacttctatcaggaggtatacaggaggtatacagtggtggtctttttgtgattttaataactgatatttgtttctcaaccgtggcactattgacattttgggctggaaaattctttattgtaggggctgtcctgtgtattgtaggatgcttagcagcatctctggcctctacctaatggatgccagtagcacctcctcctgactgtaacaataaaaaaatgtgtcta

SEQ ID NO: 221637 - DNA, 203 bp, Homo sapiens
attataggtaggagaaggtccaggaccactgcccctgtgttaagcaccagcatatatcccaagcagccagagagctaagcagatgatgagaatgaggcccaaatgcctcagccagggaaactcactgaaagtgacactccaaaacctgcactgcaaagaagacacaatcgtggatgctttggaacagtggactttccagggaa

SEQ ID NO: 221638 - DNA, 549 bp, Homo sapiens
attgctctataaatcatattggccaggagaaaggatgttcagttccctaggcttttcatcatggtcaattagggaatcagcccaaaaggtcagcatcactgcccttaaatgaggtcacactccatgcactctgagtaccccggaaagctgtggtgctggtgattaatgcatgtgtccagacacctggtttcaacgaggcaaatccctggcatacaatcccagcttgtctcttctcactgtgtgtatttctcgagctggcctgtcaccatgcaaagagtattttgaaaatgcagtttatgctcatcttggatgcagctgagatgccatggaaagaagtcagactttggaataggatgggtctcaggatttgggagcatgttccattatcccctcaagttttgattccctcatctgttaaaggttattgtgaggataagatataatgcctttcaagtgcttgatgaagggcctgaactatatcaggtactcatgaatgtttagtatgatgcaaatttcaagattaataataaaagaagctgcaccagaatg

SEQ ID NO: 221639 - DNA, 376 bp, Homo sapiens
taattttccctagggctgatgtcaagcatattggtctgtgatttctaaaatctttctctttttttgtttgtttcaaacatgggagcttttgtgcatctccaagtacatggcatttttctgtttatttctcaaagaatttgggtcaacttgtgggaaagtttagaaaatttcacttcagcctcagtagcttgacatctttttagtagtttgaagtgcttaaaatggtgaaaatttctctcgctgtttctttaatgtagtatttttcttaagaaaccgttttttccagaatgaagataaatttcagcttagatcatgcatgaagaaactcgttttaaattggaagagtttatgctaatgatatttatgctgtacaaaa

SEQ ID NO: 221640 - DNA, 264 bp, Homo sapiens
agtgttcctcggcaatatgcctgtgacaagcgtttgctgtatttgttgttcgacttagggtagttgaaagagtctctctcagccactctctctggatattttgttgtggctgtgggcactgtttgcccagcctctcactttgtagcggaggggtgggactctgcgtgaaaggaccagcgttatagtccctggcttctccggctaattcatcccgaggctcctgccccttcccattctggaaggggcgagcttatcctagacctg

SEQ ID NO: 221641 - DNA, 422 bp, Homo sapiens
atgaatgaataccaacagatgcaatatttaaaacttcccaattcataatataaccaaggctaaaaaagtaattttcttactgacacaataatttagacttaatccccttctggggaaatagactttaaatgtagatgtatgagacacttgtactgcctttttccgaagtctttaattggctgaaaatatttctaagtagggcaaatcattagatcttttttaaccattccagcattttagtatgtatgggagggaagaatgcctaaagagtctcaggagacatgccccttcagggatgaagcacagattgggtttggtagcttgagcctcctcgacaacacatgacatgctaggaagacagagatggaggactgagagcaaagagacactgggtgctgaaagatgacagctaatggacaaaa

SEQ ID NO: 221642 - DNA, 424 bp, Homo sapiens
aaagctttcagctttctgagaagtattttctggagtatcacacagagtctatggcagagtctatggcccagtgaaatcagaatgtgcaggtccatttaggctagagggagggtctctgctaaaagggcagaataatcagagggtgtttctgtctcactgtgcagcaggttggtttgctctgggctccctctgtgggtgccaaactaaatgctcaaggctgtcctgcagctgtggtcagtcattcaaggaaaaatctttgtggaggtaagtgagccctccaggagacatggttttatagactttccatattacttaggtattgggaggatggctctgataaaaacagtgcacttaataaatttaaaaataaaacaaattttgttgtagcactgtcttcttagaaatcttccaattgaaagcaaat

SEQ ID NO: 221643 - DNA, 1430 bp, Homo sapiens
gtgggtgatggcctttgaacgtaagtcaacggttgggtggatctaggagggctgccacgtctagagtaagagggtggatgttggctacaccatgggaagagtgactcttagagtgagggggtgtgcagttgtggattgagctgggagctctaccagtgtggataacaaagggagatttccctgaaggatgttcctggtatcatcacagctagggaatttgggtttaagtctaggggaaatgggcctttcgcaattcccatccaccctctcaaaggcctcttctggcatcttcattcaaaactcttccctgtcttgaccccagcccatctcaagaagccagtagtaatccagaatcattcaggtaatgtgcgtggctggcagctgagagattttagtctccctctggacactggagccatcttcatatttaagagagaccctgcttatccagaaagcaaaacatgtcataccctataaaactaaatactctttgctcaagttgatcaaagatctattacaataaagccattctgtgaaaagaaaatatagttttaaatacacagttctttatggatgccaattcgtttttcatttagttttaaaatgtcaaagccacccctatcatttagaaaggatgcatcatcgcagacaacagataaggtttcgttgaaaaacacaaattgttcaaaacacattaccttttgtattgggaggagagtagtggacatcctttagtcatcttttctgtcctctatacctaactcagttcctgtcaggtagtggacactcaatgtgtttgccgaatgaatcaatgaaataccaccgattatcccaaatagagtcagaaatgttgaaactgcttagaacaggacatttagatattttatattgcaatttcacagacccccttaaaattcttaagggtaaaagaaaaaatctcctgacacttagaactttgaggtgggcatgtggattttacccaggaaacatcttatttggcagtagtgaacaaataaagtataggagttttgtgatttacatgtagttgctaatggtttcctcaaatatttgacctgaaagagacctagttcattctccttatttaacaggtgaggaaatctgtaccatagaggttcagtaacacagctggctgatagcagaactgggattctaaatccttcgatttctaatctagtgatctttgtatttcactgaaggtttttcaaactgtgctgtccagactctaaggaattcaatagaacatgctttatgcataagtagaatgacgaaggacagagctgtacccctattcctacttccaccccacccagaattgagcagtttttctctgtcttataatagatttatgaataatattttgtttgttcagtttcaataaaacctaaaataaataatttgaaagctctaaa

SEQ ID NO: 221644 - DNA, 428 bp, Homo sapiens
agagtgtccagtaaggagcgcagcctcatcgggcatcctgtgagactctaagcagggtctgaccgactcctcaactatagaactgtgagataatcaatttgtattgttttacacctctaagaagcaattataaactattataatacatgggagaaagttcgctttgctgattagggaatacatgtactgatgaaagcaaaatacgtttgtttgaaataaaaatcgtgctaaatgggtttttttctcattgtgaaaattacatgatgaagggaaactgggtgacttaatcaccttttgggtgatttaaatcatattttatcacttgaaagcagcgtttctgaacttcccgtacaaacctaactaaggtaaatcaggattatgctgttttccttctagaaattatccaaaagttaaagacagagttaaaa

SEQ ID NO: 221645 - DNA, 566 bp, Homo sapiens
agaaacactcattttagctttgaaactccttagaggcttgttcagtggcctttgagtgaagcagtaaaaaaagagttagttatcaaagagaaaacttagaatacaaaactataataaaagatattgcattcatgcaataaaaagtgtgctatcaaaaaggaacagaacacaaatctttgttcagattttgtcttcatgaggcctacccaaatttgccgtatctgatattacaatctaccccccacgcaatgtccatcctctttaacctgttctacgtattctttttttctccagaagccctaccaccctctgatacactatgtaatatacttgttcactgttctattgatttattgtctatctcttctccctaccagaatgtagtaagcttattgtctgcttgttcaagaatagcaactagatgtagtagatgtgcagtgagtgtttgttgaatgaatgaataaataaataattcttgtaaattaaaaatatgatagcagaaaaaaagaagagttacaagataaagtttagaaaattgctttcagagcaggaaaattgtagaaaaa

SEQ ID NO: 221646 - DNA, 404 bp, Homo sapiens
caccgtctgttaattgaatgtaataaaacttttagaccaaacttctaatttacaggaaacacaaagaacaggagattctatctctcctttgctggcctggaagaagcaagatgccatgttatgtgctgccatagggccacgtggcagagctgagggcagcctcctgctgacagccagcaagaaacaggagccctcaatcccacagcctgcaaggaactcaatgctgccaacaaccacaagtgcttgaaagtgaatctgtatccagtcgtgcctcagatgagctagcagccctggcagacaagctgtttatagctttgtgagaccctgaagcagaggaccaagttaaggcatgctaggactcctgactcactgagatagtaaagatgtgttgttttaaaccatta

SEQ ID NO: 221647 - DNA, 356 bp, Homo sapiens
gccagtgagggctcaaaagaaaataagaaacagtatttgaacctacatgaagggaggttcttgtcatgtagtggtagaaagcttagggaaattgtttcctggaaacagaactcacaaatggtaaacttagatacgtagttaaagatatttccaagcaaggtattgaagatatgcctggtttgcttacagtaaaaagtgagagaaaggagacaaaaagtaaccaagactggatgacttttaaaattccagcttctctgtgtggcaaaataagcctagaatcagaaatggctgccaaaagtgtggcacaaaaagatggtcaagtgtatgactgtacaaccttttactaaaacctcaaa

SEQ ID NO: 221648 - DNA, 484 bp, Homo sapiens
actaaatgttttaagttgtgacaatactagcagggaggagtagtttattagcaaggcagcgtacaggagcacatgctttaatacatgcatataaaatgtgcatgtatgtgtgtatgcacacacatttataatgtgcctatcatctctctatatatatgtatttaaacatcaatgttttcttttttaaaaagtgagatgaggccaggtgtggtggctcacacctgtaatcctaacactttgggaggccaaggcaggtggatcacctgaggtcaggagttcgagacgagcctggccaacatggtgaaactccatctctactaaaaatacaaaaattagctaggtgtggtggcacgtgcctgtaatcccagctacccaggaggctgaggcaggagaattgctagaacccaggaggtggaggctacagtgagccgagatcgcgccattgtactccagcctgggtgacagagcaagactccacttcaaa

SEQ ID NO: 221649 - DNA, 539 bp, Homo sapiens
aaagtggtggtaatggatctttgttctagcttctgatatttatgttattagctattggtttaggactattatttttaacatgttaatgttatccttacttttttttaaaaatgagaaatggatgttaaattccaagactgacttattgttttctactttgatttattcatgttaaatgatcattcgatttgagtaataactttttaggtccttcttttagagattttgatacatagctactgaaggggggcttagcaccattttagtcataacaagaactaaaaaacttgctttttctttatgctcatcaacacttaaaatagcataacaatgactgggttgaaaatctgaataaatttttgcatatgaagtcatctgtgctgaaggatgttttgagaagtagctatataaaaatcaatttcaggccgagcgtggtggcccaagcttgtaatcccagcactctgggaggccgagacaggtggatcacctgaggtcaggagtttgagatcagcctggccaacatggagaaaccctgtctc

SEQ ID NO: 221650 - DNA, 641 bp, Homo sapiens
taaatggtatattatgataaaacagctgttatcctaatgcttggcatttgccaggaactctgggtatgtttatgtatataaaatcacatttcatccccgcaacaatcccatgagataaatattattgttattaatccctgttttacaaatgcagaaactgaggtacagagaggcttagtaacttacctcagtcacacagctgaaaacactagaatctcggactttcacctaggtctctctgactccagagcagcactcagtgttttgcttcctgggtttgggctttttggtgaagaggaaaaaaaaaaaaatggaaaaagtccaggtcattggcttttagcccaccaaaaaactaaccaaccaatcaactctgaggtaattgtcaactctttaccctccgtgtagaagaggctttctcaattgaaattataaaactggcacagaagcaaactggcgtggtgcacggggtatctgggcagttggaaatcttctagaaaaaaaaaagaaaccaataattcttcacttgcttaattcttaattctcttttctgacagtttctctctcaggaggttaaggaacaataagagatggcctcactgaaattatattctgagcaacaagaaggatctgtctggtaaaaa

SEQ ID NO: 221651 - DNA, 612 bp, Homo sapiens
catatggacaaactctgccattgcacctaacatcctatggaccaaagtcctgtggaatttccacataaaaataaatggaaagttgcccatgtctgaagaagaaaatatatttgagaagtactgtgaataaagaacagtgtttttctatgttgattcaaagatggtattttggtggctggaagaacgttagctgcaataaaatattaactattttcaatccaccaagtttggcgcattaattttgaatattggagaaatactatgcaacaagcatgtgaagacatgggtatggaatatttaaagaaagaaggttttatctaaaggtggaaacgtgtgggtctccagtaaaagatgacgaatggaactacagaaatggacaagatcattaaagaagaacagtaatagaagagagaattgttatgaagactaaataggatactatatcaatgcatttcatactatatcagatacataatatatgttcaataaaatgatagtttttccctttcctttgccttataaataaaatgtctgccatttatctcttgcagtgagacaagggataatcttaaaaatattttaacctaaaataaatattcttcaatttgtaaa

SEQ ID NO: 221652 - DNA, 247 bp, Homo sapiens
aattttagaattcttttttaaaagttcttgcatatcatttctcaggtttgctttaaacggctgtacaaatttttgaatggggtattattaattgttcgaattggttaaagcaagaatgctattgtttttgtatattgatcctctatccaaaaaatggactgaattctctaactactgctagtttgcagattttcctggatttgcaaagttaaaaatcatatgcaaataaataattttgtatcttcca

SEQ ID NO: 221653 - DNA, 250 bp, Homo sapiens
atgacatatgtccaccgttacactatcatacagaatcgtttccctgccctgaagatcccctgtgctctgcctgctcatcactctcaccgcccagtccttggcaaccggtcattttttactgtcacatggttttgccttttccagaatgtcattgaattggaatcacacagtatgtagccttttcagattggcttctttcatttagtaatatgcatttacgattcctctgtgtctttttaaaattttattt

SEQ ID NO: 221654 - DNA, 538 bp, Homo sapiens
ccaaagaaaggtcaagaaaaagcgaaaagacttgggaggatgctttgaaatgaaaagataagaattggagctacagtaggttgtaagaagccccggttgcaaaatattgaaactatgagcaagctgtagtgatggtggagagaagagtttcaggccaagggaaagaagcagctcagaggagactgagctaggccagtggacatggccccctaactcctgccacagagccctggagtctcctggagccagagtggctcctcagtcccagggcagtgaggcctatcccttccaatgcctcttccttccttctgtggaagaccaactccattgatgttccatgtttatctccctcctgagctaacctagctgagtctgctccttacaatcaagaaaacccacccactttactggattctctctgtgtgcagcgatggtggcatatatctttgtagctttttgcctctaatataatgcattataagggtaagtgatgagttctcagtaaatgaatgttgaataaacgaatttttgaaagcgc

SEQ ID NO: 221655 - DNA, 521 bp, Homo sapiens
gtggttgatagagactgagaaaggtagtgggaagggaaggataaggagaggttggtaaatggatacaaaattacagctaggccagcatagtggttcatgtctgtaatcccaacactttgggaagctgaggcaggagtattgtttgaagccaggagttcaacaccagcctgggcgttatactgagaccttgtcgctacagaaaactaaaatattagccaggcatggtggtaggcacctgtagtcccagcttcttgtgaaggctgaggcaggaggattgcttcagtccaggagcttgaggctgaagtgagctatgagcgcaccactgtactccagcctgggtgacaggcctaggtaacagagtgagaccctgtctctaaaaataaaaattaaaaataaaaaaatacaaatttacagctagataagaggaataagttctagtgctttatagcaccgtagggtgaatatatttaacgataatttattgtatattttgaaaaatccaaagaagaggattttgaatg

SEQ ID NO: 221656 - DNA, 386 bp, Homo sapiens
tatgcaaatactatgccatttttcatcagggacttgagcatccatggattttggtatccagaaggtcctggaaccaatcccatcccctttggataccgagggatgactgtattacagtctctaattatcttgtttactagttatgctctttcattagaatgtaaactccataaattcagggaccttctctgttctattcattgtatctccagcttgagcacagtgtctgacacatggtagtcattgaataaatgttccagagattgtctagttgcagaagataccaagttgttaacaagctaccctgtactcaggaagccacattttagtggagcagacaataaataaacaactagatgttctgtataatttcaggtagtaatgaa

SEQ ID NO: 221657 - DNA, 370 bp, Homo sapiens
agtgaatagaattaaattcaaactcatgtctgtttacctccaaagcccgtgctctcaaccgtcttgccatagtggtccccaggtaaatgagtgcctgaagacagtgagtgacttgtacagtccagcagttactgaggttgtcctttttcagggtatgcgagactaactcaccagcactctgttagctgtggagggaagggaggattctgtctggagctggaactgctcagggagcccctctctggattctgcactgacagctgcagacagaaaccacgtggcacctccgaaaggagaaagctctgaaatcatccaggtagcattctttgacttttcaatccttttcataataaagtatttaaaatgtaca

SEQ ID NO: 221658 - DNA, 419 bp, Homo sapiens
agctgggctatccttgagtacacaccatttcaaggagccaacgtggagtctacgatggaaatttgccccataggaatatgaaagtgctgtggcatagagtattttatagaagttaaatgtctaaccttaatggattgctaacgttggcttagattattgctaatgactacaggattttacagaatgtgataagctttgaaataatgactatattagtaacataagaccatgagagcaactaacagaattataactaaggaaccctgttacaggcaatagaataacgattgacttctatctaaaacatcaccatttatctttgaatatttatcactggggatgattcttagagcattcatcaaaaccacagcttaatatcatcaaattattccatttccacattcttttaaaactgtaac

SEQ ID NO: 221659 - DNA, 454 bp, Homo sapiens
gagtccctttcaagtgagtttgcacacaccatcaagcaacaagcctctcattaattagggttaggaaaccaaggttcaattctcaggaagtcataatttcattcatttactcaatatgaatttacaaaatgcctacatattatcagcttccatgtgcagtcatttctagataaaaaagaaacctggcttctctagaggggccaccaagttcctcctccaagtctatagctgaaaggaccttttttggaattgggtttcttctctacctctgaaagagtaacactttaaagctgaattatctttagcctggaaattaacatatttagcctgtaagtctaacatttagcaatgcttgcatcccagacatacagtagaagatacactaaattctgaaggtagctgtgctgcaaaataatgtaaaagtaaacaattgtacagtatttatgctcaaaat

SEQ ID NO: 221660 - DNA, 404 bp, Homo sapiens
cacgagaatggactaaaagccccaattaaaaagcaacaatgatcggattaggtttataaagctctactgagttacatgttgcctatgagaaacccaatttaggccagatgtggtggctcacacctgtaatttcagcactttgggaggctgaggcagcaggatcacttaaccccaggagtttgagaccagcctgggcaacatggtgaaaccccgtcactacaaaaaaataaaaataaaaaattagccaggcatggtggcagtgcacctgtggtctcagctgcccactactcaggaggctcaggtgggaggatcacttgagcccaggaggttgaggctaccatgaacagtgtttgtgcccctgtaccccagcctgggcaacagagtgagactctgtctcaggacca

SEQ ID NO: 221661 - DNA, 447 bp, Homo sapiens
ccactaaaaatgggaatatcatttattattaaataatggaaaaattttatagggacaatcatattgcaaagagaaactaaagattattttttaaaaatcaatcttacacttaaaaatttgtttataataacaattatgtcctaattcctacaagaaacaaaaatagaattaaggattgactttttgcttttggcatgatccttttgataaaattatatgaaagctcctatgtcagtctttctttcatattccattttcagacttttgaaaagtcttctagaatttcatcaattttcccaaggactttaccttaccctttgatattcgaatccctcatttctaaagtatctgtgttgccatcatcctttttttctttttttcttttcagacggagtctcgctcttttgccaggctggagtgcagtggtccgatctcagctcactgcaa

SEQ ID NO: 221662 - DNA, 408 bp, Homo sapiens
tgttatgggtatcaatgcatagacttcttgtatacttgtgaatggttttgcatgggagccagtgggagggaaggatttgctgggagatgcggtgtgtgcattttaaatttatggatactaagaaattatcctccaaagtggctatactgattacaatcaccccagcagtgtatgaagtatgagggtctttgtttccccagttcttttttttttttttttggtgggaatggcctcttgcttttccctgaccactaatgagttttatcataatttcttaactatacagggcacctgaatctccaattctatgaattgcatatccataccctgagtgtgttttaaaaataagttatttgtttgttttctcatttatttatagcaattttaaaataaatatttcatatatta

SEQ ID NO: 221663 - DNA, 221 bp, Homo sapiens
taattgaatcatgggggtggttaccccatgctggtctcatgacagtgagtgatacctgaaggttttataaggggcttttcccctttcgctcagcacctcctgctgccttgtgaagaaggtgccttgattcttgtttgcattcaccatgattctaagttttctgaagccttcccagccatgctgaactgtgagtcaattaaacctctttcttttataaatta

SEQ ID NO: 221664 - DNA, 507 bp, Homo sapiens
aattgccccatgtgctggcctggccagtccccgagggtccccagtacttgaggccggagaaatccacctcctaagaggcgctcagtctcagcagagtcgtgacgtcattggcctcagtccccgtccccataggcctgggcgctcttggctgtggcaactgtcttagaagaatggtcccccatggccgctgatgtgtgcagtaatgagtgccgcccgccttaatcgtggaacagttaatgaacacacctgggtctccggagcccacatgcacccacacatgctcaggcagcagcttagcccctcttattcacaggtgtgggcacagggaactttcgggaatggggggcccagtgtgttcatgttgctctgatctgccgcctcctcacagaaggcctttgttttggagctttgagtggggacaaaatgttggcatttcactcacattcctcttcattctttgaatcagacataaagtctagacgtccccagaggttaatcttgggaaca

SEQ ID NO: 221665 - DNA, 397 bp, Homo sapiens
gaggatagaactcttaaaaaagtaattaagcttatacgaggtcataagggtatagtccttaatccaacatgactggtgtcctcataagaagaggaagggatgcagcacacaaagaaaatgtcctgtgaggacccagtgggaaggtgtcatctgcaagctgaggaaagaggccaaaggagaaaccaaacttccaacacctgaagtttagacttctatcctccacaactgtgagggataaatgtctgttatttaagccactagtctgtggtattttgttgtggcagccctagtaaactaaggcactctaccttcattaagtcccccacattaaaaaaaaatgcagcaggacatggtgaatcacacctgtaatcctagtactttgggaggttgaatgaat

SEQ ID NO: 221666 - DNA, 599 bp, Homo sapiens
agagaaggagataaagtaaacaacctgaaaaaagtagttgaggcaataattcaagaaaattttcctaatcttgctagacaggtaaacatccagatataagaagttcagagaacatctctgagatacttatacaaaattaatatctccaaggcatatagtcaccagactgtccaaggtcaatggtaaagaaaaaatttcaaaggtagctagagaaaaaggtcagattacatacaaatggagctccatcagactaacagtggagttctcagcagagactgagactactagggcttgtatgctgccttctccaggctgtagagttagtgggaggggacagagaagggcaaggattttaaaactaactattgggtactatgctcagtacctggtgatgggatcactgataccccaaacctcagcatcatgccatatacctaggtaacaaacctgtatatgtaccctctgaatctaaaagttaaaaagcgaacaaacaaacaaaatataacctgataaatggttttctaaagtttcctccagagaggaaacttgcaccagagctctgttatctattctgttattcattattttaaaataaaagc

SEQ ID NO: 221667 - DNA, 443 bp, Homo sapiens
caagagagaggtgacatctagggagagacgggaaaaccacagtgtgggggtaggactgtggacctcaggtttgaaatccttagacccagaaggaaatgttctgggtccgttggttcaagtgccaattgcgggttcagaacacggagctctggactgatgagctccttgtccaagtgcatcctgcccaccagtgaccagtctaaaataaaggcctggtcacgaacactctggcctctctcagttttactctctgctgccttcaggagctaagcttttgccagatgaagctggaaacttccatccattagtaacaacttctcttccccggaactctagcaactcaactggaaacatgcaccagggaagagagtaggtctggaagaaggactgttctttattaggcccacactgaaattaaaaaagttttattcacatctctcatt

SEQ ID NO: 221668 - DNA, 509 bp, Homo sapiens
gcacgagaaagcattgcaggtgtgaaggtgtgaagagcacttgggcacatgggtggaactgacagctgattgattgatagatagataggagctgatcatgaggaaagctaagctggcaaagcttggatctggtaggtgatgttccttgaaggttctggaacacaagagcaatggggtgaagtcagtcttaaaatcaggctctcctgagcacatgtatgttagcacaaagttggttatctgctttagtgctccaaaagtgatccagataaaacgtacaccgagttttgtcatcttgccatagccagaaacttactaggatgcttcctttggcatggacatagatcgtctcagtctctgctctgcccatgctattacccatgcgctttaatttttcagtcacttcaacacttcctggttgacagtccagagttccagaaaccactgactctccagacaccacctttcactgggtaccacactggtgtgtttttctacttaacaaacacttc

SEQ ID NO: 221669 - DNA, 584 bp, Homo sapiens
gtaattaaagttaaatgaagtcaaagggccaataagtcaaatccaataggaacctattgaattggggctctaacccaataggactagtgtccttataaaaagaggaagagacaccaaagatgtgtgtgtcctgagaaaaggccatgtgaggacacagccagaagacagccatctgcaagccaaagagagaggcctcagaagaaaccaaacctgccgacatcttcatcttggacttccagtctttaaaactgtaaaaaataaatttccattgcttaagccacccagtctgtggtattttttggcagctctacctgccaaatacaactacatattgtacaattctatttatatgaagttttagaacaggtaaggcagatcagtggttgcctgggccctgggataaggagacagatactgactgcaaacggggacaaggaaacctttggggatgatggaaatattctgttttactgtggtggtggctgcatggatatatgtatttgtaaaactcatcaaaatgtacacttaaaattggcacatttatgaaaattatacctcaataaagttgattttaaaagaaaata

SEQ ID NO: 221670 - DNA, 514 bp, Homo sapiens
agtcagcagtgatgtcaaggagatttcctgcattgcctgggagaatagattgtggcctctaaaatatcttttttaactaataagtttttctggttctgtgctgaaggtctcttagtgtattagttagggttctacagagaaacagaagcagccaataggatgtgagagagaaagaataaaatagatccatttatctattaatctgtcactttatctctttatttataggaattggctcttgcaattgtgggagctggcaattccaaaatatgtagagtaggccagcatgctggagactcagggaatagttgataaattcaaaatacacaggctggaaactcaggcagggtttctttgtgacagtcttgaggcagaattgtttcttccttgggaaacctcagtttttgctcttaaggccttcaactgattagatggggcccacccacattatggagtgtaatctgctttctcaaagcctactaatttaaatactaatcatatctaaaaaaatatt

SEQ ID NO: 221671 - DNA, 457 bp, Homo sapiens
aggctgtttgtttcaccagagcattccgggtgctagccttgtgagtgtggcgatctagaaatgcgtcagtaaattggtgtagaaatctctactggctttaatcaggctatataactacaattaaacctctgggggcacgtcacagctttcttaaatggtttttattgcaaatgaaatgagaaatagggctttattttttttttcattcccttctttatctgctgccaaaacagacttatttatggtctgattttgaattttttctacatttttaaaaagttgccttaaagtatcttggtatgtggtaatgtggggctgtgcagtggatctttttcttattctaggcctgtgcctataaaaatcaagattagtaaatagtgactacaaaatagcgacttgctggctattattgaatttagtgaagaaagcagcctcgttgagatggttttgcttatta

SEQ ID NO: 221672 - DNA, 868 bp, Homo sapiens
ttaatttagtaaaaaattacttgcactttaggttttaaaaagtttaacacatttaagatttagagtagctaagagtaatgtccattcatttatcctaagtaccaaataatacgttaattcctttgtccctgactggatcttccaaattctgtctagttctaaaatattgggcttaatatttttatgaagccacaggttatagtgacctcgtgtgctcttcctttctaaggattcagtataatctctgagtcttttgccatcaaattttgaaagttttatgaagtcactttcttgttcctgttgcctagttgtcctggttgttaggagcatgttgacttttgagattaacacctcttatacagaaattaatttcctgaaaaggaagatttattgattcaaaatcattgatttctttagtttttgtttctttttataactggcacatcgtaagtgcttagtgctatatttttatttctaaaaatccaatctgctgtaacatttccccataattttgactccgaattacaaagtattaagatagattatattgtagttcctggctatgtgataatagttactcatttgtatcttttaatgtgtcagtgaagtattaattattgacttaagaagttgagtagaaagatgagagcataacctttggcacttcaaattaccccctagtttgaagtcaggttatgagccaataaatgtttgtatggcactttgtagccataagtgctattgaaaggtaaaataattggagtggctcagaaagctgttttccctgaggccctgagaaaaatctcactaagatatgcttggcttcaaaagatgactcaactatgaattattaaagtaatctttgttt

SEQ ID NO: 221673 - DNA, 454 bp, Homo sapiens
agatttctcccagccaagtataaccaagcctaaccctgcaaatccagatttctaccattatatcttctgttcctttgccaactttttcctgaggtttgcctttatgtgtttttgaagagtcagttttcatttcctaaaatctggaaatcactgagaaggctggattcctgagtactatggggagatagaggaaggaaggaaggcccacttaagctgttgatagtagaaaaattagaggagagaaagagtgaggcatagcggaaaaggaagaggacatttcataacgtatcttgtctcctgacatactttttgagctgttttaatcttttgtctccaattattgttgttgttagatacttccagaaaggtagtctcttctgggcaggacctagtcataaccttgggttgttacttttccttcatttgtttctttacagaggtaggtttgaggggc

SEQ ID NO: 221674 - DNA, 611 bp, Homo sapiens
atctgaaaacctgtgcccaagacatgcgtggctagcaactctagggtagctttttgttttgtcatgttatgtttttaagacagtctcgcttttgcactccagcccgggtgacagagcaagactctgtctcaaaaaaaaataataataaataaagggatctggactttcacagctttttgcgttttgcagcatcatatacagcagtctccaatttgaatggagacatgtgctgtaataagaatagcttcaggccagggcagtggcttacgcctgtaatctcaacattttgggactttgaggtgagcagattgcttgagctgcagaagttcgagaccagtctgggaaacatggcaaaactcttgtctctacagaaaatacaaaaattagccaggtgtagcagcacacacctgtggtcccagctactctggaggctgaggtgggaggactgcttgagcctgggaagtcgaggctgcagtgatccatgactgcatcactgcactccagcctgggcaacaaaatgagaccctgtctcaaaggaatagcttcatttttgttttagcactttgcactacacactttatggttattttctcatttaatctttacagcca

SEQ ID NO: 221675 - DNA, 664 bp, Homo sapiens
tcttcagtctgagaagaatttctgtctttcattgaagttccaaaggcttcttattttgatgactttgcctaaagaagggattctacagccaaatgctttctttttaacataccgaatgagtaaaagtgcaaaataagtacagaactatcaaacagcaacaaatgtgcttctgctgcctaccacagaattttccttgcctcagagttgatgatgaatgcagtcctgctccactttgattccatctggctctggaaggtgtttctgaagatttgtgaacagcatttgaatttgtttgtttttatttatattgtctttttactatgatgtataaatatgtcctgtaatgtcattgatctatatgatgagtgagacaatcaagtgttaaaatggaacttgttgattaggatatttataccatagtttagttttcttaagaaactctgacagacacgatatttaaaatgactaaatttacactttgacataaggctactaaaaggtagaatataccattgagatatgccacttgaaaaaactacttttaaaaaaatggcattactggtgtcatgaagaaaagaaatgcttttatctcaaccctggtttcaaaaatttgtgtaaaaattttcacctcaataaatagtttacttctgtgtagaaaaggaga

SEQ ID NO: 221676 - DNA, 714 bp, Homo sapiens
tcttcagtctgagaagaatttctgtctttcattgaagttccaaaggcttcttattttgatgactttgcctaaagaagggattctacagccaaatgctttctttttaacataccgaatgagtaaaagtgcaaaataagtacagaactatcaaacagcaacaaatgtgcttctgctgcctaccacagaattttccttggtaagaagaaaaccctacattacatttctttttggcttctgtctctgcagcctcagagttgatgatgaatgcagtcctgctccactttgattccatctggctctggaaggtgtttctgaagatttgtgaacagcatttgaatttgtttgtttttatttatattgtctttttactatgatgtataaatatgtcctgtaatgtcattgatctatatgatgagtgagacaatcaagtgttaaaatggaacttgttgattaggatatttataccatagtttagttttcttaagaaactctgacagacacgatatttaaaatgactaaatttacactttgacataaggctactaaaaggtagaatataccattgagatatgccacttgaaaaaactacttttaaaaaaatggcattactggtgtcatgaagaaaagaaatgcttttatctcaaccctggtttcaaaaatttgtgtaaaaattttcacctcaataaatagtttacttctgtgtagaaaaggaga

SEQ ID NO: 221677 - DNA, 556 bp, Homo sapiens
gcagcagatacaaatggtgataaatattcaaagggttgaataacttcctgaatctcatgacttatcctggaacaactttatttccatttgcacccttggtgcagaagcagtggtggagaaaactgctgacgccgtaacatggatcaaggaagtggcactaagctctactagtggtcattgtcatggtcttctttcccaccacaaacttgtggttgaaaaataaaagccatttttacttgagaatgtcttgaatgaaggattaaagactatcattttttttatttacttatttatttatttatttattttaatttttatctatttatttttttgaaacagagtctcactctgtctcctaggctgaagtgcaatggcgtgatctgtgctcactgcaacctctgcctcctgggttcaggtgattctcctgcctcggcctcccgagttgctgggattacaggcatagtggaggctgaggcaggagggtcacttgaggctggaggattgctttgaggccagcctgggcaacatggtgagagctcatctctaaaaaattttt

SEQ ID NO: 221678 - DNA, 362 bp, Homo sapiens
agattctctgaatggttttgtgcttatgatgtattttcaatattgagtaattatcaagatactaatttatagttatatagcattttatagttaacaaaatatttgaaatggcatatttttttcagctgtacaagaaaggtagttctattttccttttatatttgaaataggctcaaagtttgcccagggagcttaggttctttgacttatagagaattcatgatttgtttctaactcttctatttactgtaacttcaaagtggaaaatgaaccatataaatgtgtaatagaattatttctaatatatcaaaataagtaaaaataaaaatataaagcaatggcgattagaaggcagcttgtgt

SEQ ID NO: 221679 - DNA, 454 bp, Homo sapiens
tagagtgaagtatgaactttctggtatttagattgatttagaaagtacattaattatttttaaaaggagttaaaataattgtataaagcatttattgagcatttagggaagttcatgcaaggcagaatatgatttgttcttcatgagagataacagttttgctgtatgtatttctgttaatttgtacgtgtgtatgtgtgtgttccctcataaggggtacggttatgggtgtttatataccccataaagtagcataaaaaatattaacagaaacaaaaataaatgaatgaatggtttaactcactgttttactctatctttacttcttgtccttatctatatataatacttttattaaaacaagtattcttttttaggaaaattaagcagtcagtctgtgactataattatgtgtattcatgacaagttcagattgaaattctgttggtttttg

SEQ ID NO: 221680 - DNA, 328 bp, Homo sapiens
gaaacaccgtaagttcaaggctggcatctatcctgttcaccctgagtcgctagtttgtataatagtgtattatatcatgggcactcgatggctgaaagatgaatgtttgaatagattgagtgataacaagagctaagacttccatagctcttatcctgttccaggtacttcttcaagcactttaaacatcaatttatttcacctttctgataaacacatgaggtaggcactaggatggttcttatttacagattagtaaactaaggcacagagaagcaaaacaatttgtctaaggtcacacagtaataaatgctagaatgacaattca

SEQ ID NO: 221681 - DNA, 481 bp, Homo sapiens
ctgggaggtcctccaacctcccctgacatttctcttgaacttctcaaagttacctgcttggaccccaggggtatgagttccaagggcccgatcagctatgagattataggctgaactcaggcatcagaattgttagagctttatctcagttctgagaaatggttaaaaccacccttgggcagtcacacgtggaatcacttatttcattactatggacattttcttgtaggaacaatacatagtgaaaatccactgggataaccaacataaaactgattttgttttcagtttgatatagcaattgcattttatttgtttgttgtaagtattggtaaactttcttattttttaaaaacagacatctgtaaaattatatacttttttcctataatatcctttaaagctgcttgaaaaatgtttattatgacaatgtataaaactggtatacatggccaataataaattttttctctaggttaaa

SEQ ID NO: 221682 - DNA, 288 bp, Homo sapiens
ggtacatttaatacaccagaaattttttatgatggttaaagataagatcagttactatgatggccaagatcttcaaaacatctttggtaattgtgccaagaataatgaagagacaaaaccagaaatgctttccatggtaattttgttcttctcttttctaaaaagacgacatcagttacttttagagaaaaaaaatcacttctagttttgaaattcttatttaaccgatctccattaccacatttttattgaagtccttcataaaaatatgagatataacgcttttac

SEQ ID NO: 221683 - DNA, 570 bp, Homo sapiens
gtaggagctattcagataaataatagatcattttttagtacaaatatactttatgcataccctctacaccgggttggcatcctgtgtttttaattgctaaattcggcaaccctacctgggagtcctgtatttgtataatccacatttcttttatgaaaaaatgatggagttattcaacgtgcatgcatgtgtgtgtgcgtgcatatatacacacatgcacacaggctcgcattagttaatctttcaggaaagcaagttctagggcaatgctggagttagcactcactcagctctgttctgcatttctgagctgaagaaccttctaccaagtggttacctcatcttctagaaaacccttttttttcctcttcagtatagatgcccgcatcttttcatctcttaacgttatccaactctatattacttattattaactaattcagaaattataatttatttcattagtctgtagtttattgatgggtgtgaaggaggaataatccttatcattttaatgtatatgccagaatgcattctttaggagaactcaagcatcagttgaggaaagcc

SEQ ID NO: 221684 - DNA, 217 bp, Homo sapiens
aactcaaaattaacttttgtatgattttgggaaacaccccaatttttctcatgacaaacagagctaatacctgtctagtagggcaatgggagaataagggtcgccacagccagcacacaggagagctctgttgtcccaggggggagccactcgcaactgtggccacttccatctaaatcgcttaaaaatatgacattaaaaacacagttgttcagtt

SEQ ID NO: 221685 - DNA, 625 bp, Homo sapiens
cttgggaagagctgacttcatggaaccatagagccccttccctcttctaaatactgagagggagcaaggaagctgagttaaagagaaaatcacaaacataaaagcaaacttcggctgtttcctttaagagctagcccacagcctgtcttccctccaccttctggttgtgaaattgtgaaccagggcgccacgcgaagcattctgctgctctgctgtacagatccctggtttagctactggatgagaaagaggacttgagttttgactccagctcttccatgtattagcagtgtgaacttggtttttaggtcaaacctcaggcctgtgaactgccctgatctgagacatcctttattgacaaagagggtcttgaaatgggtgagaggcagaaagacaagaagacaaagttggaagttgcagctgtgttacagattattctaagccttctatccttgctctcttaggtcagtcgagcaaccttacatttttcatctagtatcagaaaacaaacaaaattctcatatatttcttttggattgtacagagatgctgctaaatgcaaacctttctggacacaaacttgccttatttaaacacgaacacacagacattcacatgcccacac

SEQ ID NO: 221686 - DNA, 506 bp, Homo sapiens
cttgggaagagctgacttcatggaaccatagagccccttccctcttctaaatactgagagggagcaaggaagctgagttaaagagaaaatcacaaacataaaagcaaacttcggctgtttcctttaagagctagcccacagcctgtcttccctccaccttctggttgtgaaattgtgaaccagggcgccacgcgaagcattctgctgctctgctgtacagatccctggtttagctactggatgagaaagaggacttgagttttgactccagctcttccatgtattagcagtgtgaacttgggcaagttatctcacctttccgatactgggtttttcttttctttctttcttccttttttttttttccagccaaaaaatggagatttataatggtcacaatgagccctttgggtagttggaaggatgaaatgggatcattcaagtagcatgtttagcacagtgcctggcctggcatctggttggttcaaaaccaatggcaactattg

SEQ ID NO: 221687 - DNA, 354 bp, Homo sapiens
aaaaaaaaaaaaaaaaaaaaaaaattacccaggcgaggtggtacatgcctgtagtcctagctgctcaaaaggctgagatgggaggatcatgtaagcccaggagttcaagactacagtgagctgtgattataccactgcactccaccctgggctacacagcaagagtctttctcaaaaataataaaaagcttcttaagggattctcaagtgtaaccacagttgagcacaactgctctaggccgtttaggttcctgaatttcagtttttccttactcccctagaaaggtttgcaactaaataggtcaaggacggcagtgtaataatagggaagaaacaaaaaaaggaaaagattct

SEQ ID NO: 221688 - DNA, 733 bp, Homo sapiens
gcaatgcgtgctatgggtccttttttctaacacttgcagaagatttcagccccggccacgatgtttgctgtcagcggatggaaaagtcttcctcaattgatggttcataccccattcttctgaagtgctggttatgttcaaaactctgccagaaaaggcagcttttaaagccttaaagcgaactctacaactgatagctcctctgcatgatatcgtggcctaccttgtcagttttgctaagcttggcaattgtccagcatgttttgaatttcctcgaagtcccaaccctttgagaggtgactggggaggaactgagggcattgaagaacatttttggcagctggaaatgttcctgcctaccagtctgtcacagacggcatgtgccatgggctaccagcactgagcaactctctcaggaagagcatttttgcctcacagctcagcctgccccagccactggatccacggagcctccaggcatttgagctgtttccttggagagcatttctggaagatggaggaccattcccagttatgagtaacagcccagataccctagaatataatatgcaggtaggataggtcttctccattgttgcagagagaactgagcgcagactgcaaagatggttgccattgggttcacaggtcagatcctcctactctcacccacgatgaataatgtgtgagataagcagggtgtttgattttgaggctgtaaacccagggtcac

SEQ ID NO: 221689 - DNA, 872 bp, Homo sapiens
gcaatgcgtgctatgggtccttttttctaacacttgcagaagatttcagccccggccacgatgtttgctgtcagcggatggaaaagtcttcctcaattgatggttcataccccattcttctgaagtgctggttatgttcaaaactctgccagaaaaggcagcttttaaagccttaaagcgaactctacaactgatagctcctctgcatgatatcgtggcctaccttgtcagttttgctaagcttggcaattgtccagcatgttttgaatttcctcgaagtcccaaccctttgagaggtgactggggaggaactgagggcattgggtctgagcttcaagagctgcagaacatgattgacagcctccagagcccccaagaccctatccgggtggcccaggcactcctcctccggagggaggttatatttttgcagtttgacgctgcagtaaggcatctcatccgaagaacatttttggcagctggaaatgttcctgcctaccagtctgtcacagacggcatgtgccatgggctaccagcactgagcaactctctcaggaagagcatttttgcctcacagctcagcctgccccagccactggatccacggagcctccaggcatttgagctgtttccttggagagcatttctggaagatggaggaccattcccagttatgagtaacagcccagataccctagaatataatatgcaggtaggataggtcttctccattgttgcagagagaactgagcgcagactgcaaagatggttgccattgggttcacaggtcagatcctcctactctcacccacgatgaataatgtgtgagataagcagggtgtttgattttgaggctgtaaacccagggtcac

SEQ ID NO: 221690 - DNA, 1065 bp, Homo sapiens
tgaatccagcgcctattctaaccagttatccaaacaatatcctaccaggtttccctgcttccagtcccatcgaatatacatgccagagctagagcaatctttctaaacaccactaagcttatgtcattttgctggttaaaatccttcagtgggcagggtgtggtggctcacggctgtaatcccagcactttgggaggccaaggtgggtggattaactgaggtcaggagttcgagaccagtctggccaacatggtgaaaccccgtctctactaaaaatacaaaaaattagccaagtgtggtggcgggtacctacaatcccagctacttgggaggctgaggcaggagaatcgcttgaacccgggaggtggagtttgcagtgaaccctgatcgatccaccgcactccagcctgggcaacaaaagcaaaactccgtctcaaaaaaataaaaataaattaaattaaatccttcaatgacatgcctcaccaccactgaggtaaaattaacatgcaaggcctttagtaactagcctcctgccaattcttcccgtcttcccttctttcttcctttctcctccagcaactttttctcagtcaacaaacgcagaaaaatccagtaactttttaaatcttgttacccttcagcctttgttccttcagttctccgggtctgtaatattccccccattttcgccgggaacattcttgctaatcttttaggaatctgctcaggaaccatctatttgagaaaacattcttaccccgccccgctgccgttacttttaccgaatgaccacactgaattatattatgtgtccccagctacctctgtgaaggaagcaaacatatttcagagagtagccccagcgcctgagaagtcaggcacaggcaaacacggaaacgtgatgagcaactgagtggagctcttcctccattcgccatcaccctcctccgccctcctctccatccagcagacctagcgagactctagcgtggtccacgagccccttccacccacttccgccaactctttctcagactcacaaacttccgcaagtctgagcctttt

SEQ ID NO: 221691 - DNA, 461 bp, Homo sapiens
cctgcagagtcccactccttgtttgctgggtgggtaagtgttcattagctaatatttttaacggtttccataaaaaatggattagtgtgctaattttaaccatagcttcacatggcataatgccttagcccaataaaatacataaaattgtatatacagcctgattataacttcattaaaaagcaacaacaaggggtaggatttctagccatggcagagtgaagataaaattatatgcttatattagaaaagaagatcttacatcaatgacctcgtttccaacttaagaaactagaaaaaggagagcaagtgaaacccaaaatgagcagaaggaaggaaataataaagattagaatggaaattgataaaacagagaacaatagataaaatcaatgaaatcaaaactggtactttaagaagattaataaaatagataagtatctagccagtctaaccagaaa

SEQ ID NO: 221692 - DNA, 672 bp, Homo sapiens
agaaaacccaaagtcctttcagtaccttgcaaggccccacactctggctcttgttatctctttggcctcaaatcccactactcctttccttcctcgcgcagctccgctagcctcaaacttgctgtaagtatgtatctttcagggactatatattgacagttccctttgtgtgggcaactcagcttctagatttaagtgttgctgcctcacttctttcaaataacaccctctgtgtgaggctggttgtgaccccactggcattacaatcctgctcccttcctcacggccttcccactatatttttccctgctcctaaggatcctgcagtctatttggagagtgaaaacatatccttatgaaaaggaaagcaggaatggaatattatatggaatgtcagatgagtgtaattcaagtcagtatcagaagtgatagttcctggcttggtgccagatgttggaggcctgttgggccaatgacaggaatgtagactttattctggacagcagagaaccatacaaaatctcccctccctgctttggttctgattatgtcacaattctagcatctttcatgaaactagtttttgcactgagcatattagactcaaattatgtgtttatcttaataagtgcctagatgaatataaataaaatgaatataaatctaaattta

SEQ ID NO: 221693 - DNA, 415 bp, Homo sapiens
agggtgaactttatgatatgtgaatcatatcttaaaagaaacgtagtaaaaattaaagcaatgctgctgaaaactcttattaaatctgtgaaggtaaatgaaggaaccatctcacagttcaagtacaaaataacaagaaagagagattgttaatgaagagatatgacagatttggtagttctagtatttgattgataggagacctagaagcagagagagagctggaaagaggagtagcagcaagccagaagcaacagaagaattctttccagagggaagaatggacttaagactcaagaatattccagctgccaggcatctccttatgagactaacaaattctaaggagaaagaaaatctttttctagataaataacaaacatcaaatctaccataaggacaactagaaaaagtg

SEQ ID NO: 221694 - DNA, 368 bp, Homo sapiens
gcacgagcccttctcctggcttttcaggtcccagcttcccttgactgtgactcccaaaagaatagagagactttgctatcctggctgcagtgccaaaattatagagaccaagcggaaacctcccccttgccctctgaagtttcactgaaaaatcaactttctttataaggaaagggagaaaggagagtcggggaatgtagacaattcttttgagggacagtaaataattattagggagaatgaattcctctcctccctaccatttattaaggtataattgatgattaaaaattgtatgtgtttacactgtgtatgatgttttgatatatatatacattatgaaattaataaagcaagctagttaacat

SEQ ID NO: 221695 - DNA, 580 bp, Homo sapiens
gtaatagcttatttatttcattactctttcttcataccatgctgacatggctacttgtcatactttcaaaaatgctattctattaaaaaaataaacatcatggaagtcttccactgaaaacataccaattattaaaacttatctaaagaattcagttcaaatttcttagctattcgatgtacctcctttgtctgcaaataagcccagaaatcatgtccaagctcaagaagtacctcctccacattcacaccttttccctcatattagaaaataatctctcactcttctaaacttcttagaatttatttttacctttctcattatgcctttacttacaatttgttttgtaattatttaaacatattttctatgtacattagtcataatattgagcacctttaaggactgtacctttattctttttatgtactcaataatttgttgaatgaataaatcagtgtttaattttgcatttgggatataagtatgtaggcttagaaacatttctctgagagcaaaatgattgatatacatgataagtagaaaattatggacacaaagactagttgggaggtttctg

SEQ ID NO: 221696 - DNA, 394 bp, Homo sapiens
tttaagaaaaagattctggaagaggaaataaactatctcaaagaattagaagtgtatttattaatgaaaaatgttgaatattgaatttcttcagttccgataaagcactaacagcactgttcctactataaaaactatggaaatacatgttacttttccattgcaaattacaagcatatcagtgatacctagaataatttctagtgactttagattagaaaaagaaatgtaaaaatatgtccttcagaaattttttcatttaattagtatgtttataggacacctaaaatatatcaagtggtgctttgggtatgtagcaagagtacaacaataaatgagatcaacacagttcccaaacaataaaacacatcatggtgataaagtgatgcaaata

SEQ ID NO: 221697 - DNA, 493 bp, Homo sapiens
gcagtgtagagcatggattaggggggtatgaaatagatattagtgagtgattttataacattcattgaaaagtcgttgagctaaaaatgtggctaagaggtttggagagaggtccataggaagtagaccttgattgaatgagaggaatgaagagggggatggggaaagagtgaaatgcaggtggagatatttcagagtctagagtttaaggggagagacctgaaatcttagagatttagatttttagatctaggtaacattgtagtataaagggtagttaaagcattaggtttaggtgcgataaaaagaggaaaacaaaagaccaatctataaaaataaataaataggttaaaaaagagtttgaagaaaccatcagagaaaccaagattgaaggttaatttcaagaaggaaggaaaggacaacgatgttaaatgctataaagtgatcctgtataaattgaagattgaaaaacacctgttatacttcgaaattg

SEQ ID NO: 221698 - DNA, 137 bp, Homo sapiens
aagtcaagtcttcggctattcaggaatacaaaatgtccatcaaattgttataattaacttttataaagaagcattcataatgttctttaggattagtagctcttgccaggcagtggctcacgcctgcaatcccagca

SEQ ID NO: 221699 - DNA, 533 bp, Homo sapiens
ttctgctgtcagtcacttaaaaataaaaactgcaaagttactgaaaaggcatctaagttacttttttttctggcctgtcactttagaccgtgtgtgaatttcatacatcagttttgattaccctcagtgctgaacaagaggttctattgtaatccatgatgagggtcttaatattatcccctcctccgaaactttataaaatgctccccaacataccctcatatatatttacgtggtaattggcatggggttatgcaaaatcagtgggaactgccttacttacaattaagcgtcacacaaagtaaaaaattaaaattaaagtgctgggcgtggctgctcacgcccgtaatcccagcactttgggagaccgagatgggaggatcccttgggccaaggagttggaggccagcctgggcatcacagggagacaccatctctacaaaaaaaaaattaaaaatttgccagtgttggtgtcgtgcgctttgtagttccagatagttgggaagatgaagcaggaggaccacctgagcctg

SEQ ID NO: 221700 - DNA, 635 bp, Homo sapiens
tgcacacacacacatctacacacacatacattcctccacacacacaattgaaccccagatcatttattcagccttgacctctctgcttcctagcgtttgcaacatctttaacttctctcctgttccagcttcctcatgctctaacccacctactaccatcataatttttattatgtagaactccaattctaattatattatttgcattaaaaccttcaataattctccattgcttctaaaattaagtgaattccggagtccaattgattcaggagtccgaaatcctcagtgatacacgttttcatcatacgttccagtggttctaaacagagagtgatactgtcgctctctctcttctcagatgcatcctaggctttttgaactgtgggaggcttttttgtttgtttgtttgtttgtttttgtattcccaaggactaaagagatgctattaccatttagtgagctgggaccagaatgttgaggtttctccaatgttttgggcaatctcaaaaaacaaaaaattatcttacacaaaatgacaatagcattcttggagaggaaaactacagacaaactagaagttccactagttcccataaacaccccatgtttatcctaccatcaacctatcactg

SEQ ID NO: 221701 - DNA, 317 bp, Homo sapiens
tgggttagaactgacgttttttggtataaggatattcaaatgggcggaagtccttcaaagcagtgattctcaaatttgagtgaacatcacagtctcctggagtacttgctaaaacacagacttctgggccctaccctcagagtttatgatttggtaaatttgtgacactagcctgagaatttgtatttctcacaagttaccagataataccaaggctgttgatttgggcaccacactttgagaaccgttcttaaggatattccgaagccaagagcaagtaaacatcctctgtggcaaagcttggagaatgaaaaaca

SEQ ID NO: 221702 - DNA, 436 bp, Homo sapiens
ttataaaacaattattattagaccaaataaatgaggtagacagcaacaaaataatagtgggggaccccaatactccactgacagcactagacaggtcaagacagaaagtcaacaaggaaacaatggactaaaactataccctagaacaaatggacttaacagatatttacagaacattctacccaacaattggagaatgtacattctatttatcagcacataaaatattctccaagatagaccatatgataggccacaaaacaagtcccaaaaaatttaagaaaattgaaattatatcaactactctcttagaccacagtggaataaattggaaattaactccaaaaggaaccctcaaaaccatgcaaatacatggaaattaaataatctgctcctgaatgatcattggtaatcaatatggaaatttaaaaattct

SEQ ID NO: 221703 - DNA, 386 bp, Homo sapiens
gagatggagtcttgctcttttgcccaggctggagtgcagtggtgcgatctcagctcactgcctcctgggttcaagctgttctcctgcctcagcctcctggataactgggattacaggcacacaccaccacacccgactaatttttgtatatttagcggagatggggttttatcatgttggccaggctggtctcgaactcctgacctcaagtgattcacccacctcagcctcccaaagtgctgggattacaagtgtgagccactgcacctggccagtgtcactagttcattcttactgctgtgtagtatttctttgtgaatgtaccataatgtattcattctcctgatgatggatagattgcttccattgtttgatcattgtgaata

SEQ ID NO: 221704 - DNA, 462 bp, Homo sapiens
atccgctgtctctttcgtcctcgctcagattccccttctctgtgaagcctttctgaccatcctcattaaaatcaaataaccccacccctccactctcttgcccattttcctcatccatttccccctaggactaatcactctctaacattctctatatatttttctgatatatttgtttatatgtcttgcataaacaaaatgatttggtttatggtctatctcttcttgctagaatgtgagctctacaagggtagggatgcttattttgtcaccgttgtgtccctgactcctaaaatgctgacggtgtggccagctgcatgccctgctgtctctattttgaaactctaacaaaattttggacaagaccctcctctttcattttatgctggacctggaaaattacagagcaggttctgacttccaggcacatggtacgcattcaataaataatctcttgaatga

SEQ ID NO: 221705 - DNA, 337 bp, Homo sapiens
gtgtcctcacctgtcctgagactagccagctgactgttgcccagagctagcaggcatagccagctgaaattctgaaagtggattatgcatggagtaatgctgttctcaggaaatcagtgatttattttataatctaaaatttaaacgttttaatatacctcccaagaagatacccagttcagaaaactgcagaggagccatggaactcagcagaaggccagctccctctctgggaggccgccttcaggaaaccaatcgtccccccacctgattccaaaggaattacagaaaaatggaaagccaggaacaaaaatcataaatcatattttcaatatga

SEQ ID NO: 221706 - DNA, 403 bp, Homo sapiens
gatattcaaaaaaaaaaaaaaaaaaaaacaacagaaaaaacagcccatgtgtggtttttctgagaatgctacacggctttcatatgtgcattttgaccctaatttcacttacaactttctcataagatactgttaggagtgaaaagccacaattagctctaggccaagagtgaataatttcaacagcctctctaagatggtttatatttttggagccatatatgggtgaaagtaacgatttccacaggaggacaaacaaaaggagatttttgcacacaacagggaaaagaaaaaggtttaaactttcacatgtgaaaaagttcaaattcccaagccttgctgaacacaaccccaggtagttttaaaatttgctttcaataaaaatttatttgaaatgaaatgc

SEQ ID NO: 221707 - DNA, 523 bp, Homo sapiens
acataagggtttctccacattcttgccaacacttgttattttctgtttatctttttatttttttaaacatgctcctctttctatgcaaatgctgagaagaagtggggctaagcttgctctgttcttaatatcacagaggcctgatgacctattggttaggttataccttttgcacatctccctccggagcacgacccagaagacacaaggcctgaacactaaaagaaaaaccactgtagacctttgttggaaggagcccttctcccaacagtcaaaaatgtccaacaacactcaagtacctttcttgcaattattctttcttttcttggtccaggaacacttgcactatatgatcattttgtaacatgtggaaataactaacatctgcctagatctttacaatttacagagagatttatagctgttatctcctttgaccctcatgataatatattacattcactttggagtatagaaattgaaactctgagttaactttatcatcagaactctataaatagga

SEQ ID NO: 221708 - DNA, 608 bp, Homo sapiens
atgaaaatgtgggcttcttttaaggaaaaattccctttgaacattgacagaagtgggcatagggaaggggaagattttgcctggattctccacttaactcttgtcaccactggagcatcctgactccctagacacaagtgatggaagttattttgtttccactctaaacactgtctcagggggacattgatgggatggtggagggtgtgtttcattgtgacaacagcatctttggtggggaatttgctgttggtgaaaacccagtgctttctctgagcatgggtgattgataagggcctgacatgctccttcatttggaaaatggtattaatagaattggtttcccagtgaatagtgccttttacccaagactcataaccaaatattttcacaaagatgttatatccccatgcatgagcattcattttgagatgttcattataatagagtttaagtatgaatgtgttttaaaaatgattttaaaatcatctgcaaaaaaatgttgtgtttcaaatggacagtgtctgggttttgtatagtcatcataaaaatgtctataattgtactgtttgctaataaacctacctgctttcagaaaatcatcctaa

SEQ ID NO: 221709 - DNA, 519 bp, Homo sapiens
ggcaatgaaaactaagcatggtgtctatctttaaagagcttactggtccttatactgttatttgttctgtataatgatttaagatatgctgtagcttttttagtgcttaatctttctatcagtgacatttaatgttcctcaggcatttctcacggtgcataactcaaggagtttcacttgatactagcctttaattatgtattaataaaacctgtataaaagtaccattatactttaccactgagaaaatccataagttcagaaatctaagttttaatgcacttatctcttcaatcccttggatttttttccccaagcactccatgcctcaaatgtgccaaggtatgatttttttttccctttcttattgctgttggagaaataggcaactaataaaaacagaccttttactctgctcttgtaaataccttagactttggcagtttgccttagactggtttttctctcactttactatatgggtgtaaacttcctccctgtacagtgtgttatttcctg

SEQ ID NO: 221710 - DNA, 514 bp, Homo sapiens
gggtgatttgacccggcaggggacgtttgtcgaagtctggagacatttttggttttcactactgggggctggagtgggaaacgactggcatctagtgggtataggccagggatgccgctaaacatcctacaatacccaggacaaccctccataacaagaattatccagcccaatatcccaataatgcttaattcgagaaaccctgctgtagctgggcgtgaggggcttattcctgtaatcccagtgacaggaggactgctcgaagccagcagtttaagattagcttgggcacatagaaagatcctgtctttaaaaaatataatatttaaaaattagccaggcagggccgggcgcggtgactcacgcctgtaatcccaaagtgctgagattacaggcatgagcccccgcacccagcaattttatttattttttaggttattattttttgaggcagagttttgctgtgttgccccccacgcctgggcaacaagagtgaaactcaatcacaaaaaaa

SEQ ID NO: 221711 - DNA, 371 bp, Homo sapiens
cccctcccacaccaactctgagtttgtttatggcttgttttggacaataagacattagcaaatgagatataagtacaggcttgagaagtacatgggcactggggcttgcttgctggctgctctgtggaacctgagactaccacgtgaagaagaagttcgaagtgctagaggttgagagaacatgtgcagcaaagatgaagcatcccagctgagattcccctagatcaatcagcttgccaactgccgcaaaagcgaataaagccttccaagagcatccagctataaggtgagccagtccagaccggaagaatcacctgatcaactgaaagatatatgtgaaataataaatgttagaggttttaaattttaag

SEQ ID NO: 221712 - DNA, 418 bp, Homo sapiens
gcatggagagtgaaaaatgagaggctccttcacacagccatcctatactgcaaactgaaggagacaggaaggatagacagaaggaaatactatgaaatgatatgaaagaagccttcagtcagggtttcagatggctgcagcatgcttgtggaacaaaatgggatttgctcatactactggtttagttaatacttactgatggaatgatgaatatgtgaatgaaaacttattaaatgcatgaacgaatgaaggtataaccaggtaaaatacttgaaaaacaaagcaggaagagtcaaattgtgaataagaaaaaataagaaaataattttggaaaaatgaagccatgtagctcaaataagctaacagtactgggctccactcacctaagctagaatagcaaaacaaagggcagtctttg

SEQ ID NO: 221713 - DNA, 564 bp, Homo sapiens
ctttcaatgcttaaaaactattaatatttgatatagtgctcctccatttaccaatctccacaataacgtgatatgagcaaaaataatgctttgtatttatgtagcacatgtctccatggagcccagaggatttggttgacgggatctaaaaatggctttgtcagggagaacagaaatctaatctcgtaattatattgccagtattaaaactgacactgattctatatgtggctactaatgtgaacattatgcagtcaaagtaatacggatggcttcttccagccatctttataatcaatagtaaccatactaagaagtcatactatgttgtattattttactttgccttggaaatgtttaaatattatacacatatacttccttttatttaataactctattgtaaacagtcatgtgctaaataattataattctaaatattttctaaggcaataaaacaaattattacgtgttacaatgtttatctttaaaaacagtcatttttaatgtgaaaaagcaggcactataatgttactgtgttgtgaattgagatgcttttaatgc

SEQ ID NO: 221714 - DNA, 542 bp, Homo sapiens
taatttacttaaattcagtcaactccagtaaggagaatgcttttgaaaatcttcaagaaggaaaaagagtcttgaagtccagcatagagaaaacactggaaaagaatatttagacttcaaaatgcagttgagttcctgggcaaagtaaactataccccagattagtgggagaactctcagatgtggttgcagagctgttgtcagttacattggtcagttatagttatggagatgggaaagtcaagcagaaatgagaaattctgtctgtgtttaaagaaactaaagaatgggccaggccccgtggctcatggctgtcatcccagcactttgggaggccgaggtgggtggatcacttgaggtcgggagttcaagaccatcctggccaacgtggtaagaccctgtctctactaaaaatacaaaaattagccaggcgtggtggcaggtccctataatcccagctactcaggaggctgagatatgagaatcacttgaacccaggaggcagagattgcagtgagcagacatcgtgccacagcactcca

SEQ ID NO: 221715 - DNA, 402 bp, Homo sapiens
taagtttaccaaaactgttttgtttatttctaaagatctttattttcctgtggtttttaatgactaaaagaaagttttaagccgaacacagtagcttgcgcctataatctcagctacttagaagtctgagatgggaggattgcttaaagccaggagttcaagaccagcctgggtaacatagtgagaccctgtctctataaaaataaataataaaaaagaaagttttagatatgttggtgattgttttctaaacatacttaaacttttaaactttgaggggaaattgaccatttctagacttcttatcaagaagttatttaaaatttttcagacaaaaactagatttggagcaaatgttatatgtagttttgcactggcatgtattattaaaacatgaaattg

SEQ ID NO: 221716 - DNA, 519 bp, Homo sapiens
cggtggtgtccttatttctgagacctggactttgcctaggcgggtgctggaggaacagtctcggagtgcaatgttgtcattgttggattcatgggaagctctgcctctctccacttgggctggtgaagtttgcagtggccactaaagacctctcaggccagcccaagcctgctgtgcctgtttctgtgttctctttggcaattgcattctctcttttggacccagcttcttcctacatgctgtggtcatcagagaggtgttttttaaactgcaatattttcctggttggattcatgggaagctctgcctctctccacttgggctggtgaagtttgcagtggccactaatgacctctcaggccagcccaagcctgctgcacctgtttctgtgttctctttggcaattgcattctctctttcggacccagcttcttcctacatgctgtggtcatcagagaggtgttttttaaactaatctcaacagctaaatacaaactcagaaagactctgttggacaaa

SEQ ID NO: 221717 - DNA, 371 bp, Homo sapiens
tgatacattaggtgcattaaatttattttggacttatgatattctcaacttatgatgggttattgggctgttacctcatcatctgccgaggaccatctgtatacattttcttgtgaacagtctggtcagtttcttcttataggagctcaaggcaagtccaaggggctggacaaaaaataggcagaatatggtttcttctgtgctccatccctgctgtagcactctctttcttgctcaatctcccaatcaaaactcctccttccaaatggcatgaacccaggaggcagagcttgcagtgagccgagatcgcaccacaacactccagcctgggcttgggtgacaaagcgagactccatctcaaaaaaaaaaca

SEQ ID NO: 221718 - DNA, 524 bp, Homo sapiens
tttgggatgattcaagcacattacatttattgtgtgttttattttggttattattacattgtaataatgaaataattatacaactcaccataatgtagaatcattgggagccctgaccttgttttcctgcaactagacagtcccatctgggggtgatgggagacagtgacagatcatcagacattagattctgggagtgcacaacctagattcctcatatgtgcaatttacaatagggctcatgttcttacgggaatctaatgctgccactgatctgacaggacgtggagcttaggtggtaatgcgagcgatggggagtggctgtaaaaacagatgaagctttgctagctcacctgctgctcatctcctgctgtgcagcctggttcctaacatgccagggaacatagatcagtacagattggcgacttcggttttagggcctatgttagctggacctaagaatgtttgctttatgatgcgatttcagagtattgaataaatctctctaatttaattgcaatgtc

SEQ ID NO: 221719 - DNA, 464 bp, Homo sapiens
aattaaaaagtggggattggagcatagaagaaagaaaagaaaagaaatttgaaggacagtatgtatagtataacaaacctgcaagttctgcacatgtatctcagaacttaaagtataataatttaaaaaaagaaaaaatgtaaaaaaaagaaattaaaaagagttggagcatagaagaaagaaaagaaatgcaatttgaagggcagtatgtgcagtgtaataaacctgcaagttctgcacatgtatctcagaacttaaagtataataatttaaaaaaagaaaaaatgtaaaaaaaagaaattaaaaagagttggagcatagaagaaagaaaagaaatgcaatttgaagggcagtttgttacactgcacatactgcacatgtatctcagaacttaaagtataataatttaaaaaaagaaaaaatgtaaaaaaaagaaattaaaaagagttggagcatagaaaaaa

SEQ ID NO: 221720 - DNA, 812 bp, Homo sapiens
aaaccaccatggcacgtttatacctatataacaaacctgcaagttctgcacatgtatctcagaacttaaagtataataatttaaaaaaagaaaaaatgtaaaaaaaagaaattaaaaagagttggagcatagaagaaagaaaagaaatgcaatttgaagggcagtatgtgcagtgtaatctcatttgtggaaacaatttttaaaagaaaaatgcatgtaaatgtataggaaacttctggaaagatacacaaagccaagagctgtatgggaagaaggtaaaagaaccatagggaagagttaccttttacttttcacataactttctttccctttttaaaataataagcatgttttatttttataatttaatgaacagatgtgttgatttgaaaaacacactgatcctgaaagttaaaattccaattcagagaaaattgatttctatgaaaagtatcaatcccccaacaatgtcatcaaaatgaagtagatagcatgagaaaaaatacttaatgtagaggatgggttgatgggtgtggcaaaccaccatggctcatttatacctatataacaaacctgcaagttctgcacatgtatctcagaacttaaagtataataatttaaaaaaagaaaaaatgtaaaaaaaagaaattaaaaagagttggagcatagaagaaagaaaagaaatgcaatttgaagggcagtttgttacactgcacatactgcacatgtatctcagaacttaaagtataataatttaaaaaaagaaaaaatgtaaaaaaaagaaattaaaaagagttggagcatagaaaaaa

SEQ ID NO: 221721 - DNA, 580 bp, Homo sapiens
tgaattcctgaagctgaggttttctcactggcacaaatctaccctgaaggcacaggtggtcctttttcagatgccacccaggaaagcagagagtgtgacatcagaactctaataaaacctcttctggtcgggggcagggagcagagatgaaagcacttttgaattttccagtagggaaaaaggtttgttccttaattagaggtagtctgggaaatgctagcacttgtgcaggtgccccaggagagttggaaaagcttagttctgtggtcactgtgataccatagtccccctgccttgggtagctaacgtagcataccagctggcgttaggaaaactagctaaagctcacagagaggctctgccaaagtgatcgatctttctctgtaatgtctgtaactcatttggcctgctccaggttactacttgattctcttcagcagttaagagttgcattctgaaacactttcagagagtagtgctagtgttgatttctggatctaattctggaaataccagctgtaaaattatattggaatttacatttaagaaaaagtcagaccccagtcaattctgtccagga

SEQ ID NO: 221722 - DNA, 806 bp, Homo sapiens
  misc_feature (665)..(665): n is a, c, g, or t
ggggttcgggtgcgaggccggtcctgcaggcggcagccagagctgcgcgccgcggcggcggaagatggctgcggccgaggtggcggacactcagctgatgcttggagtcgggctgatcgtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaagactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctggactctgcctgccctggtgtggcaccgacaggactggaccatccttcantcttacgtgcacctcaacgccgatgagctggaagccctgcagatgtgcacaggttacgtcgctggatttgtagacttggaggtgaccagaccgaccttatgatgtgtttgggatctggcaggagtgagattacttgctccc

SEQ ID NO: 221723 - DNA, 784 bp, Homo sapiens
  misc_feature (643)..(643): n is a, c, g, or t
ggggttcgggtgcgaggccggtcctgcaggcggcagccagagctgcgcgccgcggcggcggaagatggctgcggccgaggtggcggacactcagctgatgcttggagtcgggctgatcgtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcantcttacgtgcacctcaacgccgatgagctggaagccctgcagatgtgcacaggttacgtcgctggatttgtagacttggaggtgaccagaccgaccttatgatgtgtttgggatctggcaggagtgagattacttgctccc

SEQ ID NO: 221724 - DNA, 451 bp, Homo sapiens
tccactaagtgtttctgagtaaccaatcaattcacttccttgctgctgtttgacattctcacagtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaagtttttgcttgtaacctttttctattctacctacaggattgggataaaggcttcattaataacttaaggtgtttctcgccttatcagataagttataaaagtaaatgaaagggcctaatgtaactgtctcttaatcattaagcttactgaactacagtgatgccccactggga

SEQ ID NO: 221725 - DNA, 1250 bp, Homo sapiens
  misc_feature (1109)..(1109): n is a, c, g, or t
ggggttcgggtgcgaggccggtcctgcaggcggcagccagagctgcgcgccgcggcggcggaagatggctgcggccgaggtggcggacactcagctgatgcttggagtcgggctgatcgctctcaccaaggaccgaggggccgtgggaaacgtctgacgcccacttcacggaggagcaaatggaggcccaggccgtcattgtgcacggacacaccataggccgtacagagccgggagtgggaccctcgcagtgtagcccagagcccccaacccccaccagtggagagctcctgcatcatgtgatcgagcttgtgcataaataaagcaggagtttctacacaatcctgtgtggtggaatctcggttagctctgaggaatacggggtctccctcttatccaggctggagtgcagtggcgcaatcaccgctctctgcagcctccgcctcccgggcccaaaccatcctcccgcctcggcctccgagtggctgggacctcaggcgtgcaccaccacccgattaatttttgtattttttgtggagatgggataccgacatgttgtccagtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaagactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctggactctgcctgccctggtgtggcaccgacaggactggaccatccttcantcttacgtgcacctcaacgccgatgagctggaagccctgcagatgtgcacaggttacgtcgctggatttgtagacttggaggtgaccagaccgaccttatgatgtgtttgggatctggcaggagtgagattacttgctccc

SEQ ID NO: 221726 - DNA, 1538 bp, Homo sapiens
  misc_feature (1397)..(1397): n is a, c, g, or t
ggggttcgggtgcgaggccggtcctgcaggcggcagccagagctgcgcgccgcggcggcggaagatggctgcggccgaggtggcggacactcagctgatgcttggagtcgggctgatcgctctcaccaaggaccgaggggccgtgggaaacgtctgacgcccacttcacggaggagcaaatggaggcccaggccgtcattgtgcacggacacaccataggccgtacagagccgggagtgggaccctcgcagtgtagcccagagcccccaacccccaccagtggagagctcctgcatcatgtgatcgagcttgtgcataaataaagcaggagtttctacacaatcctgtgtggtggaatctcggttagctctgaggaatgtaattatcttccataattaaaaaatatcacacggggatctttgggcagcctcgtgcagtatttaggggatggaacccgttggttcccttcgaaaaagttttattttcccgagatttttgcacacccctaaactctttctattccccaagtgcgcaataacattgcttaggctttagcaaaactgaagaaatatgctgattatttttcagtgcctcaaagcagtgcgtttatgtgggaatcgcttactgtttttatttctttgtctttcttcttttttttttttttagacggggtctccctcttatccaggctggagtgcagtggcgcaatcaccgctctctgcagcctccgcctcccgggcccaaaccatcctcccgcctcggcctccgagtggctgggacctcaggcgtgcaccaccacccgattaatttttgtattttttgtggagatgggataccgacatgttgtccagtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaagactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctggactctgcctgccctggtgtggcaccgacaggactggaccatccttcantcttacgtgcacctcaacgccgatgagctggaagccctgcagatgtgcacaggttacgtcgctggatttgtagacttggaggtgaccagaccgaccttatgatgtgtttgggatctggcaggagtgagattacttgctccc

SEQ ID NO: 221727 - DNA, 786 bp, Homo sapiens
  misc_feature (645)..(645): n is a, c, g, or t
ggggttcgggtgcgaggccggtcctgcaggcggcagccagagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaagactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctggactctgcctgccctggtgtggcaccgacaggactggaccatccttcantcttacgtgcacctcaacgccgatgagctggaagccctgcagatgtgcacaggttacgtcgctggatttgtagacttggaggtgaccagaccgaccttatgatgtgtttgggatctggcaggagtgagattacttgctccc

SEQ ID NO: 221728 - DNA, 483 bp, Homo sapiens
gaattcccccaacctctggtaaccatctttctattctctacttttatgagttcaactttttcagattctacatataagtgagttcctatgatatttttcttttcgtgcctagcttatttcacttaacataatatctcctgggttcatccatgttgtcaatttccatttttcaaaaggctgaataatagttcattgtgtttatactgtatgtatttatactttattcatttatccattgatggacatttacattgattccatctcttggatattgtgaacaatgctgcaataaacatggcgtgcagacagcagtatgtgaaatcagacacactgatttcattttcttgctatctatacacagaaggcaaaacattgagccttcagaataaaagtaagataatatactgaataaagaacattatatacaaaagtcagatcactattggatgtataccgaatagtgggattgctggatcatatagt

SEQ ID NO: 221729 - DNA, 411 bp, Homo sapiens
tagtctgacgtaactgctattgttgtacccggatggcctctttctcagtctttaggagtacttgtcttcaggcggactctcttcctccttctgctgtcttgctggcgcaagttgctgccccaagttgcaccttggaactgggcctgagaagagaggagttattcatctccttaagctttcaggccccggggagaatcttacaagcacttcatagctaaataatgctatggtgatttattcatgtgctgacattgtatagcttctttattgtattttttaaaaaactgaattgcatgagaccttagtagttaacgttttatgggaggaagctattgtgtttgtttctattataccaggaaggttgaatcactgaggaacttggtatgatgaattcagttagtaaaaaaaaaa

SEQ ID NO: 221730 - DNA, 396 bp, Homo sapiens
ccgactgttgtttttgcactatctgtgtgtcaacacagtccacaatgctacagtgacttcttaggaatatcttagtatgatgaaaatagttttgatctctcggatcccttagaaaggtcttggagaccctcaggagttcaaggccatactttaagaaccactgttaaagacataatcctaaatgatgaaggatatgcaggtattggggatatttaaaaaggaacaaatacaaggtttctcttaaaattgctcttgaatgcttgtggtagtgtgtgccttgtagttttggctagttttagtaggatgtaataactaagacttggaccaccatggaagaagcaactttctgcctttcaggattttccctgataagaaaatggccagtgccattatgaa

SEQ ID NO: 221731 - DNA, 686 bp, Homo sapiens
cttctgaaaatttggacgacagcaaaatgataaattatgtcgataatgataaatgggcacaacatactcataaagcaggtcatttctaccaaaatatttctagatttcatcaattttcccaagaaccttgatatcctttgaaattcaagttattctttttgagggtctgcttggttttcatcctggtagcatttctgattatctaatctaacctccaaatccctatttatccttagttccactgattcaagcaagcatgcaagttacataatttgaccttgaaattaatttctgttgtcaggtattctccaagaatcaaaagagacacactccataaagccacatattgaataggctggggcaggaagctagaatatttgagtaaggccaaattctttaagagattaattttacattgtgatgaagcttgctcccatgaagcaaccttctaccttgagaggtgtgataatgagaacctctattatctcatgtaaccatttcaagtcttgtcaggtggctggtatctacattttactaaactaagatgaacaaaataatgtatttaccgaagatcatagagaaaatcaacagaagacccatgactgaaaacccaagtttcccaatagctcctactgtatcactatagtgcctccatgatatacatattcatgcaacaatatgcattc

SEQ ID NO: 221732 - DNA, 612 bp, Homo sapiens
taaagcatatttcaatattaaaatgtgcaggaaactgaaaaatcaaagtccctttgtctttgtataaagttgctgacaatttcatttatgagatcagggaagtaataaaaataaaaattttctatcaggaaaaagctcaagacctaccttgtgtgtaccatttaaaaaaaaaatattagatttgtagcaactagttttgggggtgagggctgagggaggagtcataaaattacatataggagactttttaatatttgatgatgttaaatatgatgccaaaaggatagttcaaagattaaggaaaagaacatgaagccgggcacggtggctcacacctgtaatcccagcactttgggaggccgaggcggtcggatcatgaggtcaggagattcagaccatcctggctaacacagtgaaaccctgtctctagtaaaaatacaaaaaattagccgggcgtggtggcaggtgcctgcagtcccagcaacttgggaggctgaggcaggagaatcgcttgaacccaggaggtggaggctgcagtgagccgagacagcaccactgcactccagcctaggcaagaagagcaaaactcagtttcaaaaaaaaaaaaaaaaa

SEQ ID NO: 221733 - DNA, 277 bp, Homo sapiens
tagtttcaacagcttagcaagctgagtccttgagacacagagtggctttatcagaataactccaagtgcgcagaggacgacagagagacaagaggaatgcttctcagacttactggtttcctccaaggatttgcttgactctaattattggaagacctccaggggccaagactgcctgagcttgtcaagggattcctctttctaccagaggacaccaccacccagacactaaatcagatgagagctaacattttcacagcaataaatctctggaaca

SEQ ID NO: 221734 - DNA, 340 bp, Homo sapiens
cattaggtagctaatacatagtcttgcaagagttcgttttttggctgagcattatgttcttgaggttcatctgtgttgatacctgtagttgtagttcatctgttttcattactatgtgcctttcccctgtaagtagtcccccccttatctgcaggggatacagggcccccagaaggtgcctgaaacttcagatagtaccaaaccctgtatgtactatttattttttcctatgtatacatgcctatgagaaagtttagtttgtaaattaggcacactgagagatgaacaataatgaataataaaatagaacaattatagcactatattgtaaaaaaaaatg

SEQ ID NO: 221735 - DNA, 522 bp, Homo sapiens
aaaaaatctacatcaagcttgtcctgtctgtggcctatgggctgcatgtggtccagggtagctttgaatgcagcccaacagaaatttgttaactttcttaaaacatgagattttttttcacaatttttttaaagctcattagctatcgttagtgtattttatgtgtggcccaaggcaattctttttcttccaacgtggcccagggaagccaaaaaattggacacctctgatctacataaaaagtggcagttcagatgtgttattcaagggacaactgtaaatacagaaaggcatatcccatggtgatccattgctgtgggggaaagaggaaggagggagtgtgagaaggacgctttaaataaagtgatctgggaaggcatcagcatagataaatagtagttgtaaaaaattatctacctagtagggactaggtgcagtggctcacacctgtgattccacactttaggagcctgggagtttgagaccagcctgggcaacatggcgagaccttgtttctatgga

SEQ ID NO: 221736 - DNA, 681 bp, Homo sapiens
agacaagatgattaaatgtaataggagatactggaacaacaaaaaagggacattagatgcaatttgaggaaatctgataatggacttttgttgatttatcgatattggttgattaattgcaagaactaataaattgtaataccatactaatgtatgatgctaataatgggggaactgcggtttccaggttatataagaactctgtaatgtcttaaatttgtttgtaaatctaaaccttttaaaatagctaaaaattatagatacaatttctaaatgatttaattaacaaaaccagtttaattcttcagttgaaatgagcaaggttagggatacctgtgtgtttcagtgtaatatctgaaaggaaaagaatagatacataatttatatcacttctctctggacttagggtctcttgtcatatacatgactgggcatccatcagcttcagtggaggaaaggttaggaataatagtgtcagaactaacatgagaattttaggagattactgagtcactcaaaatgtctgggtgacccagctgatgagggccatttcacatgaaaaagattcctgcaacaccttcttttctttagcacatgatcgtttatgaagctcttttacattgttttatctttatagcaatcctcagaatagatcaagctttttttttttttttttttgag

SEQ ID NO: 221737 - DNA, 439 bp, Homo sapiens
tctgcacaggggcagtggagagcgcacggcttctgaggcagcggcctgggatgaacctctagcaattccgctcaccagcagtgtcacctcagataagctacttaaggtctctgggcttcagttttgtcacttgtcaaggaggaagtcgtcctccccctgtgtcatgaagattcaaggagagacacatggactcaccctgaacaacatggacactgagcaaaacctcaatttatggttttaaagatgtcaagaagtattaccttaatatacatgtcacaaaaatccttgtcagactctgttctgatttacttgctatgtaggtcacatagcaagtaaatgcctaaaaagtgcaatttaatgatcctttcgtaaactcctcttcccctgggctggaatgatgttctggagttataaattaaaagaatgctggtaccctaaa

SEQ ID NO: 221738 - DNA, 496 bp, Homo sapiens
ggggctgtcaaggccgtagcatggtgtccctggaagtccaatgtcccggcaacaggagggggcaccagtgatcgacacatttgcatctggaacgtgtgctctggggcctgtctgagtgccgtggatgccctttcccaggtgtgctccaccctctggtctccccactacaaggagctcatctcaggccatggctttgcacagaaccagctggttatttggaagtacccaaccatggccaaggtggctgaactcaaaggtcacacatcccgggtcctgactctgaccatgagcccagatggggccacagtggcatctgcagcagcagatgagaccccgaggctatggcactgttttgagttggaccctgtgtggcggcgggagcgggagaaggccagtgcagccaaaagcagcttcatccaccaaggcatccgctgaagaccaacccctcgcctcagttgttttttatttttctaataaagtcatgtctcccttcaaa

SEQ ID NO: 221739 - DNA, 455 bp, Homo sapiens
caaaaaaatgaattttactgtatataaattaaaacataaatgttaaaaaagtggagacaaactcattttgagagactacagtgtaaaaagggagagagatttactattttatattttaagaattcagaacagttttctgttaagcctcatgtgcatgcctcagtatcaggcaaacacttctgttaactctgccaaggataataggatttagagccaaagggactcctgaaaattattttgtgcaaccccatcatttcataaataagtaaactgaaggctcaagaggctaattgtcttccaaggctctaaatgtagttactcttgctgctttctagattttctctttgtctttgtctttcagcagtttgattataatgtgactcgatgtgactctctgcatttaacctactcggagttcattgagcttcttggatatgcagattattatttattta

SEQ ID NO: 221740 - DNA, 496 bp, Homo sapiens
caggtgttatctgcaaatttaatatacaaaaaaatgacgtggtgaagagagaaagtactgaatataattttaaaatataggcccagagaattaatagtttcctttcattctgctctggttaggctctctgcaggagttttgtgttgaatttggggagccactttttaagagaaactctgacatgcacatctgaagaaggcagtcaagataataagaaaaccaggctgagcacggtggctcccacctgtaatcccagcactttaagaggccaagggaggaggaacacttaagcccgatcaggagtttgagaccagcctgggcaacatagttggatccctgtctctacaaaaatttttttaaaaatcagctgggcattatggcatgtgcctgtagtcccagctactctgaaggttgaggtgggaggattgtttgagcctggaagtttgaggttgcagtgagctctgatgcctgggtgacagagtaagaccctatctta

SEQ ID NO: 221741 - DNA, 520 bp, Homo sapiens
gcattttggtatctcttatcaggcctcctgccatctggttaagaaataattatttttttaaaaaaattcccaatcggtaattatattatccttgcattataattgcccaaataattattggacttacacagagtctttcttcccttccatgaactctgagtccttttctagatgttatatcattaacctattattttatagaaaaggaaagtgaggcctggccgaggttgcccagctattaaatggaatacttgcctaaggtcaatgtcctttttcctaatcactgctctggaatgattggtatttaacaaatagtaacaataccactgtgctgagtgaattcctattggttcctcaaggctccatgccctttcaagtcccagtcctggtttcacatttatccctgcctgaaacactgcctcaattacccctcacacacttagcctggataactcctattcatccatcccagaatagatattatttctttttaataacagctttattgagatataatttg

SEQ ID NO: 221742 - DNA, 397 bp, Homo sapiens
ggtagggtcctgccaggctcccaaaacgccccgtcccagcactcagtcccatggaggcagcacagcctcagggaggccagcgactctgggcctgcgggtgagtccttcagcccctgcacagcccaatccatctgccacccacttggtgaccccaaattgtagtaagacaacacttccagttactcaacagcttctgaaatttaaatctctggaacaatttacagtaataagaccctaggtgcacctgtctactatccttgtcctccctaatgaaatgggctaggcgtggtggctcatgcctgtaatctcccattttgggaggccaaggcaggagaactgcttgagcccaggtgttgggagaccagcctgggtaacatggcgagacctcacatctaat

SEQ ID NO: 221743 - DNA, 371 bp, Homo sapiens
agtcatctaagatctttagcacttagcttctaaaatacacgataaccatagttcttttcctctttggtaaagaaattattattttgggccgggcgcggtggctcacgcctataatcccagcactttgggaggctgaggcaggtggatcacctgaggttaggagttcgaaacgagcctcaccaacatggtgaaaccccatctctactaaaaatacaaaaatttagctggacgttgtggcatctgtctgtaatcccagctactagggagactgaggcaggagaatcgcttgaacccaggaggtggaggttgcaataagccgagatcatgcaattgcactccagcctgggccacaagagtgaaactccatctca

SEQ ID NO: 221744 - DNA, 377 bp, Homo sapiens
tccacagtaataaagaatcgagaaacagatattttttcaatttcttcccattacattttatgtccacatttagatgtatctgggaagatctctaaactgacaccactgtgagaggcccctgggattcacaaatatcatttccatgacactcagaaaacgggggaaaagaggaaaatgtgagcggtgataaattggagctaatctctttctgccacaacctgaaatgatacttggccagatgtacacacctgaattcaggatttacccagagaagcctgcccagaactttgagcacagtaggtcctcaataaacatttcctagggggctaactgaaaggaaaacaatcaaaacaaaacaataaaattaaggtgttgga

SEQ ID NO: 221745 - DNA, 245 bp, Homo sapiens
  misc_feature (224)..(224): n is a, c, g, or t
cgtggtcgcggccgaggtacgttttacaagttcagcactgtgctagcctctgtggggattcccaaagcagaaagtagacgggtgccataggatgcgcagaaggaagcgctggtgtaggtgtggtccaccgatgatgggaaaggaaacggagcttgccttggtgtcattaccaacaggtttgtgatatgtatacatttctggatgcagtatggttaaacaggggncatttaaaagagcccccaccg

SEQ ID NO: 221746 - DNA, 435 bp, Homo sapiens
cactgtgcccggctgcctttttattttgcttaggagagtttccagtcctcattgagagagtgcgtatgtatgtaatttcttcttttttttcctaagggatgaggttttaccttgttgctcaggcttatcttgaactcaggcttatgagctcaggcaatctgtccactacggcctctcaacgtgctggattacaggcacgagccaccacacggagccagtgtaatttctttagagttacaaattacaaagtaaaaatatttatgatcaaaatacttactcttgttgcatttaatttcagaaagaaactctctaatattaaagaactaaatcccagtactttgggaagccaaggcaggcagatcacttgaggccaggaattcgagaccaggctggccaacatggcaaaaacccatctgtactaaaaatacaaaaatc

SEQ ID NO: 221747 - DNA, 352 bp, Homo sapiens
gagatggagtctcgctctgtcacccaggctggagtacagtggcgtgatcttggcttactccaacctccagctcttgggttcaagcgattctccttcctcagcttcccaagtagctagaattagaggagtgcctggctaatttttgtatttttagtagagatgggttttcatcatgttggccaggctggtctcgaactcctgacctcaagtgatccccccaccttggcctcccaaagttctaggattacaggcatgagccaccgagccaccgagcctggccagatcagcaaagttctgtgatgcaaaagcctgggcaagtaatgcccttgtctgtcttccctgctgtctccag

SEQ ID NO: 221748 - DNA, 418 bp, Homo sapiens
cactggccaggaggagccaacacaaggtcctgggcatctccgtcccgggaaggtgggtaatgcccctgtcgctctgggctccagggcgcgcccccgcagcttccccagcggggtctgacgcctccgggccgaggtgcgccaggtggcgagggtgccaggcgcggccaagtcgcggcggtctgagtcagtcacccaactatgctgcggaaccagggaggccggctgggccgcccccgccgttgagctccggcttcccccgcgcggggcgcctgctccccgcccccgcgggcggagaggaagcggcggccgaggcgaggcgcgggagcacctgagcaaggcgcgggcgccgggctcggcgtttccggagctgagcgcgggtccgcggcccgcgctccccgcctccaggtgcggcggccgc

SEQ ID NO: 221749 - DNA, 420 bp, Homo sapiens
gctgagcaataattcattgtatggacatacagcagtttgtttattcattcatctgatgatggatatttgggctgttttccacttttttggaagctgctatgaacactcacatttaagtctttgtggacatatgtttgcatttttttaagataaatgcctagaagtgaaatcttagatcctgttgtaagtgaatgttttacttgataaataaaagactgccagtttggtgcagtggctcatgcctgtaatcccagcactttgggaggccaaagcaggcagactgcttgagtccaggagtttgagaccagcttggacaacatggtgaaaccccatctctacaaaaaatacaaaaattagttgggtgtggtggcccaggcctgtagtcccagctactcgggaagctgaggtggtaggatcatc

SEQ ID NO: 221750 - DNA, 429 bp, Homo sapiens
tcctggaggaggccacctgtttagcacaccctgctggagagatgaggtccctcaccacttagaactggagttgaggctaataggtttgtatacattcagaccagctcaaaagacaaagaccacggaaccaagccactgaagacctgtgccacaattcctttagccagtatattgaaaatgcaatgagctgtcgacattctcgccccttcccgtcccttcactttatttcctgtgtaaactataatatactctcagcttgacgttggggaagtggctcactctaaacctgtttcctcatctgtaaaatggggataacaagaaaacctttgtcaaagggcagagaaggcatgagaggacatgtgtaaagcattgaatttgatgcctagaacatacaaatgttcaataaatgttagcgactattatgctaga

SEQ ID NO: 221751 - DNA, 428 bp, Homo sapiens
tttttcctactgctgacttgaatattcagctttctgcagtctaagtcatttgctatttccagttcccaaattttgttgctctcatttctaccttatctaaaatgatactcccaattcaatattgtctctcataataccctgtatgttctttccacaacaatcatcatctttaattattttcctttattatttatctctgccactagaccattagctatctgagggaagactggttcttatttatttttcatgcctatcacagcaatgaactatggcacagagactaggaatatagggtcaggagtctgggttcaaatcccagctctcccacttagttacatacatacccttggataaaaaatctctctgtgagtctcatttttcatcagcaacagtgggataatagtaaacgtttctcctagagcttt

SEQ ID NO: 221752 - DNA, 474 bp, Homo sapiens
accacctctgtgctgttcactgttgggtccctgggaacacaggcgagctcaatacctgtttggtgaaggaaggctcaaaggaaggagtggttgaagagggttaatcgtcatctctctggctttaggtgccctgcagccttggcaagggcattccacttcctgacctgtgttcattcaagcagccaccctgggaggtgcgctgggtggggacagttcttcctgttaagaacgcaagtggtggagggggcctttgtcaaggtcagagacaagcaccctgtgagccagaggccaaccagtccccaaggtcagctgcctgccaggccattctaaaagcaccagttcttccaggaagctgtccccagccttcccaaccgggaattaacctctgggcctcagttttctcatctgtgaaatggagatgtgaaaagtgagcgagccttgatgacagtcataataaagatggttaatatcgac

SEQ ID NO: 221753 - DNA, 571 bp, Homo sapiens
agctatgtgtgtgtgtgagtgatttattagctacaggtaatgcttacttcacagagtctgaaaatgatgtaagatgatgtcacacagtggttgatgagatcacacttgaactgcctaactcacaggcttgtgatcaagtttcattcaatttgattaaaagaaaattaagcgtatcaagggtgtaaaggctacaatggtgaacaagtttttgggttcagtccatggaggcttgaacagtgcttggcacccaattagtgccccataactatttgttgaatgaaagactaatgtgtgaagtgtgtttctctgtgagttattcttgttcagtaggtgttcagtaagggcttgctggttcttctaattgcctgtgggtttctgctgcaaatcacccatctctagctacatgggttcttgttctgtcaacataggtccacaccctgtggaataagtgaggcagaggtgtcattttaagcctcagtggggaaactggtatcagatgggttgctggtaaaaccatgtaaagcaaaaaaaagtcgacgcggccgcgaatttagtagtagtaggcggccgc

SEQ ID NO: 221754 - DNA, 298 bp, Homo sapiens
tgtgtgcctcttagatgtactgagaacatgtttaaggatgcaaactttttataccatgtatgccttatccactagccaaggacctggtgtggcattgaagtaaagatatgacaacttgttccaatgttggggaaaaaaaaactggctcatatggctcagtgggagatggtgtagaaatgtgattcctttcttaggaattttaaagtgactttttaaactctctactttgggagttttcaaacatacacacattgagaaaatagtatactgaaccccccatctaccgaccttaatgata

SEQ ID NO: 221755 - DNA, 484 bp, Homo sapiens
gagggtgaggcgtaacagggagaccgggtgtcgggagaaccagaggagaggagactggaaagaagcggggaagtgtgcctggggcagcttccgaaggggaacggcggggacagatgaggggggcgcgattgcaaccagagcgcccgcgagctcccggatttcttctctttcctcgctatttcccgcacacacagccctgcagccctcccttcttccttcctggcttgtgattagaacgcagccgcaggcggaagtgcagtgacgccatcagccgtcgcctgagccgtggcgcgcgggtggccgaaaggcgaaagtgagatttcaagggccgggtctggggccccgcgggcgcgcagtgctgcggcgtgtggggagtacggggaggctggagaggagccggccccgggcagtgtgaggtgcggaagcgcggtccagacactttgctgacgggaggccggtccgccagatccgggaggtggggcct

SEQ ID NO: 221756 - DNA, 470 bp, Homo sapiens
caaagcccaccttgatttaagggaggggacatagaccccaccccttgatgggctgttatgttagatactttgtggccattttgaaacttccacactttaaaaattttgttttggcattttttttttgttaacaaaattatgccagttgtatgtggctaagtatttacacaatttttatgaagtggagggatatagagaatgataagcagaccttccccttcactgctccaccaaacctcagcccctttccagaagtaacccctcaactctctgatcggtattgttctggacttactggtgtgtgtatttgcatggtgttttatcagatgacattgccatcttttacttattttaagatgaaagggattgtgctttataaggatttccatggcttaaggacatgttgggccatctctccatctcaggccgtctgcatgaaccccttcctgtctggcctctgcagcatattt

SEQ ID NO: 221757 - DNA, 499 bp, Homo sapiens
aataatgttgctaataatactcatgtttgtcttatgttatttactaattctaggatgaaaagccagaatacaagcagtgaccaccacacctgacagacctcttgctgcacatatctgtactctccaattaacaaaacctgatgctaaaaacagaaaagaggggagatgtaggagattggtcagggtggtgggaaaaattgtagaaagatgaaaccttggaaggctggaaggttttacaaaagcttcagaataggatttggctgaaggcagccagattctcttatcctgtgccttaaagcttaagttagataacaaggggatataaagaaactgatctaggtaagttagtttacttaggccttggaacctggcctttaatcatctgcaggactgctctccagggagggcgactatgttaattatccacaagtgtgttaactcaaagcctttgttattaaatttatactgaataaatgcctgcagtgccagcatgtcaggg

SEQ ID NO: 221758 - DNA, 483 bp, Homo sapiens
agaggcatcagaatgaaatcaaccctgctgacaccacgaacttggacttccagcctccagaactgtgggaaaatacatttctgttgtttaagccacctagtctgtggtattttgttatggcatccctagaaaactaaaacagaggctaactcacctggaatggccaaggacaatctgctggcttaggcctgtctccatctcagttccctggggcaggggcaaagccatatctgaaattttctttttcctcccatatggttcttacagcctcaagaggcctcttggcctttccttccttaaagaagtgaccccagcctctctgcctcccagatgagacagtctggagcctggatcctctccttaaagcaaaatatctagttcatcatttattatctttttaatctatttgtttatggatgggctttgagctccccttcttctgggccccttttttttttttacgtcaaaagctgaaaactggct

SEQ ID NO: 221759 - DNA, 259 bp, Homo sapiens
gcgaaactgtctcaaaaaaaaaaaaaaaaaaaaaagtaaaatatgttatataaacttgctaaatgtaacacacacacacataaaacgttaggggtaccctctccgaaaccgtatttctggaaaagtgtgacgctacagtctgtcactgatataaaatcccagacaaagaccaactaaagaaaatccccaccaaagaaaatacatttttggtttctttaagggagtcagttccggactgtggaagttcttctggggataa

SEQ ID NO: 221760 - DNA, 430 bp, Homo sapiens
ctatagatttctggcttgggcggctgggtagatgttggtaaccagattgagagaatagaggaaatgggacaggtagagtacagaagagaagaaagatgcattttactacagatacaagtttgaagtaccaggaaacatccaaagggagatacctagtaggcactcagatatatggaactggagctaagcagataagatatattttgttacaggtaacagaaacttatttcaacaagcttaagcaaaaggggaagttggttggcacatataaccaacctgagaagaataagggtagagcagagccaggcctgtgaacaagaacagatgtttacatcccatcaatacaaccccaaacctctcacctctatttatctttgcaagtaagagaccccacagtcaactgggttcttcacatgatgaaggacatgga

SEQ ID NO: 221761 - DNA, 691 bp, Homo sapiens
tattatggttacataagatgtcaacttcagtgcaatgtgggatcctgtatatgctcctggaatagagaaaggatattaatggaacactggggaaacttaaataaggtttgtagtatagttaagaacattgtatcaatattaatttcctgttcttgatcattatactatggttacgtaagatgtcaactttaggagaagcagggccaggagtggaaaggagttctttgtactattttgcaacttttctctccatctaaaattagttagaataacgcccttcatgggaaataaaggcagagcacaacactgtaaatattacaatcccaaatgtttaatatatgcgtatatagaaaaaagactgggaggaattgcaggaatgtggtgacattgggtatcgctgaatggtggaaattatggtaaggtttgctttcgttttcatattcatctgtactttctaagttttctactcatttgatggtttaatatggtggatccttggaaataacggtgaatgagacaagatgaagtttatctctcatggagcttatcttctaatggggggaaatggaaaatgaatacatgaattaaaatctttgtgcagaaaattaagctgatgtgatagatggtcagagggggcctctctgagaaggtgacatttaaggggagatgtgaataacaaggaagagaacat

SEQ ID NO: 221762 - DNA, 482 bp, Homo sapiens
aaagttcttgaggagcctttatgactccttttagctcaaggaattataaaagatgccttaaggtgcattccctgcctcggagtggctttgcgattgtttatacgttgctaccatcccaacaaagagatggcaaataacagttttctccatccctggtagtctactctgtcttcaccctcagtttgtttcagcagtgtgagctggctgaggtcctgctgagtggtggttttcttttccttccccacttaatttaacagaccagctgaacacacatcagagagctaagctagagtgtggagtcattatggtcttctagtatggttttatgccccactttggggactctggtttgggacctagtttattattctgggcaagaggaaaagggcacacgccaaataatagcaaccacaacacagatttgagtagaacttcacactttggtctgtttcaccatcatgacaattttgtgagataggaaa

SEQ ID NO: 221763 - DNA, 430 bp, Homo sapiens
tcaagcaataaaagaaagggattttatctataactttagaaacacagcatttcatatttaaagttgatagaaatgtaaggaaaaataaaatccgtatgggtatcatcttccaagaagaaaatatgaattaagggatagatactttttacaatatgaaaataatcagaatttaccctatagaaatttaagtctgaattaactacaaggtaatagaagaaacgttcttcttaatctcatgtgtgttctctgtaactgattttcttgagtgcaaactgcacgtatctggaccaaggttcattttataaggcaacaagttagccagggggagggtgtggctaggtgtttctcttgctttgaacatctaataaaccaattcagtggaaaagaaccgaataaaatacagaagaatgatagttctcaatgaaaggtt

SEQ ID NO: 221764 - DNA, 530 bp, Homo sapiens
actgtctctcctcttccttcctccatggatctgcttattcaggacagccctgattcttccaccagtcccaaaggcaaacaacccacttctgcagagaatagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtaggcttgttttgtccttgcaataaggtgaacaaaaattggactaatttgcatggctaagatctctgtggatgcatgtagatgtgtgtactatgtgtccgtacatcgcctcttgcaagtaatttatgaagatgaaatgcttttgtaacttccttcacctctttctttccttaaatattctattatgtgaataattatgtcataatttaaccactttcttgcacagaccaatattgtgaaaatctttccaacgtttccttaat

SEQ ID NO: 221765 - DNA, 512 bp, Homo sapiens
ttcaattcctttgggtatatatctcagaatggaattgctgagccatatggtcattctgtgtttagcttttaggaactatcagactgttttccatagtggctgcacttacattctcaccagcaacatacaaaggttccagtttttccacgtccttattaacacttaatttccattttaaaaaagcttatttttattatggccgtcctcttaggtgtgaggtggtatggttcaggactttacttcttgtgctgagttttttaaaaaattgtgattaaaaacacataacataaagtttatgattttaaccatttttaaatatatagtacagtaagtgttaactgtttgtggtttgttgtgcaacagatctctagaactttttcacttctcaaaacttaaactctatagtcattaaacaacagctcccaatttccccttcaccccagcgctgtgtaacctactttctcgttttatgagtttgactacattaaataccttgtataagtgaaatcatg

SEQ ID NO: 221766 - DNA, 465 bp, Homo sapiens
ctaatgggagaaggaaaactggttagccaaaatgacctgtgagctatcaccaaccctgacatgctgggattctatggaaggttttatattgcaaagaaaggttaagtccccatttgacagatatttttgattgatgccatcatgaagtaaagattagagaatgacaaaataatagaatttaccagatgctgaatcagaagtattttctccttttggaaagtaatgtgcctcacgattgcctccacacgtgccttcgaggttagctggtcagaatgagattgcttagagtggccagagaaggcaaagatgttcttatgtcctgaatatgctttttcttgaaatcatgttttgctcttttaaaatcagtttaaagatacattctctttttctggtttggccccctagcattttttatatgttctgttgagataagtattgcttaaatgaatcgtttattgaaggaaa

SEQ ID NO: 221767 - DNA, 420 bp, Homo sapiens
ttagagaggtagtcaggggatttgagttccaggtctgactgtgcacttgactcaccacgtcatcttggttaataatcacctaacaataaaaataataaccttaatttatataatgctctgcagtctgcagagcacttttaaagaaagtataggctgggtgtggtggatcacatctgtaatcccagcattttgggaggctgagacaggtggatcacttgagtgattaggagttcaagaccagcctggacaacatggtgaaactctgtttctaccaaaaacacaaaaaagtagctgggtgtggtgaaacatgcctgtggtctcagctactccagaggcttgagcctgggaggcagaagttgcagtgagctgagattgtgccattgcactctagcctgggtgacagaacgagatcttgtctca

SEQ ID NO: 221768 - DNA, 367 bp, Homo sapiens
gaaaaagggaaaaatgtgttctctgcctctccccaacttcccagaaagaaaaaaaaaatcataactgtcagaaatgtgataggactgtcaaagacatatggaagaaacccaaacaaaccatggaagttgtgaaacataaatcccaattctatttgttctacgacagtgtataaaccacacatttttcatcaagatagaaaattaaaaccctcgccaggctcagcattgctggggaagttggatagaaaccctagtgtcctggcagaaggagaagcagctgctggctggcctgggactgaaagatgcttctgaaccgtggactggaccacagagtttagctgcctccctgtctctacattttagtact

SEQ ID NO: 221769 - DNA, 557 bp, Homo sapiens
gtgatttttatacaaccagcttttaagaaaatgtatttattaaacattattgagtagaggttatccaattacctttgctcccagaaacctttttgtttttttagtgttgctaatttccctgagtaaaatactaactatcaaaatagaacaaagggaaacaaggccaaagaagtggcccagactgaaatattcgtccccgagtaagagaggatgatggccttaaggccggtggaggtgagatttgtgccgattcacccctgcctcagccctccctgccaaggggctgcttctgtcctcagccggctgccatttgccttcttgactttggaggcttatcattaaaagagtgttcaaaagaacggtctccacagaacctaggcagattttaaacttacattttcatagaggtttatattttccttggattaacacaacattcatttaccacaaatctcttgtttagggaagagtggcacaccaggcacaaataaatcattgctaagtgctttcctatgtgttatacttgttaattaaaccttgttttgtcttgaccaaat

SEQ ID NO: 221770 - DNA, 513 bp, Homo sapiens
tagctagaaactgcaatggaataatgcaagaacacagaacaggaagagaaagcagcgatcctgcaatcattcaaatgtgataatacatgcaggagagaaaggaaaagaattaggccatgggtcagctaacctttggaactatttttagcctcagaagcacttttatcccccttataaattccatacttaaagttccagaatttaaaatttgatgagaactgttgtgctgtttcaggttgtgaaaattcatttattcatacacgtaattttacctttgagcaaacttcaaaaagaatgactgccaaaatgtattataacctgttttctcaaatgtttttctcattctcttttttaaaatttctctctaaaaacgtcatagggacaactgtaattaggctaattgcgtccactcatatgtgcagcttatggcaataacagagcagtcatagaaagaacgaggtgcagtatgcttcaaaatgcagcatctgcagtgctgtcaaggccagccatgcc

SEQ ID NO: 221771 - DNA, 670 bp, Homo sapiens
  misc_feature (602)..(602): n is a, c, g, or t
cacggcagaatcacactcaaaaaaacaacaacaacaacaacaaaaaaactacccaattttgtttaatgggcaaaagatttgaacatttcaccaaacaagatatacaaatggtaaataagcacatggaaagatgttcaacattattagccatgagggaaatggaaattaaaactacactatacacctattagaatagttaaaaacaaaaacaaaaaaaactttttaaacctgacaataacaagtgccgatgaggaatcagagcaactggaactctcctacattgtttatggaaatgcaaaacaggccaggtgcagtagttcacgcctgcaatctattatatttagtacagtaacatcctatacaggtttgtagcatagcagcagtaggctatatcgtatagtctaggtgtgtagtaggctataccatctaggtttatgcaaatacacttaaatgatattcacacaatgacaaaaccacctaacaccacatttctcagaacacatccctgttgttaagcaaaacatggctgcacttttgccatacttttacctaccaatcctactcctaggtattttaccataaagaaatgaaaacacatgacncacaaaaattgcataccaatctccatggcagaatatggttttgggttatatttcttgtacggattagc

SEQ ID NO: 221772 - DNA, 518 bp, Homo sapiens
ccacttttacttatgccactttggcaaagttttggttgcaaccaaatcatctctccagcagtgtgagaaaatacagagtgtgaggcacttgcagttcaataaagttacagatacatagtttactcagtgagtttggtttaactcagtgtagtttttatttcccttactgcaggtgtctcctgcctgtccctgaggctggctgcttcttaggcccagtccttaggaaaacagatggagcgtgtgtgtctggtcaacatagttttaggtagaaactggctctttgaagccattcaaacctgagcctattggttgactcccaaaattttatggctaaaacttgtttaactttatttttcagttttctcagcccacagtttaaaccagaagtagctttcctctgaacttccactaatttcatttactagatcatgttttctgagatcttagtctctattctgtgccttgcattcttccacatctcctggctggtcctctggcctgccggtcctttggtcagg

SEQ ID NO: 221773 - DNA, 434 bp, Homo sapiens
cagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaatt

SEQ ID NO: 221774 - DNA, 658 bp, Homo sapiens
ttttaagccaaaaaaaaaaaaaaaaaaaagagggcagttttgctaagatctatcaatctatcaagcaccagcttggaccactgaattaaacaattttggctttaccatgacagcttcccaagtagctgggactgcaagtgcgtgccatcacacctggctaatttttaaaaaacttttgtagaaacagggtctcactatgttatccaggatagttttgagctcctggtctcaagcagtccttccgccttggcctcccaaagtgctgaaattacaggcgtgagccactgatgcacacctttggttacaaaccactacatttttggaaaccctcctggttctggtaggaatttatatttgggctatatggtggtcggtcttttcaagcataatggcacaccaagggttaggtaagctaaatgctttcaagtgcttctcttgcagtctagagttccagcaggatgatttgctttccctccaagctctcttgcaggattcacaacagttctccactaggttggtcctccttaatatccccattaagatttttccccacagacttatcagatttaacttgtctaaaagaaaatctttaattccctgcctactcgctgccaaaaacagaaacaaaaaatcattcttaatcttctgtatcttctga

SEQ ID NO: 221775 - DNA, 321 bp, Homo sapiens
aagcttcagtgagctgtgatcatgccactgaactccagccggggtgtcagagcgagactccatccctaaaaacaaaacaaaacaaaacacagattaattcaacaaatgtatcttgactactgtgtgccagactgaggatacagcagtaagcaataagcttccctctagagcttatcgttattgccatctaatcatgataacatttttgtccatagagttgccatgaggaagtctctttgagactgtgcaagagctgattgattgcaaagctctattgactgggaagttgttcatgaaggaggaatatttcaaaatacatag

SEQ ID NO: 221776 - DNA, 380 bp, Homo sapiens
agcggtgtggctatggaatgtgggaggcataggcttctggtggtgtggagctcagagccctgatgtcatcatgtacagggtgtcacttcagaccctgtgtcgctgaatacaaaaagctgacatttactgagcacttactatgggccagtccctggtggtaagctttatagattcatgttcatgcatttatacaaacatatatatgtataaaacacttatatgtgtaattttacacacacacacacacacacataattttttcatttaagcctcacagtacccctatgagatagtattaccattatcttatttttacaggtgggagattggggctcaaatttaaggaatttgttcaaggtcatagtggagccaggattcaa

SEQ ID NO: 221777 - DNA, 516 bp, Homo sapiens
cctccgctacaaactagcactgaatgaaatgtgtcagttttgaaaaaggaggtttttatacattacacaacctctaagggcacttaacagctctaatatgttttatcagggcccactgcagcaaaatttattttattgtaaagcaatattttatgctaaaataaaatagttctaaaagttgtttccacccctctttatgaataacttctcacttctccatggcgaaagaggactgaccacagcaaaaattcggtggaaaccaacagctcctggaacacaaaaactggggttgtttataatctctccaccctgaatatctagcaccattactatataataataggtgctcaataaaggtttgttaaataactttatttttaaaccttaaacagatactagaagagtccatagttgatttctggtcatgcaacggtttatttctatattgtaagttatgtattgttatgtattatttctgtattaagagaactgagaccacagtagcaaacatcattt

SEQ ID NO: 221778 - DNA, 429 bp, Homo sapiens
ggagagagctctcacgaattccaagcctacaaaacaacagccttggagctccgcggcggcagtcgccgcgccccgggccgccgaggccactcgtgggtcgtgggtcgtgcgtcttccgtgtcctgtaagggctgtctggctctccctgccaggggtgcagggggctgggatggtgggtttaatattaagaggaggaaatctcaaatcttcctcccctcaatgccctcctcccccccgctcccaccccccacacacactctttctctagatgcccagagaataacctacctccctggtcgggaccccttcccaccccacaccccacagctaggcccaagctatggggatgcagcccgagtgggagattatgagaccagaaacgggaccctgtctccactgatccgtctgcaaaccctcattcgccctgcc

SEQ ID NO: 221779 - DNA, 437 bp, Homo sapiens
gaggtttttagtttccgttactgggaagcgcaggatggaagacttcaggcatatttggattcaagctcaaaggtatagttaagactccttaataattatcttcatccctctttatatgctagcctcattctcttcattggcagatcgtgttcttccaatttggtgggtagagccatactcatggacaagcaacttttgcactcaccaaggttctggcaccgagaaaggccctgagtacagacacttgaacaagcccagctcctactccctgagccagactccaatcagcagaaccttccagctgacttacaagcaaaaatcaatccttattgtgtttgagattaatccttattgtgtattgtattgtggggactatttgttatatagtgttagtatggcaatagctaataaatacatgtcaccatgattagtcttcc

SEQ ID NO: 221780 - DNA, 555 bp, Homo sapiens
acagaactctaagaacaaaataatccaccatggaacagaggaaaggcaataattttctgtctttctctaaactgtaaagtaatttaaccatcaaaagaactctttgtagtttgagtgtaatgtaagaaatatgtattccataccccagatttattaaaattgcatattggaacaattttgctgaggttaaaataaatcttaaaacaaataaatattttcacagtacacatatgaaaccatttttttttggacaccaatcatataataaccaggcagtaggtgggcaaactggccaaatcaagaatgatgtctggctggggaagattgttattaagatccacctgatttcttttcttttttcctttttttttttcttgttagagagagggtctagctctgtcacctatgcttgagtgcagtggtgccatcatagctcactatgatgtcagactcctgggatctggaatcaagtgatcctccctcctcagcttccctagtagctgggactacaagcgcgcatcaacacgcatggctattttttacttttattttgta

SEQ ID NO: 221781 - DNA, 460 bp, Homo sapiens
atttagaattcagtagtctatgagctcctgtaaccagggatgacatcatgttcatctcagcctccttagtgcctagcacagtgctgattcataaatgatgttaaaaacacattatggattcactcctgcctagtgtctgtgcatctttatgtgcccagttaaaaatagttgatcaggctgggtgcagtggctcatgtctgtaatcccagctgtttggggggccgaggagggcagattacctgaggtcaagagttcgagaccagcctggccaacatgataaaaccccatctctactaaaagtacaaaaaaaagtagccgggcctgatggtgggtacctgtaatcccagctacttgggaggctgaggcaggagaatcacttgaacccaggaggggaggttgcagtgagccgagattgcaccattgcactccagcctgggagacagagtgagacaccatctca

SEQ ID NO: 221782 - DNA, 226 bp, Homo sapiens
ttctctgtcctccttcccccggctctcagcatcgtcacggtggacccctccttgtccagcatgctgcctcccgcctgctgtgacctcactctcttctgctgtcctgggacctcgtgggcctcctcccgggtccccttcctgctcctcatcctctgtttggccgtctggttgttagagctctccccaggcctcaggaggatgacgaataaatgaaccacctccgtcc

SEQ ID NO: 221783 - DNA, 477 bp, Homo sapiens
ctccttgaccttttatttaaaaaggcccaaacttttcagttctcagtgataacagtaagacttgatttatgtgccaaaaactattctttggtcagtgtttttaaattaacataataagcaataattaagctatttgccatgtagttaaaatttgggaaacactgggtgggtctaacctttaaggaaatctgtttttttgccgggtgcgatgtctcacgcctatagtcccagcactttgggaggctgagacgggcagatcatctgaggtcaggagttcgagaccagcctgaccaacatggagaaaccccgtctctactaaaaatacaaaatcagccaggcgtggtgggcatgcctgtaatcccagctactcgggaagctgaggcaggagaatcgtttgaacctgggaggcggaggttgcagtgagccgagatcgtgccattgcattccggcctgggcaacgagcgaaactctgtctca

SEQ ID NO: 221784 - DNA, 484 bp, Homo sapiens
aatatttcaccctgctgctccttagttccttaatctgtaaaataaggtgacaaagcggtagtaaccttctctcaaaaagaggtttcatcgtgttaatacctataaacagaatagtgcctggtacttaataaatactggccattattaaatttcctagatgtgtgagaatactgctatggttttaagatgtctcactttgcctttagagtttggaaaccaggctcatattggcatcacaactaatgtaagtcaccaggcaatttcaagtaatgaggccaggctatagcaaagggttatcaaattgagaggcacgcctttgtccctaacaacacagggcaaaaatccaacagctttgtcttatttttgttgaaatcattgtgtgtttgaagaagtctcttcatgaatagcttatggattttggaaaacttcccacaaaaacaagactctttgatccacaaggatttgtttttcatcttaaaaatga

SEQ ID NO: 221785 - DNA, 326 bp, Homo sapiens
tccagcgtggcacgaggagcaagactacatctcaaaaaaaaaaaaaaaaaaaaaaaagagagagagagagagagatagaatgagaattggcaacctagaagctagatagtaaaaacttaaaagaatgtagcaaaatggagaaagaaattgaaaataggaaagatgttgggcatagtggcatgaatctgcagtcccagctacttgggagactgaggtgagagaattgcttgtgcctagaaattggaggcttcattgagctgtgatcataccactgcactccagcccgggcaacagagtaagaccccatcatatatatatacaaatta

SEQ ID NO: 221786 - DNA, 354 bp, Homo sapiens
cagcttcaacaccaatcaaccactctactcatgtaggaggggaaattatcaaatcatgcccaagtttggttgaactgttcccctccaacttccccctcctgaattattctcaggcaaattccagagtggatattatttcattggcagtctagtaagaatccttgtcttttaaagatacagactatatctgcatatgtatatatccacaataccattatcaccccttcattctttaatatcttcaagtatctagtattcaaatttgcatttgtctcagatgtcatagttttagtaatggtttaaatcaggatccatataaagtctctaccttgcagttgattgggttgacgtcag

SEQ ID NO: 221787 - DNA, 586 bp, Homo sapiens
aaaattctatttccaacaaaaccatctttaaagaatggaagagaagtcaagacattttcagatacaactatttagaatgtgaaagtttggcactaaatgacttaatttcagaaacacagaacactaatttgtttttattatattaatccatgattattttatttaaaaaagaagttacttagctgggcgtggtgggaggatggcttgatccctggagatcgaggctgcagtgagagctgcgcttcagcttaggcgacagagcgggaccttgtctaaaaaaaaaagggaccgagggcagtggctcacgcctgtaatcccaacactttgggaggccaaggcaggcggactgcctgagctcaggagtttaagaccagcctgggcaacacggtgaaaccccgtctctactaaaaatacaaaagaaattagccaggtgtcgcagtgtgcacctgtagtcccagctactcgggaggctgaggcaggagaactgtttgactccaagaggcagaggttgcagtgagccaagatcgcaccactgcactccagccagggccacagagggagactccatttatacaacaaaaaaaat

SEQ ID NO: 221788 - DNA, 991 bp, Homo sapiens
gcttcactgaagttctccttggtcctgattcttggcctcctcccaccagaacgtgagctccttgtgggaggcagtgcccctcccagcctcctccctgtcacagactgtgtgggggccacccaggggctgaatggaccagggggtcagcagggagagtgctaagtggtggcggggggcctgtggcagaggccttgtgacagtgagggttgagggctggtccagagagatgatgtgatccccaggagaagccacaggggaccatgacatgggcgccaccagcttccaggtgaacgtggacctatcgaaagccagcttcagggcaggacactgtcctttctggaggggatggccccaccccacagacaaggcaggcccagacaactctaccccactgcctagaagtgcgggtccccagagccagggtagaccccctgagtcaggagcccgggcacagaactgagcacctgcactgcaggcccagggccgggttccctggagaaggagaaagactgaagccactgcctacctcctgcccacaacagactgcaggcccatttggtgacacaggacaagcagcacatgtgtcgaacactgccgagcccgcaggcacgcctgcatcccacagccacgagcctgtgaggctcaggcatgtgacctgcaggagctggaggcgggcgggaaggcaggtgggggcctctccctggctggagcagggagctccaggagacctcaggacggcccccacccggtgggtaaggaccctgtttcccaatttgcccccaaggcctaatggacccaccgggcttagggagtcctcactcagaggagaggagcccacccctcccaggacacctggctgagccggaacagcagcgcaggggagctgtgacagcagagagcagcaccaggtcacacaagcagccgccccggaaggacacggcccatggtgacagaggacaagcagcatgcgtgtgtcagacactggcctggc

SEQ ID NO: 221789 - DNA, 527 bp, Homo sapiens
cgggggatgccgggctgccgcatcagcgcctgcggcccgggggcccaggaggggacggcagagcagaggtcgccgccgccgccccgggatcccatgccgtcctctcagcccccgcccccaactccgaccttgactcctaccccgaccccgggtcagtccccgccgctgccggacgcagctggggcttcagcaggcgcggccgaggaccaggagctgcagcgctggcgccagggcgctagcgggatcgcggggctcgccggccccggagggggctctggcgcggctgcgggggcggggggccgcgcgctggagctggccgaagcacggcggcggctgctggaggtggagggccgccggcgcctggtgtcggagctggagagccgcgtgctgcagctgcaccgcgttttcttggcggccgagctgcgcctggcgcaccgcgcggagagcctgagccgcctgagcggcggcgtggcgcaggccgagctctacctggcggctcacgggtcgcgcctcaagaagggcccgcg

SEQ ID NO: 221790 - DNA, 488 bp, Homo sapiens
cgggggatgccgggctgccgcatcagcgcctgcggcccgggggcccaggaggggacggcagagcagaggtcgccgcccccaactccgaccttgactcctaccccgaccccgggtcagtccccgccgctgccggacgcagctggggcttcagcaggcgcggccgaggaccaggagctgcagcgctggcgccagggcgctagcgggatcgcggggctcgccggccccggagggggctctggcgcggctgcgggggcggggggccgcgcgctggagctggccgaagcacggcggcggctgctggaggtggagggccgccggcgcctggtgtcggagctggagagccgcgtgctgcagctgcaccgcgttttcttggcggccgagctgcgcctggcgcaccgcgcggagagcctgagccgcctgagcggcggcgtggcgcaggccgagctctacctggcggctcacgggtcgcgcctcaagaagggcccgcg

SEQ ID NO: 221791 - DNA, 239 bp, Homo sapiens
gcaaaacaaaacgaaacaaaaatccaaaaacagaaacgaaacaaaattctcccttaaaaaaacccctaaactaatgacattttctaatagagcaatctgattagttgaaaataaaggagagctgggtgtggcagctcatgcctgtaatcccagcacttagggaggaagagctgggaagatagcttgagcccaggagtctgagacctgcctggacaacataatgagtccccgttctccac

SEQ ID NO: 221792 - DNA, 443 bp, Homo sapiens
gtgtagttgagacctcttatattaccaatgaattactgaggcctagaaaggtcaaatgaattaattgcttgaggtcacctagctagcatgtggcaagtctgagactaaagcctctgtcttttgactcttggtctgtgcttttcctgtacttttttgctcctgtgcacaattaccatgtagcatgcgcatagaaacacagattagaaatacacagaagataatcacataacttagaaatgagttttgaaaaggtgtagccggactccttatctaaaattaatctaactgaaattgtattttagattaactttgctacttgaaaaatgctaagtggctgcctgagagcaatgaaatttcttcctctaatgtgctcctcagggcaggtagcccttatcattgttttccaaaccactagccattaacatttgtggggtgcctgtgga

SEQ ID NO: 221793 - DNA, 521 bp, Homo sapiens
ggaattataaaaatcactcaatccaaaataaggcagaagaagtggaaaagggagatgaagatcagatggaacaaagagaaaacaccgagaagacagacttaaatctaaccatattaattatgacattaagtgtaaatggacttgtggtaggtaggctgaataatgagccccccatgatggccatgtcctaattcccagaaattgtgaattacgttactcacatggaaaaaggaaatttacaaatgtgattaaattaatgctcatgagatgtggatattatccttattatccaggtaggacaaatgtaatcacaaagtctttataaggaggaggcaaaagagtaagagatcaaaaaggcgatgtgatggtagaagcagaagttggagtgatataaggccacaagccaaggaaggaggccagcttctagggctggaaaaggcaaggaagtggattttcttctagagcctcctgaaggattggagccctgccaataccgtgattttagacttatgagctccaga

SEQ ID NO: 221794 - DNA, 414 bp, Homo sapiens
agtgcaaacaataactgcacggctgcatgtggaaatctacatatggacaggaccatcattttcactgcagtccaggaagaagagagccactcactcatttcatccttatgcagcaaattgttgttgttgttgttgtttcctcccattaaggctattatatgacactgacagatgcttaaaagcatttagacctgaaagaactgttgggaaaattgctgcaaaaggattgacaaatgatgatctttctgtccgcaaggttcttatttcctgtgcaaaatggaccaaaagaataaaagaaaggagaaagattcattaatgtgggaacttggtattgttttctgacatgagtttatactttttattgcattggggccaaaacgtgactctgtttatgaaaggctgcagtattcttaa

SEQ ID NO: 221795 - DNA, 441 bp, Homo sapiens
gagtcaaagtccaaactatatgcagccttcattccttcagcaagtatttactgagcatttactatatgtagggcatttctgaagctctgaagttcatggctggatccagggttggatgctgcaaacctttggctggacactgagctaagtaatgcatgtggaacaatcccattggctgcttgtggaaactgagtgagggcagggctagttcctctcatttggggcagcctgagagaggtatcctgacccatgcagtagaaatagaggctagatccccctgtgcagagcaaaagcaccaagcactgaggttggaggagacttctgtcctcatgtagcttatgttggatatagtgtggggacacaggaaatgaacacaaacaagtaaacaatatacttcaaaatggttataaaggctgtaaattaaatgtaacatggaaatga

SEQ ID NO: 221796 - DNA, 305 bp, Homo sapiens
gtttggagaggaaggaggacttcccaggtttggtggtcaaagcctgggcagctggtgtagctgtggcatcttgtgtaagtgtgggccggctgctgagtcagcatgtcacactagacctccagacagccctgccaggggagtcaactgaggctcaggggtgacacagctggtttgcagtcgcacatgggagccagaatgagtgtggaccagccctgctcacaggccaaagtggggcccatgggggtgggcctgttgctgggaccccctccccaggaggtgtgacccttccccatctctgcccagac

SEQ ID NO: 221797 - DNA, 443 bp, Homo sapiens
cacgtaggtgaaccggtcctggctttcttagaagattccctgctgcataaaaccaaatcccgttgcactttcctgggttccttggctttgtcctttgtcatttccaggatggagcagaggcactggtaatttggcttttacttgcctggtacctctggcatggagtggctaaacggtggcaccatgtactagttgctgccatcttcagataaaatattgaatcaatatgacaaaagtcagatgaatactagctgccaattaccctgcttcccttgggggcagcctgtttggagcatagaccagctttgacctgcaagaactctggatatttggaatatttaaaattccaaatacagtatcccaggaattcaggtcagctgaaggccgattgggaagggcttaccttaaatgaatcagaaagaaaaaggtgtgggtgtgtgcta

SEQ ID NO: 221798 - DNA, 329 bp, Homo sapiens
gaataatcattctttttaaattcttaataattagaccagaattgagctgaggcttatatctttaacatctatggcaaaagaagctgtttaagcaaatatctattataaataagcatatgtattatattaaggttataacaggccatattaatcctacttgtgagaactaaatttttaaatacttttatagtgattagtggttatttgcacataaaaggatttaggcttttaaaaaatgagtcatgtatttattaaagcataactaactcaatttcttcatcaatgcttcgttgtattcttctaatgttgtttcctttaatgatgtacta

SEQ ID NO: 221799 - DNA, 272 bp, Homo sapiens
taatacttctctcaatgtatcttctcagctttcttcattagcttatctcttttttctttaagcatttatatttttagatttctggacctgactctctgtttaactatgtttctcttttttttgaaatggagtctcactctgttgcctaggctggagtgcagtggcactgtctcagcctcctgggttcaagcaattctcctgcctcagcctcctgagtagctgggattacaggcgcctgccaccatgcctggctaatttttgtatttttagta

SEQ ID NO: 221800 - DNA, 348 bp, Homo sapiens
actacttcttgtcctcttctgcatatattcagcaagtgtctctgcagtgcctgcaacacgctgggcactgtgctggtacagtgatcaataaagacaagaaggtccctgggcagacacagtccagtgggggaggcagacaataacaagtaaacaatgaactaccagtggtcatgagttttatagcagaaatgaagatggtgtagtgattgaatacggggaggcaggggtggctttgataagcctcttctagggacagcatatgcagaggtggaaaaacatacatattcaagacaaaggaagccagggtagctggagccccaagaataagagaatggtgaagatggagtt

SEQ ID NO: 221801 - DNA, 200 bp, Homo sapiens
atgactagctctaaatgcttacatactatgtggaacaaagagtggcaattgtagaaaagtgactaggaagagaggggttagtttaagaaggtctgtttgtacagatttctttcagccttaactcccctcctcttgtgatgagactatttctcttctcctggtatagggaaggtatgggagtttcaactcctgctttatga

SEQ ID NO: 221802 - DNA, 515 bp, Homo sapiens
gacttcaggcagctgagaaatatttgtcacaccctgtggacatggctctgctagctctctttctggtaggagaacagggttttcaaggtggagagcgtgcgtgaagggtttgtttatggaaatccaaaggttcagttcatgaagttggccaggggcccccttctcatctctttctggaaactcttcctactcccaggagccccttctcttccaagaacctcccagaacctggatttcattaaataccaaggaggtaaaacactttttaatcatctgtaagatttgaactcaggcccacatctgtggttgtcaaaatgtggccccagtaccaatgataggtgcctgagagtgtgtcagaaatgcaaaagcagaccaagcgcattggctcacacccatgatcccagcactttgggtagccacggcaggaagactgcttgagcccagaagttcaaggctgcagggagcgatgattgcaccactgccctccagcctaggtgacagagacagacaatgtc

SEQ ID NO: 221803 - DNA, 616 bp, Homo sapiens
acttgctctccagctatacctattcccatttcacagggtgactcattgccttcctccatcttcaccaagatggctccttcttgaagaaaaccaggccatttcagtatgcctaccctcactgagaatatgtaaggaggaaagaacaggtctctgcctgagggatggggactgagttaggatgagctgggacttctctgcacacaaatggaagtttaaactgagatggccctctgctgaaggggagtgcaaatcagacagccaaggagagtgcttgagtatttcacaaagtcttcaaagcgctgcttccctaaatattaaaatatttcactacaaaaagatggggtgggaaccatttgataaagtaagatttggtcacaccggttaaaggaatagctagtaaacacttctgctgacctcaggtgatccacctgccttggcctctcaaggtgctggtaaatacttctcaaacccatttgaccacagagttaaggagcattctttcatagagcatctccttctttcatagagcatttcccaaaatatagaatgtatttttggaaaaactagattaaggtcattagaaaaattacaaagaattttttttttttgagtcaga

SEQ ID NO: 221804 - DNA, 338 bp, Homo sapiens
caagaggaagacagcttgccctctaggagctcttaccagaagcattgggctgtggtggtataggtacagggaagacataggaggaaggaagtaagttccccgaccttgaaagagtcagggaaaactaaaggaaagaagaaatcgttgagacagaccctaagatttattggctaagtaaattgggataatatagctaacatgtattgaatgtttattatatacccaatattttgctaagcacttttaattatcccattaattcctctcatccctatgtggtagatgcatgtatcattgtaaaaatgagtaaactgaaacttaaatctgtatctatcttc

SEQ ID NO: 221805 - DNA, 285 bp, Homo sapiens
tggcatgggaagtttttcctgtttaaagtagacaccagaaacatctaggaatgttgcagaacagttgaggattactcaaatgaggtatttccaccctggctcactgataaatcacccctcagaatatagtcatactgcttattgaggagttcttatgacccaggccctgggctctacatacattatttaatctcatcactggttgagagaaaaattgaagctggtaaatggtggaacaaaattcaaactcatagctgtctgaaaagtacatgcttttcccctgta

SEQ ID NO: 221806 - DNA, 422 bp, Homo sapiens
ctcccgggtagctgggactacaggtgtgtgctaccatgccccgctaacttttaaaatttattttgtaggatgggctctcattatgttgcccaacctggtctccaactcctggcctcaagtgatcctcccacctcagcctcccaaagtgttggaattacaggtgtgagccactgcacctggcctcttacctaacttatttggtaatgaaacctgatctgattggacatgaagctctttatacttgttatttaccccatttgatgtaaatagttacacattttatggcagaaatattgtgtttgattatagggctgccttagacccagctgagggtgtcatgtcccacatgggaatctcaaaatattctcaactttgaaacacatctgcctgtaacgatttcaagtaaggaactgtggatgtgt

SEQ ID NO: 221807 - DNA, 268 bp, Homo sapiens
ttcattgagagagggtcctgtgaaaccatggatatggggcataactcagttaaggagtgtagttggagaagctgatgcttaagcttaagagaactggagccagttttaagagaactggatccagcatagtggtgcatgcttgtaatctcagctactaaggaggctgaggcaggaggatcacttgaacccaggagtttgaggctgcaacgggctgcagttgtgccactgtactccagcctaggagacagaacaagaccctgtctcaaga

SEQ ID NO: 221808 - DNA, 435 bp, Homo sapiens
acacaaacgcacacacgtacataattgattttccacatggattcaaaagagtaaagcctgcataaagaagacagtatagacccaaagcaagtggactctacttttaaaatctcagatgacactaagcaggtttgatttttctttctcttttcctcacttaataatattctagggcagacagaataagaccttcttgcctagtgtctgtttctctgtctgttgtctgccctcagacactaactcaggtcatagcagaagatgaagttggccatctccttgggttgcaggtcgagtttggtgcatcccagagccctcccgccatcccactggatggtggccatggagagacagaggagcagagggagagacaaaggaacagggatggaaggacctgcattggtcactagtaacttagcaacccatgggccaatatga

SEQ ID NO: 221809 - DNA, 343 bp, Homo sapiens
aggtgaccttgattgaattaaagaggtaatgactgaagcttttttctgtagaactaggttgcaatttttgcaaatgataaactatatgttgatttaattttctctttcttttttctttctttcttttctttctttcttagtaattgaaagtcattgggttcttggactttgaaataggaaataaaatttaaaatggactttttgacccttctacgtaacacttaggctcctaaggaatattgtaattgatgctggatcatcagtgtcatgttaacaaagcactttagatgaaactacccatagtcccttccctctcatgttcaataaaaagctagtaacaaga

SEQ ID NO: 221810 - DNA, 559 bp, Homo sapiens
gttctgaggattaagtgtgaaagctcctagtctggaccacccttaagaggagcttaaagaagggtggcaacaggccaggcatggtggctcatacctgtaatcccagtactttgggaggctgagatgggtggatcacctgaggtcaggagttcaagaccagcctggccaacatggtgaaaccctgtctctactaaaaataccaaaattaattggccaaagttgggggtgcctgtaatcccagctacttgggaggctgaggcaggagaatcgcttgaatccaggaggcggaggttgcagtgagccgagatgatgccactgcactccagcctgggtgacagagcaagactccgtccgggaaaaaaaaaaaaggcaaggttagcaagtgtccgggaggtgttaatgacctaggctagcaccaacttgagactcgatgaaattaaaacaactgaaaacaaattagaaagagaataacttctactaggtgattctgctgcgttgaatgctggaggggtacatttcatgtaagttgcctgcatcatcgacaattctctcacgtact

SEQ ID NO: 221811 - DNA, 218 bp, Homo sapiens
gacacacaccccctttctcctcgcctcttctcggagggtggaagagacaaaaacggggggtcagttctccagtccgccggctgccggcacgcggggcggcgctccgtccggcccccgaggaccagcggcgtggcggctgcgctcggacccggtccgccggccggaggagcgcgcggcgcccgcggtcgcgcccgcaccgcaggccccttcagagagtc

SEQ ID NO: 221812 - DNA, 495 bp, Homo sapiens
gcacgagattcactgcaaaaattatgataatagaagtcattatattttgaacctctatgtgccaggtatcatgttaagcactttatatgtattatctcctttaatccttaccgtaattttataaagtagttactattgtcatcatcgctgttttatgaaggaagaaactatggcttaaagagattaagcaggccaggcacagtggctcaagcctgtaatcccagccctttgggaggttgaggtgggaggatcgcttgaagcaaggagttcaagaccagcctgggcaacatagcaagactctgtctctacctccctcccccacttaaaaaaaattagctaggcatggtggtacacacctgtaggcctagctacccaggaggctgagacgggaaggatcacttgagcccagaaatttgaggctgcagtgatctataatcatgccactgtactctagcttgagtaacagagccagaccctgtctgtttaaaaaaaaaa

SEQ ID NO: 221813 - DNA, 396 bp, Homo sapiens
ccgaggccgcctcgcccgccgcgcgcgccggtccggcagcgcacgggttaaggctggcaccgcgcccggcgggagggggggcgcccacctcccctcctccccgcgccgggcatgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccg

SEQ ID NO: 221814 - DNA, 393 bp, Homo sapiens
ggattacaggtgtaagccactgtgtcaggccattgttttgagaaagacctattcaggttttttgcccattttaaaatcaggttatttgtttttttgccattgagttgtttcttaattcttaaaatattaataagatgtgagcaaacagtttaaatttcagaaaactaaatatctttgaaggtcactgtactagtctgttctcatgctgctgataaagacatatctgagactgggcaatttacaaaaggaagaggtttaactggactcagagttccacgtggctggggaggcctcacaatcatggtggaaggcgaggaggagcaattcacatcttatgtggatggcaacaggcaaagagagagagcttgagcaggggacctcctctttttaaaa

SEQ ID NO: 221815 - DNA, 465 bp, Homo sapiens
tggtttgttgcatctaaactccaaaagggagcgagtagaatgaagcacgtctgacccctactttccatatagcctggactagttttttaggtttctttggaatcccgttgtctgagaagggggcccattcaattacttagggggctaggaattttctttgtggttgacgttcataaccttaatggcggcttaaactctctgacccttactttctatgaaataatgtaaaatctcacaggtaagatactgtagatgaagtcacctaggacatagtagttatttgataaattttcttttccttctttcatcccctgaaaatgaaccaaacctcacaccctttcctctctttactcacaacccaaacataagaaatgaatgtgaaggttcataaagagcacatatcacttttagaaaagataaactcaatatttttagtaccacttataaacaataaatttttattca

SEQ ID NO: 221816 - DNA, 374 bp, Homo sapiens
tgtatccatttcgctcactaaactatagcttgaaaagcaagatgagtgttaaaacgtatgtgttgaatgaaggaatgatgaatgaatgaatatatgaatgaatgagcgaatcatttttgaatagtcctgccagtgatgaagtcaaggaaacaagctcagggaatgcgatgggcgctgagactgatgataacttgctatgtgttcttttttctgcccttcctcctttcatttcagggtttcaaagccagaggagataaaagaaatttgttccccttgcaaagatgaaaatcagatttgccctggttttggttaatcgaagtattgatacgtttttccttatttaattttattttttaattacctccagttccatc

SEQ ID NO: 221817 - DNA, 579 bp, Homo sapiens
tcatttctgggagctggtctgagagtctgccttggagatgtgttggatgggaactaggggtttgtaggctccattgtgagcaatactgatgggaaatgaccccaactggtatggatattttgcataaagcccctgaaatctgacatgctcagggtcagagccatgaaccactgtcttgacaaaccccatgtacatggactaataaggaaggtgtgggcaccatggcgttagtgttcaactggagagtgggaaagagatttgcatgtgccaccagccctgatagagacagtgacagaacacactgattctcaacattgcagacacctgctgtctttgtccctatgtaggtttcccccaatatttaggggatcaggtcagataaaggccttcctctgaaatggaaattatttaaaatcgatgaggaagtcatccaggaatgacttcctctggggatctgtggatgatggtgctagggtttgtaccagaccaaatcaaggtaactagagcctccccaggtgattgtaacccatctcctaaataaaacttgcatcgactcggttgcattacaatttgattttc

SEQ ID NO: 221818 - DNA, 557 bp, Homo sapiens
tttctcaagaaaagaggctgcaggggcagaaaactggaaacatgaagctgtatatgtatagaattccagggcaagtaaaatgtaaatgagtgatgaaacaacatcactcctcacaacccgggtgatttgcaaagtcaccagggaatttcaggacacctggattacaaaaccatagcaagacttggagtccgcattagcatagtgaagtggaagctgccagctcagttaagggctatgcctagaactggcatagcaccacttctcccatgttctcgtggtcaaaggagttacaaggcccacccagatgaaaagggatggagaaatagattctacctctggatggggactggcaaagtcacattgaagagcatgtggaatgggaattgtgttgtatggtagccattttggaaaatacaatctactgcaacagatgattaaaatacttaaaaagaaattttagtgtgttatcgtctttaaacattgtacaaatttaaggtgtataatgtgatgttttgatgtatattttattaaagtgattactagtcaagcaaaaaaac

SEQ ID NO: 221819 - DNA, 445 bp, Homo sapiens
gcggaaatgatgacctattttccccatatgcaaaagtgggtaacatgagaagttaaagtgtgtgctggatttattgattcactgctaaagaatggaatgcagcagacagaaaattcaactacgtttttgtgggctgttctatgaagaggcccaccttgcaaacaactgaagggaactccattccaacaggagtgactaagatcctccattcaacaatctgcaaagatgttaagtcctgccgacaaacatatgtgagagcttataaatggatatttccctagctgatacttctgatgagactgcaatactgtttgacagctcggctgcaactttgtgagagaccttgagccagaaatatgccactttgccaaggctggatttctgacttacagaaattgtgagataataaatgtgtgtcactttaagcagttaagttttgcggtaa

SEQ ID NO: 221820 - DNA, 406 bp, Homo sapiens
ccacagccagacaaaataaacaaggaacaacatttacttaatcccacagatttggccaagttttatccgataagaaggtggttggtgctaagatacaaaatagattcttgggactctagctgcatagtacaaatatccttttccttcacaatgtctctagaacataacgatgatgagtgtaacaaattttaaaggatgcaaatgcaataggaaaaaaaaattcctatctgaggcttttacatgtaagaagtgccaaagttaataatgacacagtccccatactaaaagcctcggagatgatcctcaaatattatttctcaaacagtctcacaaatattactgggacagttcgcaaagcactaaagaacgtcacaactatgataagaaagaattagtcaatactgtc

SEQ ID NO: 221821 - DNA, 375 bp, Homo sapiens
gtagagacagggtctcgttttgttgcccagcctaatcttgaactcctgggctcaggcaatccaactgccccagcctcccaaagtgctgggattacagttcaacaatgttcttcagaaatgtttctttatttcactttgccatttttggggagctaactttgtgctgttcatttttcaaccacatatacctattctgtctacactggaaacaacatgattcaacttattcatttaacaaaaaaattttttagcaactactatgtaagcaggcatgttctgaatactaaaaacaccatggtaaacaaaacaaaatcccctcctcatggagcttacattctagtaaaatatgtcaggtagtgatatttgctgtaagag

SEQ ID NO: 221822 - DNA, 215 bp, Homo sapiens
cagtgattgcctagggatggagttaaataaagattgggatagattaaggagggtggaaggaaactttagggagtaatgaaaacgttattttgattgtgacggtggtgtcacaagtgtaaacagatgtcaaaattaaataaattgtatactttgactgtacaatgtagttcattatatatcaattatcctataactcatgaaaaaagaaaagctgt

SEQ ID NO: 221823 - DNA, 990 bp, Homo sapiens
gatcttgatatgttggccaggttggtcttgaactcttggcctcaagcagtcctcccacttcagcttcccaaagtgctacgattacaggtgtgagccaccactgcagaccattggaaggtttttacgcagagaagtcacgtgacctggcatagcttagctcagtggtggctttggaactccaggctggagtgcagtggcacgatcatggcccactgcagcctcaacttccaaggctcaagcaatcctcccacctcagcctcccaagtagttggtactacaggtacgtgccaccatgcccggctaatttttgcatttcttagtttttttgtagagatgagggtctcatgtttcccgggctgctcttgaactcctggctcaagcaatccacccacctcagcctcccaaagtgctgggattacaggggtgagtcattgctcctaacttttcgttacactagaaaattgtagaagacaccaaagagcctctgtttatgtggattgtggctattgatattcaccaccatagaaatgaaaacaaaagttttaattcattgaaaaataatgaaaattctcaggtcaatggtaaaaataatgataataaaaccatttcatgttaacaaaaactttttttgttttatgaaaaatggcaatttaccaagacataatttagtgagaagaatggcttttaagaaaaaccggtttttcagaggtcttctgtgtttggcttaatagaggacagcttgattcccatatttgcttttgcattcaaactgttgggatatgaaatttttgtcgaagtatgaaaaaatccacttctcataaatatttagtataggagcaatatttaactttttcaaatagatgtacatatacttctttgatattatactaaaacccaacaagtggtagtttcttaaaggttagttacaacatggaatctgaaactggtttaatgaactttttattctgttccattaaaattcattcatgt

SEQ ID NO: 221824 - DNA, 567 bp, Homo sapiens
acattctataattaactggcctgtaatctttaagagtcaaggtcatgaaggtcaaagacagtatgaggaactgtttcagaaggaaactaaagagatacattaactaaatgcaatacagttattccccggtatccatggggggtgggggtgcagggatggtttcaggatccaccctcccaacaccaaaatccagggatgctcaaataccttatataaaatgatgtggaatttgtatacaaccgatgcacatcttcctgtataaattatctccagattacagtcacgtgttgcatatgttctgagaaatgcatcattaagtgatttcatcattgtgtgaacatcatagggtgtgtttacaacaaatctggatgatacagcctacaacatatctaggttatatatggtatagcctattgctcctaggctataaacccatacaagcatgttactgtactgaatactgtaggcaattataacacaatggtatttgtgtatttaaacatagaaagggtacagtaaaaatatggtattataattttatagaaccaccattgtatatgtggtcta

SEQ ID NO: 221825 - DNA, 471 bp, Homo sapiens
aacatgtacaccaccaaaattgaccctaatgtaaactgtggaatttgggtaataatgacacatgtcagtgtaggtctttcgactgtaacaaatgcacccctctggtggggatgctgacagttggggcggccgtgtgtatgtggtggcgggcgggacggcatatgtgaaatctctgcaccttctgctcagttttgctgtgaaactcaaactgctctaaaaagtatagtcaattaaaaaattgttatagattacagaatgaaatttagcaagtttcaagaagagaatgtgtaacatctcattttttaggaaaaaaatatattcataggaaaagatctggaagaacatacactaacctgtcaatagtggttattcctaagaaggatgaaagaggagtttattgggcaactgtgttctttacaatgagcatttaattactcagttttctgaataaaaaattaaggacgaagactt

SEQ ID NO: 221826 - DNA, 397 bp, Homo sapiens
cttgggggttttctccctctccttccctacattttttccccattcccctctggtttgcatcctctccagtctgtgtcccactcctgacaggaatctcaaggtcattctgacccgccatttttaaaccagtctactctcgattacctagattccaacattgtttttccccaaagctagaatattaggtggcatcacactgctgttctatttcagagttggaaaatttccactctaatgtcatgaatatttgcacaatactgggtatattgggtgcagaagccctttgtgtttaggcctctttatcctgcttcacagggagttagaactgggttagtcaatcgaagtcctgtccctgaaatgggagatgttattttcctacacctatctttactggatc

SEQ ID NO: 221827 - DNA, 297 bp, Homo sapiens
cttggtgactaccgattaattgatttgaatatatcaatgtctggcagttggaccaattactcagcttcccaatctgatggtgtggttgatagaaatgtttcctggtggcattttcccacaggattaggatggtggtggcattagccaggatctcttttgtcactgccactgttactgaatgatctgtattttgaactttcttgacttagtatagtattatacatccagcccttaccctaaatgcttattatttaatattgacaacttacaggttaatgttttaaatctttttttttt

SEQ ID NO: 221828 - DNA, 641 bp, Homo sapiens
cggcactgtgggggatttttttaaatgtaaataaccagcaggcttatatataatgcagcaagtgtgaaaagcatcacaggtctaataataatgtatgtagatgtcagtaaagtatacttttgcttctagtgcttcacttgcctcatgatatccatcaagcttttgagaagaaagtacaggatctgttaggttcttaacctagcagtttaccagatgcattccttgatcagcctgcatgtgtcaaaccactgagtaccacatgtgtccacaaagacacctctgagaggggcaggcgctgacaagatcctggagtcagaggctgggctgggctgttgcctgattgactatgcgaccctggatgtgcccatccccatgtgctttgaattcatcatggatcacatgagggagtccacagagtatgccagatcctttttggcatctttccccaagtctaaatttctttagtgtcattcatttttctgattttgtaattgttttgagtctattattgccttatttttctgattttaaagcaatataagctcattgtcaaaattttgtaaaatccagaaaagtatgataaagggaatcagcatgctgagccctactattcagcagcaaccaccaataacattttgaga

SEQ ID NO: 221829 - DNA, 478 bp, Homo sapiens
tgctagtttggttactgtagctctgtagtatcatttgaagtcaggtaatatgattcttccagttttgttctttttgcttgggatagctttggctattctgggtcttttgtaattccatataaattttaggattattttttctatttctgtgaaagaatgtcattaatactttgacagggattgcattgaatctgtagattgctttgggcaatatggatattttaacagtattgattcttctaacccatgtacattgaatattttttcagttttttgtgtcctcttcagtttctttcatcagtgtttcatcagtatattgatgtatgtgtgtgtgtgtgcatacctcacatgtatgtttatatacttcaattaaaaaatacacatagataacttgatgaatttttacatttttttgtaggggacaaataaataatagcattttattcttatgccatttgaccatagcatttgtgttctg

SEQ ID NO: 221830 - DNA, 389 bp, Homo sapiens
acctcaaattgtaatagtccctatgtgccaagggcagggccaggtggagattactgaatcatgtgtgtggtctcctccatactgttctcatgatagtaaatgagtctcacgagatctgatggttttataaatgagagttcccctgcacaagctcttttgcctgacaccatgtaacacaaccctttgctcttcctttgtcttctgccatgattgtaaggcctccccagccctgtggaactgtgaggccactaaactctctttcataaattacccagtctcaggtatatctttattagcagtgtgagaacagactactatacctgccttaaaaggcctgcaagtttgtgtaccatctaaattcatatgttggaactttaacccccaatcgg

SEQ ID NO: 221831 - DNA, 625 bp, Homo sapiens
gggatggtcagtacattggagtactttgaagagggctgaagttacacatatttatggctcattttgacttgattgctctaaagtggctgatatattacaaaattctccttttcagtaactgtccagttttataattagagatgggtaaaatagggaaaaaaaatcttcctagtcccatcatgttcagctgaggaaacaaaagcaccgagaaataaaatgacctgcctaagtgagttagtgacagagttagaattagaacctaggtctttggctccaaatctgtccatgccattttttggtgttcttgtgggaaacctatgcctaggagaaacaaattgcaattacttttgaaaaattaatatttgaaaaataatatttcatttttaaagccattttaacttttagggaggaggctacatcttatttaagagagcttaacttaaacttcatttctaggtttaattttactttgcttttaaatcctcaattgtctaataaagctttcttaagtagttaagtagtttttataatttcacataaattaggtgacttttgcatttattttaaatattcaagaacctttacaaacttagcaaaattctcttaaacctttaaacttaaaata

SEQ ID NO: 221832 - DNA, 387 bp, Homo sapiens
gctataggcctttgagcaaatcaatgtttttttgtcccatagtttatcaaaagacagctccaaatttgttcattcctttaaaatatgtatttctttttgcaagatgaaaaagttctgggccaggtgctatggctcatgcctgtaattccagcactttggtaggctgaggcaggaggatcaggagtttgagaccaggctgagcaacatggcaagactcttgtctcttcaaaaaaatttaaaaattagcagggtgtggtggcatgcacctgtagtaccagctactccaactccaaaggctgaggcaggcaggaggatcacttgaggccaggaggtcaaggctgcagtgagctattccagcctggatgacagtgtgagaccctggctcga

SEQ ID NO: 221833 - DNA, 456 bp, Homo sapiens
ataaataaaaataaataaaatttaaaaaatatagtatgtacatttgcatatcctattccattgaatattatctaaacttgcctatatttcttaactcagaagttacatgcatcctccttaacaagtgggtgagctagataaatctcagggggattaaaaaagattcaattacttatcttttggggtgaattgatgaataagaaactgtaatagcaaccctctggacctactaggcatctgtaattggtaggcttttccgacattttttccttcacagacttagcaaccgaagcacaaggtggattaaataaatgactaaataaaagagaaacagaaatatcatatcctggctccagatccatgattgtcagtagtgtgttacagtgtttttaccagtaacagttagcattgccttgattataagcaaacaaaagtagattctatttagcttaagca

SEQ ID NO: 221834 - DNA, 515 bp, Homo sapiens
aggaaattaagagtttgactagcaggctggatgtggtggctcgccaggactttgggaggccaaagcaagtggatcacctgaggtcaggagttcaagaccagcctggccaacatggtgaaaccccatctctactaaaaatacaaaaatcagctgggcgtgagtatatggcccttggtgacagaaggccaggagggtacatgcagagatttcagcagcagccacagcaagggtggaaggtggccaacagcttgaagcacagccgacagcttgcttcctttgccaagcctgcacaggagcccctcaccaggggatccaggtcacacctcctgggaagaggggaggagagagaggagagagtcctaactgagctgaacataaaccctgaattgatcatgcttaacacgaagtgtctgagcatctgagtctcctggaattggcaaagttttccttcagcaatagaagcagaggctcatgaaccacatctagttatagaaaaataaattgtgttctgcata

SEQ ID NO: 221835 - DNA, 395 bp, Homo sapiens
ggagctgtatgttttgagatagcgataatctactagtggcccagggctgtgctgttcaataaagtagcccactagccacatatggctatttaaattatctaaaataggccgggtgcagtggctcatgcctgtaatcccaacactttgggaggctgaggcagatggatcacctgaggtcaggagtttgagaccagcctggccaacatggtgaaacctcgtctctagtaaacacacaaaaattagccgggcgtggtggcggctacctgtaattccagctacttgggaggctaaggcagcagaatcgcttgaatccgggaggcagaggttgcagtgagccaagatcctgccactgtactccagcctgggtgacagagtgagtctccgtctcaaaaaaa

SEQ ID NO: 221836 - DNA, 525 bp, Homo sapiens
gcacgaggcaaagatgtaattcatgttgtttataatagtcataagctaaaaacataaaataataatacaagaaaaactggttaaataatcgactacatccacggtgtgatactatgcaaccagtagaaatgataaacatacataaaatggcatttgatatttcatttcagtgaaattgatgttataaaatagaataatatggccccattattataagtttagttacatttacagatgtatacaaaaaagtctagaaggatattcatgaaaatattaacggtgattagctctggatgttgggattacaaattatatacttaatatattgtaattacatgtattttaattttttactataagcattttacttttataatcataaaaagaaagaaaatattttttttcataaaggacaacacatagtatttcctgaaagaaggagcagtagtatttagctacaaattaaagctttcatagcaaatgacataaaaactggtatacatatatacagtaccatagaattca

SEQ ID NO: 221837 - DNA, 384 bp, Homo sapiens
gtcaactttgctgatattttgcttaaaaataacactttggccactacaatttgtatttttgtttctatctctagggaatatatgaaaagcttgaaactgttacatagcaatatgatagaagtgccttctgaattacacagttaatgtgccttgagaaatattttaattgctaatagtcaaaaattttagtttatttttctttataccagaattatattatcctgaatattgatttggaaataaatggactgtcatttgaaaccttgccattcccattgctagagacctgtgatttttaaaagctttcaccgaagctttttcttcctcagctgctctaatttgtgaagggtccgtttgaaatgagggtataggggcaggccatga

SEQ ID NO: 221838 - DNA, 302 bp, Homo sapiens
cctcatcagagagacctcctctgactaccctgttaaaaatcacccttccccaccatccctctccatcccctctctgctcttttcttcctagccaagcattactttctagctcagcgatgccacttgatgtgatgtcctgtatccacttttgtgttatttgtcatcttcgttagagtcaactcctcgagggtgaagacttaagttcactgtgtgttgcttctacctgtttataatagtgttgagtgttcggttgatgctcagtagacacttgcagaataaacaaaaagagaaccaaaaccaca

SEQ ID NO: 221839 - DNA, 321 bp, Homo sapiens
aaagaacgtggctgcagggcgatcttgcccttaagatctgtgaaactttgaacttgagggtgataatttagtgcatatctggtggaatgaacttctaggcaccatagcacaagagggatcctgtctgcatcaaacagcctgtgctcttatgtgtgactgaggaaatgacctcaagttggaatttctatttaaatggcaagcagagctcaaaagtttggaacatttgcagcctggccaagtggtcaaagagaaaagctgattttcagggggaaaattcatgaagcctccagaaatttgcataaaatggaggccagtgctaat

SEQ ID NO: 221840 - DNA, 771 bp, Homo sapiens
gtgtgttcagagtgtaattgaatagataattcacttgaaaaaaatacaccaaagttttttcagtagtgtttcagtttgacaataaaaaaaagtacattgtgggatatttatagtatttttgaatctatttttaccagtagactgggagtgataactgatttggggcataggggttaaaaacaggaaatgtggtttatacagtaggtagtatctccagagtttccagggttgatttcttatagtattgtctgaagagtgttatgcgtcaaaacaacattaggccgagtaccttgaaatccgcctgtgtttaaaggagccgtctttccaattacaacaggaaatgcttcatggaaaagtttgcattcttggtataggttaagatggcatagcagttgtttattgtaattacaacacgttcttcctctccagcacttttcagacactttttatacagtcagagtaaatcttgtgtcacttctagtaaatttccttcaattttcgtattaaaattttattttattttcatgaaaagttttgtcaaatagctgttaagaatgttttaaaatagactatcatagctgaggaggagcatatattagggatactgttaattacagtaatcagagaatccaagttaagaggataaaaaggcatgaagaaataggagtataattctgtgtggccttttgcatgataggttggcagaatccatgaaaactgaatagcttgattacctttgcactcagcaattccacttctgggaagatatct

SEQ ID NO: 221841 - DNA, 350 bp, Homo sapiens
ctcctagctagctgtgtgcactggggcgtgctctcacctctggagttctgcctcctggcagcaaaccaagagagtgccacacagactatgcaacctccgggtccacttttgttcccatgttctatgacttggggacctccaccctgctctactcatttgcacaaacatgtattcactatgggggtcctatccctgaataggccattccttctactcgttggtgcccgagagttcctccctatggaaacacaatcaaagacgacacttaaaaacacagatccctgcgagagagggcatttgctgtccccatgccctctggcagacaaatgaatttcttgagagctgactta

SEQ ID NO: 221842 - DNA, 431 bp, Homo sapiens
atggaatattcaacaactttggatagaaaaaaaatttgtttgttaagattgctctttttccactaaaaaattatggaatatttattataaaatgtacaaaggcagagaagatagtgtaatgaatacctatcacccacatacgtatcacccagcaaattgatggaaccaaatctgatgttgatagggcccaggaaagcatctgagggtgaacttgacctttgaggagaaaagtgcctggtgcaggtggtccctgggcaccctcccttccagcctgcagctcagaggggtactcttgctgatggagatgaccacagatgcccagtgctaatctgggggtaaattgagcctggcaccttcagtacagaatgcttattgttccttgcatttaaaggggctctttccaggattcctgggtgatggtgcatgattct

SEQ ID NO: 221843 - DNA, 325 bp, Homo sapiens
gggctccgggcccgaggagcgctgcgcctgtggggtgtgcaggcgaagtgtgggtgtccgcgcccatttcctcccctcccccagcgccgcacgttttatttacatgtttatctcactgcagcggcacattcacttttatagcctgtgctttcaagtatatttatacacctctgcgcagacacaccaaatctcctgggacgcgcacacgcgcgtggattacagacccccctccccctcgcagaaagctcagatttccatgcgggttgggaaggctaggaaaagatgtggggattcggttgggcaccgaagttcgccggccctttcc

SEQ ID NO: 221844 - DNA, 305 bp, Homo sapiens
cagcctcccgaatagctgagacctcaggcgtgttccaccgtccccagctaacttttgtattttttggtagaggtggggtttcactatgttgctgaggctggcattaaactcctgacctcaagagatccacctgccttggcctcccaatgtgctgggattagaggcatgagccaccacgtcctgccctaaacagacgttttaattacgcttgtcaagtcctcttgtgaaatattcatctgcagtgacttggtaaatgtgtttgctaccacacaggataaacagtgtacagacaaacatttgacata

SEQ ID NO: 221845 - DNA, 547 bp, Homo sapiens
aggtgctggtggctgggacagctgagacaggagagggcagttactattttccagtctctgcctccaagggcatctactgtactgtcagttgactactggatgcagctgaaatctgtctcctcaagtttagtttattcaggctattaaaacagtcttaaaactccaattggctgggtgcggaggctcactttgagaggccaaggcaggcagatcacttaagcccaggagcttgagaccagcctggccaacatggtgaaaccctgtctctactaaaaacagaaaaattagccaggcatggtgacacaacgcctgtaatcccaggtacttgggcagaggttgcagtgagccaagattgcgccactgcactccagcctgggtgacagagcaagactctgccttttaaaaagacacacacatgcacacacatttgtaaaacgaagacaataattagtacccacttcctagggtcgtttggaggattaaaagagttaatatatacataataaatcttttaagacagttcctggtcatttaaagacttagcatt

SEQ ID NO: 221846 - DNA, 500 bp, Homo sapiens
ctcgcatgtgcagctcacaatagggttcgggctcctatgacagactaatgcctctgctgatctgacaggaagcatatctctggcgataatgcccgctggctcgcccgccagccgctcacctcctgctgtgcggactggttccttacaggccatggaccgggggttggggacccctgccatagagtactgttgaatagaaactttagctcgtccggcggtgggctgggggggtgggggtagctcatgcctgtaaccccaccactttgggaagccaaggcaggcagattgcttgagcctaggaacttaagcccagcctgggtaacatagcaaaaccccgcctctacaaaaaatacaaaaattagtcgggcgtggtggtacatgtttgcagtcccagctactcggaaggctgaaatgagaggatcgcctgagcccagagaggtcgaggccacagtgagctgtgattttaccagcctggatgtcagagtgagaccctgtctccg

SEQ ID NO: 221847 - DNA, 357 bp, Homo sapiens
gaggctttaacttggaagacaacataacacctgctaataaggaatctgtgtaagtagaacagaaggtagatttgcacagagttcctgaagaggatattgaatatttgcttgggttgtcccccatggattaataaaggaagtcttgctagaattagaagaacaaaagcaactggaagagggtcctagcagtcaatccgggccttgggcacaactaacagtaaagtgactgccataggcttttgaccatattttagcagcaattactatttttgaaggtgatctaaatgtggattgctgttcgtggtggcaagtctaaagatgaaaaatgtgtctgcataccaagaaatcctcagtgat

SEQ ID NO: 221848 - DNA, 332 bp, Homo sapiens
gagagtacgaccaaggaattggctacagtcatgtgtttgagaatcaaatctgtggatcttaatgtgcacctggtgaaataaaggaaactataacgttaaagaagaaagacatttcctaggaattcaactataatctgagataagaagatcattccttttgccaaataccccagggcatttgtcattttttcagtgacttttatttccatttagagtgagaggatcctgcatagaaacatgaagtctgctttaatgtggaacctgaaattcacttgtccacttattgttatttccacctccttaatttcttattaaaacccattttttcttcc

SEQ ID NO: 221849 - DNA, 107 bp, Homo sapiens
cttcatggctaacagctctttagtttcattcatgtcagctaagtggccactcttagctctgagccaatcactattctttgtttccctggcccttctgtcgtcttctc

SEQ ID NO: 221850 - DNA, 591 bp, Homo sapiens
agatgacagaaggaagcgattggccctggaatgactgggctccaggtccccacctccctcatacagccttggtctgggaagcccaggcttgatgcgtatgcagaaggaaggcagcatacattctagacagaacgatctagtaactatggggctgtcatttggggaggtggatcaatgtccttataaaaaatgctacagactattctctggggcccacaggacgggaccatagacttaataaacaaaatggggacggtgtacagagatccacaagtagaaattttctcaaggtgctttttttttttttttttttgagacggagtcttgctctttcacccaggctggagtgcagtgaccttgtcaaaaaaagaaagaaaagaaatggggccaggcgcagtggctcacgcctgtaatcccagcactttgagaggccaaggcaggcggatcacctgagattgggagttcaagaccagcctgaccaacatggagaaaccccgtctctactaaaaatacaaaaaaaattagccgggtatggtggcgcatgcctgtaatctcagctacttgggaggctgaggcaggagaatcgcttga

SEQ ID NO: 221851 - DNA, 528 bp, Homo sapiens
aatttggtcaatttataagatttatcaaaagatgtttcaaattaaactttggttcaatctgctatgttcaaaggaactggtggcctatgaatattttccaatggctatttcttttacaatatataatggattttaataagatatggctcatgaaaagagttcagagagaagactgcactgagagaaataagagtttagaatatcatttaaaaagtattcacttaagaggattggtaaaaaaataaaaaaataaaaaaatgtatttctggacaaagttgacaaagtaagattttgaaagtaaagttttcaatgcaagtgaaaagaaaatacggcaaccataaataaagactaaattcaggcctctttaaaagccaggccttctgtaaatcattacctcaattttagcaaaagtctcattagagattaatttattggcaatgggtatatgcatgtttgggcccattgttgcattttgttcattagcttataggtggcaacattattattccatcttcatttgtgggtggt

SEQ ID NO: 221852 - DNA, 298 bp, Homo sapiens
gggcacagctaggcagtctgctggagcaccacatgaggcctctccagcatggagttttctcaatgctgcatgctgcccccacagcaagcaacccaagaaaaccggtgaaagctacatggcctttccttttctagtgctgagaagcctcagagtaacttcttccccattcttctggttacaagagaatcaggagccagtcccacgtcaaggggagggaaggtagacaccacctctgatgggaagcatgtcaaagacactgtggctaatttttaaaataaagcaatgttgaaactacact

SEQ ID NO: 221853 - DNA, 285 bp, Homo sapiens
gattctctaggcagacacaattgcgatgtgagagttttctctctcctacagctttgcttgtttgtctccctcgtatttgtaaagcagtaaaataccaacctgtaagattattgtttagtaaacataagcaaatccagacatttattccctactattgctatatttagaaatgatcattaatccatatcagagaactctcacaaatatatgttatttttgcattccttagcgtttaataaatatcatggggaaacattaagaagtatgttatccttttgaggagac

SEQ ID NO: 221854 - DNA, 817 bp, Homo sapiens
tcaagacatttacattttgtagttaaatatccttgatatgtgttgccaaaatgtttccaaaagagttgcccctgactgatatgccaccctcagcccaggtttgagagggctggtgttacggtctacaccagcttatggtaacaccaataaagccagtctcatgatctgaaagagaaataatggtatttcaaaattataattgatacgattattaacgaaacgcaaatgttcatacttattaagccgtttaaaactttcttggttgattatctgttttctttgcctgttttcctaacaaggttttgatggatttatttaaaaatcatttgatgagctctctgtatgttgtcattttgatatctgttgcatatatgtgttgcttaatttttgcttttggaggctttgaatgtaccaaagctttatattattatattgtcaaagctattagcttttctttttgtgacattgtttgttagaaagtccttcctgggaaatggctttttaaatgggtcaagagcttgccttttcctcctttggggctctctatttttggtaaattctaaacaaacatccttttcccaaataccattttcccgggaacatctggaatgcgcttgcttttatttcttcctccccagaggacggtgtattggggtgggaagaggctgtcacactgagatgatctctgggtggagaaactggacggggaagccctgagcttcagaaacagccccttccccagcttcaaggtggctgtgctctgttgtgaaagatgtctgatctttcccgccaaaaaaataaaaacattgtccaaaaa

SEQ ID NO: 221855 - DNA, 454 bp, Homo sapiens
ttttagaagattatggtttaaggtataatttcattcaaagttttgtaacacttagctagtgataagctagaaggaaatttgcattttaaagaagtttcagaatttgaaattttgagctaggaaaatcctcagtatagaggaataatgactgcaacaaatttgaactctgaggaatttcttgacaaatatatactgacatccagattaccttctaatgcttccgtcaggtttgtaagaggtgtgagtgaagaaaggtgctaatttgtaaagggtgaatgatcagataaatggagtatcagaaggaaaacaatgtccactgcttatgtccaatatgaactccagcatcttactctgtatccataaaataatgaaaccaattttccttcatggcctgtcaatcagtcttaaccgctttatagtcctacctcaaacataatgataaatctttagatac

SEQ ID NO: 221856 - DNA, 264 bp, Homo sapiens
aaccttttattttcttccaaataaatttaagatgatctgaatcattatttttctcaccatctatttatgacttaactaaagctactgtatataaaatattgtgccagtattgatgggagacatcagttttcttttgtgctaaccacttttttgttaatttttattatgggaatttttaatcatatgcaaaaataggtggaacagtatctggcgaactcctattttcttattatcctgttttgataattatctacagtcgtgctg

SEQ ID NO: 221857 - DNA, 755 bp, Homo sapiens
aagagctggtgagcctggggtttcccacgggcggggctgggtgtgatctgtaccatagccgggaggtcttgtcaggcatagaggaatgaattgcaacccaaagccctattctggatttgatgcaaatgagattttcctttgtttgctgtttttttcttttcttttttgagacagagtcttgctctgttgccctggctggggtgcggtggtgcgacagtggctcacttcggccttcgcctcccaggttcaagcgattctcctgcctcagcctcccgagtagctgggattacaggtgcccgccaccacgccctgctaattttcatatctttgttagagacagatttcaccatgttggccaagctggtcttgaacccctgacctcaagtatccttctgtctcagcttcccaaagtgctgggattacaggggtgagccactgtgcccagctgtttttttagaataagagtgctttgtccttcatttaaattcttgcctttgcctgacttccatttctcccctggagttcgttctaggacctattatcaaagttcagacggaataggaaaatgcggcatttaggtttacttctgtaatcaagcttatgatcttgttcccagtggttttgtactgaaatagcagagcggctgtcctgagggggaggggagaggacgcagggaggaaggcagctgttgacctgcttcgtctttgggccccagagcagaggctgtggcgaagggagcgcgagagggagaaagg

SEQ ID NO: 221858 - DNA, 643 bp, Homo sapiens
cagcagcatagatattaccgtcccaaactggaaacagcccaaacatctacagcagagtatgtacaaaatgagatataatcatacaatggaatcctaatctgcaatgaaaaagaacgaaccactgccacatacacaacacatgagaatgcaacatgttgaactgaagaaaccagacacaaaagaatatatactgtgaaatttccatttataaaaagttcaaacacaggcaaaatgaatctatgctgttatggtaatacagtgggtacctctggggatgaggaagaaccagatggtggttatacaagtgtgttcacttactacagtgacatcttatggctaaatctcaaaaatataggcagtatgtaaagtaaattcatagaaacacaaagtagaatgtgattgccaggcactggggaaggaaaaaaagggaatttgtttaatgagtatagtctcatttttgtaagatgtaaaagttctagagatctgattcacaacaatattcaatattcaatatttaaaacaattgaattgtacacttaaaaatgtttaagatgggccaggtgcagtggctgaggcctataatcccaggactttgggaagctgaggcaggaggatcactagaggccaggggttggagaccagc

SEQ ID NO: 221859 - DNA, 507 bp, Homo sapiens
tccagtgtctgaaatgaaaaataacctagatggatttaacatttggctgattttggataaaattacaaaagcaattcaatgaagaatagatagtctcaacaaatggtagtggtaccattgaatatccatatttaaaaaactaaactttgttgatatatatgcctcacaccatgtgtaaaaattaactgaaaatggatcataggcttatgtttatagtttcttccaaaactattacacttttggaagaaaacagaaaaacatgttttgtgactggattaggcagatactattttagatacaacaccaaacacactattcctaaaagaacaaattgataaactggacttaaattacaagattttgttcttcaaaagattcttaagtgaatatatgcacaggcaacagactcagaagaaatatttgcaaatcatatatatgataagggacttgcatctaaaatatataaagaactcttacaactgagtgttaagaaagcaaacaacctag

SEQ ID NO: 221860 - DNA, 543 bp, Homo sapiens
ggaatgtcagtcagcaagagggaccatgcaggctatttagccatgtctgtatagtctgatgttacatttatgttcctcccaaggacaatgcaacatatgtgtggaacttgtttggaaacctgctcttttggacaaagaaatatccatgactcagccccctaaaactcttccagaattttgacattctaaaaatgcatcttgtcctccatgtggaattttgtccttcctaaattcattcactaagtaatctttcattgtgcctactatattctaggtacttttattaagtgtttagtattcaaaaataaataagaccccatccctggcctttacagatgcaaaaagcagtgctcatctccagtggtcttttttttaagtcctatgattaaattttaaaaaaatatatgacatacatacatacaacaaaaagtttgttaaagataacacagagaccaatatatttttttttttgaaatggagtctgggtgacagagtgagaccctatctcaaaaaccaaacaaaaaacctgaaaacaattttaaa

SEQ ID NO: 221861 - DNA, 475 bp, Homo sapiens
acccccgcttaccccatgtttcccaaatgaggaatccaaggccaagaagaagggaaaggatttacccaagggcattcctcaaccacagaagggaatccagggatttgggattctctggactagaggaattaaccgggactgggctagagcctgggcaagacacctaagaaatccaacccccaagtccagcctaagtatccaagtccctgtcccagcagcccaatggggagcccacctggacaggaggtaggcctctccagaccacaccagagaggtggtcccactcctacttcaagactccaggatggagaaaagccactgcctcctccaagatgctctggccactgagagtggaatccagcccatagctgaggaagaccagaggaatggttgctgctgaagacagaccaagtggccagaggtgctctcaatggagaaggaactctagccaggagaataggttgaggaggagcag

SEQ ID NO: 221862 - DNA, 431 bp, Homo sapiens
cgtttcccagataaggtgtgtcctctcatccctgctgcatttgcccagacctcctttcctggaagtgtcttcttcttctttgcttatataaatattctatttatcccccaaggcccagcttaactgtgacttcctcagtgaaatattttctaaaaccctaattacaagaaatgtgtttttctgctcaactcccataacaaactgcataaagctttattttctcctgctttgaattatggttcatttttgtgttttcagactattagtagctggtagctgggtcatgacttttgcacctttttatctttccagggaacctagcacagttctaggtaatcaactcacatcaggcaaaaagataaaaggaaacaggtaaactaccatgaagaggaaagagcaggaaccaattctgcaggtggggacagcgagta

SEQ ID NO: 221863 - DNA, 353 bp, Homo sapiens
tgtctgatcttgatgaaggctgataacatgtcactcactggaagaaaatttaaatttatcaataaagataatataaactcatatgccattgaaataagacattgaagacaaactggttaatgagtgtggccaattcaaagagaacttaagatttatcactgtccaagaaaacttgaaatgcctttaaatcttacagccaatatacaaaaaaaatttgatagaggctttaccaaatttgacgataatcctaaaaatatacatggcattacttgtaatggattatagctaaataatgaagctaaaagaaacttttctaaatgatcaataataaaaacaaatttaaatcaattatg

SEQ ID NO: 221864 - DNA, 1034 bp, Homo sapiens
atgctaggtggctgaaatggagatgactaaggtcagaaaattgttttgctgcccagaaaaatggagcatctttatagaagcaccagtgagccatcatagaataaaaatgaattaaatacttttctcatcattctactagctctctgaagcttcaagtgtttgtgctaggtatcattaaaagaaaaatcagtgttcatagcagctttatccacagtagccaaaaggaagaggtaacccaaatgtccattgacatgagtggctaaacaaaatgtgtgatcgaatatccttttatttatttatgtttttattagttttttagagacaaagtctcgctctgttgcccaggctggaatgcagtggtatgatcatagataacttcagccttgaacttctggcttcaagcaatcctcccacctcagcttttcaaggtgctaggattatgggcatgagccatcacacttggccttgtttcctttttaagcatgagtaaaattacatgtttatttgtttgttttgttttgttttgttttttgttttttttttgagatggagtttccctctgtcacccaggatagaatgcagcagtgtgatcttggctcactgcaacctccgtctcccaggttcaagcaattctcctgcctcagcctccccagtagctgggattacaggcgtgcatcaccacacctggctaatttttgtatttttagtagagaaggggtttcgtcatgttggccaggctggtcttgaactcctgacctcaagtgatccacccgccttggcctcccagtgttgggattacaggcgttgagcttccacgcctggctagattccatgttcttgagcatagctttgagctagtttttcttggattttctgccttagtcgtgactatatagctcacagtgctttgagagcaagctgtttccctgagacgagtgaaaccgttttgccaattgccagaattgcaggtgggtttctactagaagacacttgagagaaagccctctccgggtcactagacgagtctgacacag

SEQ ID NO: 221865 - DNA, 649 bp, Homo sapiens
aacaagtcaggagtcttggagcagctcatctggatggtgtggctcagggcctctcgtgagactgtggtcaagttgacagttggggctgtcgtcatttggaggctgaatggactaacggatccactttcaacacggctcctgcacctagttgctggcaggaggcctcagttcctactgtgtggacctccacttggagctgcctgagtgtcttcatgacacactctctctcggatcagaaaggagacattagtaatgccaaggatactcctttactcccttcacaagtgggcacagatatggtcctttttccaccagctctagaaagaaacatgcagagatgtttgaaggcaagaagacagtggcctgcatgacttggagcttttcttaattgtaagtcagagataataattaatgtcatgcctagttcagagaattattgtgtgactcaaatgagatgatgagcattaagacattggaaactttaggtactatatgaatgttttcttattggggcaaaccattttcctcttgtaaaggtgagcccagggacatgtctctcccccatctctatactatcagttctgatctttgaatgattgcagtgcccctcatagggttgggtaaggaccaaggcagagaatatgtagat

SEQ ID NO: 221866 - DNA, 455 bp, Homo sapiens
gacttaggtaaaagaaagcaaaaaggtcttcagttgccacgttagagccattgccatacgcttgctttgcagttagcacttggggctgcagcattcctgatacagtgaaggagaacaaaacgggcttttctgtggaagcctcttctcttcatttatgtggtagatttagagcttcaaagaccccacagcacaggccctttttcatgtagatgaggattctgaagggaagtgcctgaccggataccctctggttctgctttgtgtggccatgttttctagctttctgcaccataccatctgctgccctgggtcagatcacaaaaaatgaatccaggtcctgtgtgccaattgtttttgatttgtagtcttcctcttttgttttctgtaaggtaagagtgtctcttagttggcaggcagtcagcgttcttgagaggttgtttgacagtcactttatc

SEQ ID NO: 221867 - DNA, 416 bp, Homo sapiens
gggtgtgataagagcacccactctcagagggaatctgtgagaactgtacaggaaaatacaataatgctcagaatggtgcctgacatgcagttagtactccaaatgtttgctattcttataaacccctgcatgatcttccaaaggtttcaccgatcactgtgacctgagtcaccacaagctctctgtggttagagcagtgagaattggagcccacctgagaagtattcagtatgtcagttatctaatgtggcagaaaaaatgacccccaaaacttagaggtttaaacaaacaaacatttatgatctcacagtttctatgggtcagaaacccaggagtggccacaccctggctcagggagtcttacaaggctacagtcggcgtgtcagccggggctgcagatgtctctgtttgactag

SEQ ID NO: 221868 - DNA, 299 bp, Homo sapiens
taatcagtacaaatgccagaccctaaaatggggggctgcagaccagtaacggtcctctgggaatctttttggtcattcccgtttttaaaatttcatccgatcacttttatttaagtatcttttcagctattctccttgcaaatggtaagatctggttctgcaagttgcaaagaacccattacaggcaatttaggcacagtttggagatgcaatgacttctcttgccatgctacactgccgactctgggcctaatgacctggctacccatcaggatacctgtgcatgcctgaatgatcac

SEQ ID NO: 221869 - DNA, 1177 bp, Homo sapiens
atccatttgtcaacagacactttgattctttcgtatcttgagactaatgtgaatatgctgcagtgaacatggggtgaagatctgtcttcaagatggtgattttctttcctttgaacatatacccagaagtgggattgctgggtcatatggtagctctatttttaattttttgaggaacctacatactgttttccataatggctgtaccagtttacattcccaccaacagtgtgcaagagttcccatttctgtgcatccttgttctcactttttaaaagagaaactacccttctatggccttactgaacagtgaccatgttttgaaccacttgattcctgtctcccgtctctccctcttgccacatctggaatgagacataatccaaagatgaccaacctgtgggcttaccaacaacctgtggcttgatttgcaaagtttaactcagtcagttttaagtactatgcatgttgtctagattgaaattccgacttagccacttgctagttgtgtaaccttaagcaggttacccaaagttcactatgcctcagtttccttctctgtaatattagatcctatataatgtggttttgagaattaaaaatagttaagtccttagaacagtatctggctcatactcaaagcttcataaatggtagccattattattattctggtaggaatttggaattaagaaactgaataactaaaagagttactagtagaaactaaaggtagagtgtcatgagatagaacagtggtttttattcctttttggggtcattgctttcctgaagcatctgatgaaagtatggacattccctgcagaaaagttcataagtatatataaacaataaaatcaaggttgaaagcacctgatgcagagaatgatggagaggaggccacagcaagtcagagccatgtgcaagtcagccttgagaaggagcagaaactgccaccaaagcagagggaactgttgagtaaacggaggggaatggactgaatgaaaaggcagaagcagaagctgggagatagcccttcagttccggtccagtgatttctaccccagaattcctgtgagatctctgtttatctcctcacagccaacttccctgcttataaccaagctagcatagcctcccttcttgcaatcacactatccagaccgaaaaaaaaaaa

SEQ ID NO: 221870 - DNA, 439 bp, Homo sapiens
  misc_feature (15)..(16): n is a, c, g, or t
  misc_feature (88)..(88): n is a, c, g, or t
  misc_feature (90)..(90): n is a, c, g, or t
cataggggtgcaggnntacagagttgattcctagagtctagaagcttcctcgggagaaaacaaaaaaacgaacaaggaaacgtttttngnggggcgcacaacaattttcctcctttggtgggatattttatatacagacttttacttaatccccaccctcagctgtgtgcagtgttctcagatatagtcctctggtcaacctctgcagaagggaaacctctagcctgctgaaagttgtaactgttaaaggcttgtaactgattctcctattttagccccaccagcccctctacctttagatgtacatgaacattcccaaaattctaccaagggaatcggcctttgcattacaattggtaaaatgttgttgccctttgacctctgttgtctgctgtcatctttacctagcctactttttaggtatatatacccgctaaaa

SEQ ID NO: 221871 - DNA, 788 bp, Homo sapiens
ctgtgtggttgcatttggagattaaaggtctctaaggaagtaatgagggctaaatgaagtcataagggtgtgccctgatctgacaggattagtgtccttataagaagagacaccagagagctttcactcccctccccgctctctctgcactacacctaccaagaaaaggccatgtgagcacacagcaagaagacagtcatctgcaacccaaaggtaaagccctccaggaacctggcaccttgataatgaatttctaccctccaagaacgtaaaaaaaaaaaaaaaaaaactcctgttgtttaagcatatagtgctttactgtggaaacctgggaagactaatacactgcccttccttctttttccagtatgatcattagggtctgggagggtaagggtctgagtaaatgcagttattgagtatagagccaatgctattatcataattttatattactgtgagcaataacaacaacaacaacaacaaaacagggctaccctttggtggcaagtatcttatatgtatatcagcattcaggctcactaacaaagccagatgaggcgctttctcagcagatgcagcactacaggtgtctgattctagcctggcaaattttcattttcataactaaaattacagggagaaaatgtgaaatggtaacaaagaaactaaacttatattgccttgttcaaggttttcatttaacgaaaatgtgctctgcacataccagaaaattatacgtgtaaaaagaaacacttgaattcatctgtaaaatgcaattctaaatg

SEQ ID NO: 221872 - DNA, 834 bp, Homo sapiens
tgatatgaaactctgacgttgttgtgattacattgtattttttcatatctgttatgtgatatagcaaccaacatattagttataataataattaggtaatgagttcacacagttattggatggagtgctgtgtccatccctaggtgtttgttattgtagtgatacttataagaagtacagcttggtgtacctacattagcgcaaatttcactagtcaggaaaatgtggataaagtggtccctttgattcattagccctatacgaagtattttgaaaaaaatattttaacagatttgtatcctctttccatatctcatataaactgtaattatttttaattcccccaaatgaatgaaagccatctttaccattcgattctttaaaaaaaaaataagaattagtatttatcgattacaggtcctgtgcactttacatactttctttaatttagtcttacaacaatgctatgtaaaaagtactttttgaaaaaatgaaataaaatttatgtaccataacatttatcactttagtgttcagttcagtggtttttagtatattcacaagattacgaagctatcggtactaattccagaacattttcatcatcccaaaaagcagctccatactcactagcagtcactacccattcctccttctgccagctattagaaaacgctgatctattttctgcttctgtggattggcatattgtggaaatttcatataaataggctcataaaaggctggatggggtggctcatgcctgtaatcccagcactttgggaggccacggtgagcagatcacttgaggtcagaaattcaagaccaggctgg

SEQ ID NO: 221873 - DNA, 401 bp, Homo sapiens
attcatctcagcggtcaaaaccggacttagctagtctccaaatttgcctactttaggaacattaggaagttatttaacctatttgggctttgtttgtgtcgtcgtttggttttgtcttaaaattgtggtaaaatacacataaaatttaccattcttaagtgtacatttctgtagcatgaagtacattcagtattgtgcatcagccatcaccaccaagccatttctggagctcttttcgtcttgcaaaacaaactctgtccccatgaaaaactgattccccatttctccctcccaccagcccctggcatccaccattctactttctgtctctatgaatttgacaactcatgtgacctcatataataagctttgtttaagggtaaaataaaatttaatagttg

SEQ ID NO: 221874 - DNA, 224 bp, Homo sapiens
taattggatatcataattgaaaaactgcagttaggctggcaaactaatcacataaaaagtaaattttttaccctcaatattttcaatagtcacttctcaattatgagaaaacattgtttgttagaagcatattctaagttgatgttttcagtataattttggattcctgtgaatgacaatattatatataataattattaataaatatttaattacaataaata

SEQ ID NO: 221875 - DNA, 508 bp, Homo sapiens
aaaaaagaacagatctttggtacttaggtcatgccagaattgcttcagatccctcagtgactgaggggacacttgaagcagttggcgaacgaggcaggggacaaaaaggacgtggtccttagagaagcctgtacctcctgcctctgactttgtcccactgtaattggagcaaattttcacggcaggtgctttttcattccttgagaatccaggagcagaagttctgaatgaataggaaagtgagggattggatgagactcagaatcataccattaaggcatttattagacttagtaacagaggcaaggagaatccacaacagttaacagaataaatagaagttgctttggggctgggcgcggtggctcacacctgtaatcccagaactttgggaggccgaggcgggcggatcataagttcaagagatcaagatcatcctggccaacatggtgaaaccccgtctctactaaaaatacaaaaattagctgggcatggtggcatgtgcctg

SEQ ID NO: 221876 - DNA, 390 bp, Homo sapiens
gacttatagatggtcaaggagatgtatcttctcatcatgtttcctctgtaggtgtgtgtgttccaaatttcctctaaggacatcagccatattagattagatcacatcctcattaccttattttaacttcattacttctgtgaagacctttctccaaatatgatcacattctgaggaactggagtttacttcatgtagggattttatatttttgtagataaattcagtccataacaatgagtctcatgtccataaaagaaaaatcctttgcttttgtgagatgcatgtacatctctaatttttgtaacacacataagcagatatatacctatagtttaagtgaaatgatgtacatatttaataattttggccttctgtcttcatatttct

SEQ ID NO: 221877 - DNA, 500 bp, Homo sapiens
acggcacagcaggatttaggccagacttccccaactcctgggcaggccctgtcatctgtaccatgccccaattccatggctctgcgtgatgtgacaggaccctcagctcactgtttgcccctgctggaggcatcacaccttctgccagtggctgttaagagctgacctgtatatcacaagcccatttccattatctgctcactttttgttccctgcatcaaaatagttgactctgtaaggatatctctcaaactagcagattcttctttaaaggaaatcagaaatcccagctgtttaacttttttctaatttcctttatgaggcaccattttgcttccttcctaaaaaattaataatgtatattctggattcatttttcctttctcttgccttcatccttgtacagtgtgttcctaatacagacatttttctgaaagtatgaaaaagatttatggacacattaacattttaacgttctgcaataaaatctagtatcaatt

SEQ ID NO: 221878 - DNA, 326 bp, Homo sapiens
ggtatcacacaagagaagttctctcatttatttaaaaaaatggaaaatggtaaaagatgtctaatgtcttgtatggaccttgtatgagataacttactcttttattcccatattttctataaattttttagctttacccctcaaacatgggagaaaaagtttcagcattttaattcaaattggtaaaaggctgagcaacccttaaagctgccataatggaagaagactgtgagctagcttaaaaaagagagaatgaaggggaagaaacaaaacccctgtgtggcagagtgtcgagatgagatgagcatttatttgtctccgtcgaa

SEQ ID NO: 221879 - DNA, 725 bp, Homo sapiens
tacattaaagggaacaataataaatagttttatgaggatctatacttagctacaaaaattccagatgacaaagaggcatcaaatgcccacttccaagaagaatgttatttacagagctgaactatatacatttaaaaaataaaccattgctactgccctgtaatcaggagacttgataataaccttcatgtttattctctgctgttcacctatctttttggggctgttttctaagaataagtctacacctttaattgctttgtcacacatgcagtgctgaatgttttgtttagttcttttaattaaatgcttatatatgtgcctggaagagaaccattgagttgctgcactttgaaccatctgttacctcatagcacaggttattacataaaaacaagttctagaatttgtgatgtttagagacctcagtgtccctcctattcagcttgttcaagttacattattagctgtacaaaatcccagattggcttgtattttaaactggaactggaggtggtatatagttgacaaaactgcctgagaaattcaagctgttcacatcatatgagttatctgcccataaaggagtccaatcatattgttattgctaaaaggattagtaactttttttgttttgttttgttttggccacattacctgtagcacatctgggaacaatttgcatgaaaacaattgatgcccatgtcccaagaccaggaattaat

SEQ ID NO: 221880 - DNA, 265 bp, Homo sapiens
tagaccaactgaacagaaaactcagaaataaagccacacatctgcaaccatctcatcttcaacaagggagataaaaacaagcaattggaaaagaattccccattcgataaatggtggtggaataactgaatagccatatgcagaagattgaagctggacccctacttttcaccagatacaaaaattgactcaagtgaattaaagattgaaaagtacctcaagctacaaaaattctagaagacaacctagcaaatatttttcccaa

SEQ ID NO: 221881 - DNA, 474 bp, Homo sapiens
cctgtgctaagaccatcgcacaatatctgaacttccatttccatgtgaaagaaaataaaattgcaagtgtgaaggcagatggtgcttgcaggattggcaggcaccctcacgggtggccgggtggcacgcgatagccatgtgtgcgccatttctctcctctcgccggttccaggctggcacacagccggcttcttctctccatggttggccaagttccctccctccaaatcgaggctccaagaaatctcatggctgtctcagtagatcaagatccccttcaccacaatcggccaggcataatgtaacaggaaagtgtgagggagagacgagttccccccaagaatccagcagccttgctggaatgcaggccctgctgaaagctgttgctgatcaagtgttaaaagggtgtagcatttggcctatgtatattttgtcacattccttttgtaataaggaagggggtaaaggccaaga

SEQ ID NO: 221882 - DNA, 776 bp, Homo sapiens
aagtctaagaactctttgcctcaggtcttaaatattttttcctgtttcttccagaagttttataagttttatctcttatatttaggtctatgatctgttttgatttaatttttgtgtgtggtgtgaggttaggatctaagttcacttttttgcatgtgaatatccaattgtctcagcaccatttgttgaaaggacagttatttctccattgtcaaaaattagttaaccataaatgtgcaggtttgtttctgatcctcagttctgttctattgctctatgtgtctgccttataccagtgtcatgccctccttattagggtagttttacagtaagttctgccattggagagtatacatcctctaactttgttgttctttttccaaattgttttcactgttgtaagtcctttgcattttcatataatttttgagattggtgtgtctacatctaccattattaagatttcataatgattgagtgcttagtatttaaacattgcatttaaactgcttcatttttgactgggtgtggtggttcttgcctggaatcccagcactttgggaggccaaggcaggtggatcacttgaggtcaggagttcgaggccagcctggccaacatggtgaaaccccgtcactactaaaaatacaaaaattaaccaggcatggtggcatgtgcctgtaatcccagctgcttgggaggctgaggcaggagaatctcctgaacctgggaggcagaggttgcaaagctgaggttgcattactgcactccagcctgt

SEQ ID NO: 221883 - DNA, 466 bp, Homo sapiens
agtggcagcaactggccaaaggagatgcagccagctaagactgtccacactttggcagacaaccggttttcccttttctgggtctgttcaaaaagcaaacattaagggtgggcacataatccacaagccagaaagttgtgcacggctccagtgttgagatgggtagggccaagatgaccagtgtgaaaactctcagatagaaaggagccatgcatattaaatgaggggcaacaaacatttcaaacgattagataacattttctcccaactcaaagatcccaacaatgaataggaggcatggaagtagatgtgccaatggggagggatgaggagtgaacatgaatattatttgaatagactttacctcttaattcttgcaacatgcattcttgattacctactgtgtgccaaacaagattttgtagaatattgcaaaaatgaccataaattcctcgtgataatgtga

SEQ ID NO: 221884 - DNA, 646 bp, Homo sapiens
  misc_feature (434)..(434): n is a, c, g, or t
  misc_feature (506)..(507): n is a, c, g, or t
  misc_feature (530)..(530): n is a, c, g, or t
  misc_feature (550)..(551): n is a, c, g, or t
  misc_feature (568)..(568): n is a, c, g, or t
  misc_feature (575)..(575): n is a, c, g, or t
  misc_feature (589)..(589): n is a, c, g, or t
  misc_feature (592)..(592): n is a, c, g, or t
  misc_feature (616)..(616): n is a, c, g, or t
gtggaaattaggaagctcatctcatcttccgacaccatagttctaagggaacgagcagaaggaacctgtctcagatctcaggggtgcttacaaatccccacaaatacctctgcttatgtcgaattagggcatccaggaacttcttaccgcttagagaacaggcctgattgccaaaataacgttcaggctctgtaaatatcagcccgctggcctcaagtaattccccccgtgtttaagaaggccaagcattaggaaacctgagcgttaagaagcctgagtgtgggccaggcacggtggctctgcctgtaattccagcgctgtgggaggccaaggcaggtggatcacaaggtcaagagatgaagaccattctggccaagatggtgaaatcccatctccctgtctacttttacatttgtatttttgtacacccccancccggcccccagcagacacacaaatcagcatgggttgttgtagggatttactttaggaaggaagatatgggnnaattggaaccaagaacacttgtntccagaagacgacttctggnncagagcagtggcaaggnatgaaancataattgcatcangtnctccaagcttcctcggagctggangagtcagacaaaaagtcgacaccgtgaatt

SEQ ID NO: 221885 - DNA, 178 bp, Homo sapiens
acatggtgctagcatttccgtgtaccaaggtgagcccaagatttggtgaggaacagccaggcttgtgcgctggctctcttgctaggaaaatggtcacagaacgttccggcaaacaggtcaagcctgtggaattctgtgcctgcattcatctacaaattaaaatataacatgactcctg

SEQ ID NO: 221886 - DNA, 307 bp, Homo sapiens
agcttcttgacatcacgttccaaatcaattacttgccctcaaaacctatctcagggtctgtttctagggaagccaccctgagatgctgaagcacagagacgttggctaagcaactcaccaagtttataaatttatgatgtgggagagcaggaattcaaccccagggagtcagctgctagggtccatggtcttatccgcactccaccagaacctttgcaaactacggccagagggcaaagtttggtttgctgcctgtttctgtctgcctgtgagttagaaatagtttgtatagtttcaaatggtcaaa

SEQ ID NO: 221887 - DNA, 396 bp, Homo sapiens
aataaagcccaattctactttttggggggcaaatgttccatctaagttaacacaaaaagaagaaatttaaaatatcgatataagcaactgcttactaaatagagtgctttatccttgtcttggcatcacttacagttattttaagcaatggcctattttctgtgtttaaatatttctaattagccagaaatttgtcatgatatttagatcattaaaagcctaattgaaacatcctttctctccaaagcctggagttttctgttcctgtttttttggtttgtttgtttttttaagcagctttattgagatacaattttcataccactacatttacccatcataaacctacagtttaaggatgataattaaacttataaagttgtccaaatatcacca

SEQ ID NO: 221888 - DNA, 179 bp, Homo sapiens
gctctccttccccattgagtttcctgaaatgttttgtcattcagaatcattccacttcaacccaacttttcttgctgagttcagaaagcaaatactaagtattcccatagacagcagcttttccatttccaccctctcctattttcagatggagcccttatttgtagcagatgtaccta

SEQ ID NO: 221889 - DNA, 409 bp, Homo sapiens
attcctccaggttgtggggaaaatggagattctaagcacgatgtccatttcacagaaagataccaatttggtggcttatttcctttctaccttcagaagtggctatccctgccacccaaacagacccttgactctcaagtggacggggtcccatttgcacagggggagaccttacagcctacgttgagtctatacttaccacttagtgagcatggtatccactcaggggcctctgtgggcatctgtctcctctgcagcatctttcctccccactgctgggtctgcacatgaccccctccttgggttaggcctctgatcagtgatgaccttggtatggtggtaatggtcagtcttggcatcaaatgagccagtttatatcatcagctattcaataaaatactaatctagg

SEQ ID NO: 221890 - DNA, 362 bp, Homo sapiens
taagtccaagtgaacagaaatggaggaggcaggaatggccatgtggggttcagccagagacaacggagatcacttaagagatgactctcaccttacccaccctgagctcaatgtcaatgcatttcctattcagattggcataaagatggtggctgataaccacttatcacctgtatgaatgaacaatgaatgagcataatcaaagtactcagggccctattctatgtaatggagttcaaatgaaaagtccaaactcccttcccaagcaattgtttagatgacttaaatgtccctacgtagtgattgttggttatttcctttgaatcagagaaccaaatgaaaaggaaaagaaaaaggataaa

SEQ ID NO: 221891 - DNA, 368 bp, Homo sapiens
ggagatgttgaatggacagtcaggtatataaatccggagttcaggaaacaggtcaggctggagatatacatataggaatcatcaacatatggatggtccttaaagtcatgaggttgtacaaaatcactatgagagtgaatgcagatttaaaaaaatagaagacatgcaaggactaatccttgggactccaaaatcaagagaccatgaagctgagaaggaatcagcagcaactaaggaggaaaggcagtacagcctggtatcccagaaggcaagtgaagggctcatcgagaaagaagggaatgaccctgtggccatctgtggcaaagtcagtcctgggggactgagaactgctcattggagtacctgaa

SEQ ID NO: 221892 - DNA, 528 bp, Homo sapiens
agacaaattctttgaaaggcataaattaccaaaactgacttataaagaaattttgaaatatcagaataggactatatcaaataaatggaacttataattaaaaaccttctcaaaacaacaacaacaaagattaaaaaactccagacaggtttactttgaaatctatcaaactttcaaggaaatagtaataccaaatctatacaaactcattcagagaacagaggaggaagacatacttcccaacttagtctatgaagtcagcattctactgataccaaaaccagacaaagacattacaaagaaagaaacctacaggccagtccagtgtctctcaggaatgaacacagatgcaaaaatgtttaacaaaatgcaatcaaattggattcaacaatatatagaaggtgggggggggattgtatccaggaatgtaacattcacttaacgttcaaaaatgagtcagtggaaaatagtgttttatctgggaactgcaaaattcataacaaaataaaatacataaacactgaataa

SEQ ID NO: 221893 - DNA, 507 bp, Homo sapiens
aagggcatttaataaaatttttcatgcattcatatttaaaaacaaaaacaatggcaatgcaaaataagctctaagtagtatttacatatttcgatttattatgcaacatttctaacatatataaagatatgaagcataatgacaaaggtccatgtacctgttatccaatttaagaaataaaacattaaaaattcagtagaaatcccttgggttctattccatgatcatgttcccccagagagagccactattctaaatttgttttttatcattttatgcatttctttaaacaatatgtagtgttgttagcacatagtgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaatttt

SEQ ID NO: 221894 - DNA, 844 bp, Homo sapiens
gcctctgcacacgctttacctgcccctcccagagagtcacagccaggccaccccctgcctctcatttttagcatagctttcggtgtccttgttctgatgccttgggttggaaacagtgtttaaatgatggggaaaatgtgagagtttgagacagtcagtgtgcagggagatgggaaggaaaaaggagtcaaatgagacctgggttgttcctctctccactgcctttagaacggggtcagcctttgcccctgccccacaaagtcgtgtaagatctggccctacccatcccaaccctgggggccactgtgctctgtgcacccctgccctgaacacacccagctcgcccggcctccagctcctgcagatgctatgctgttcctcttcctggagctccctttcccagacctcctcatctccctcagctgccagctcaaatgccgtctctccaggacgtccttctctgcagccccgcgcactccatcatcctctgtctccatggtgtttcttgaatcagaagcggtttgttttggccaggcatggaggttcacacctgtaataccagcactttgggaggctgagacaggagaatcgcttgagcccgggaattcaagaccagcctgagcaacatagtgaggcttcatctctccaattttttttttttaaatcagccaggtgtgttggtgtgcacctgtagtcccagctacttgggaggctgaggtgggaggatcacttgagcccaggaggtcgaggctacactgagctatgatcgcagcactgcactccagcctggacaacagagtgaaaccctgtcttgaaaataaaggaagagaagaaaagaaacaag

SEQ ID NO: 221895 - DNA, 831 bp, Homo sapiens
gaagaatggcattcagtgataagaactgttcatgagcctgaattccatggctgctcctgcacaaaccaccggacacagatccggggaaaggcaacaaagttgcctctactttgtgagtggctagaagttactggacatctgggagccctggtgccttgactgtaaaatggagacaacaactcctctcatggttgttatgacaaggaaatgagagatacatatcaagtgcctaacatagagctggctcctatgaaccagaacttattaagcaattgtagaaggcaagatttaaagcacagactttggagcagtccttgggttccaatcctggctgcatcgtttatcatctctgagcctcagtttccacatctgtaacaaaagctttcattttacagatgtaaaagcagtgtgtacctccaaggggtggttgtgaggattaatcaagttaatacacatggcattctcagatcagtgccttgcacggcaatttactcaataaatgttagcgattttttttcaatacatggtcattttttttttttttggtctctttttaactgctcaagaggaagactgtgaggattttaaatagcctggattctcttccttctgtcaaccatatgtcttaacatactattacgagttactcctccccaatagtagcagtattgctggttgtgaggagttaacccggccatgcctattaccttgggaaacctacagaagcctgctgaatgcaattttctatctgcaaaatggtgaggatactgggtgtttacatgactgggttcctgacatggaataggcatttaataaatactaactataatt

SEQ ID NO: 221896 - DNA, 429 bp, Homo sapiens
tgctctttggtgtccaggcccctggcgctgtctggacctgtggtctgaggtggaccaggtgcctcccctgggaaagtggggatgtcctttctgtcattcagtacctgcctcccttccgcaccacgtggggcttctagcccatgagagacgtttcaaattcatatgacccacataaggggaaattctgcccatgcagtcccacttggaattctttccagactgaacttcggggcatcaaagcttttggtgtcccggcagcctctttccttttttttattttatttattttatggatctggaagctttagaagctcactgtgcactccagcctgggcaacagagtgagaccctgtttctggaaaaaaaaataaaagcaacaacaaacaacaacagcaacaacaacaaataaagtctatgcttttaacataa

SEQ ID NO: 221897 - DNA, 455 bp, Homo sapiens
tgttgcaggtgtgcattttataagagtacacaatagattctcgaaagcattctcgctgtgctggggccgggcccaaagaggtggcacctggcatgtggcagccagtcgtctttagccctgggccaccctcatgactcggattcgtcttagctgagacaccagcacctgggaggcacagcctgggcccactccacaggactgtcctaccaggatggagacaatctcctggccctggttcttggcaggtgggtcatgttacggggactttctgtacatggacattcacgtttcagtcaggcccggcctggacgggagcaggaggggcctctggggactgggaatattcctctcgagttggctgctggctgcacaggtgttgttggtttgtgaaattcatcaagctgtgtattttctgtatgtatatgtcaacaaaagtacaaataaaataaaaaata

SEQ ID NO: 221898 - DNA, 329 bp, Homo sapiens
ctccccacatccctcctcctccctgaccccacctcccaagcctctgaccaatgcttcattgaaccactttgaaacgactttttcttttgtatcctctatgttttgaaaactgcctacagcatttactaaataataatttatctttcacccttcctaaaataaagtttgagtctacagcttccaatcagaacttcgtccattaaacactgactgagcaattactatgcccagcactgcactaggcatgagggctgtgaaggtgaacgggacctgccctggccctcccaggtgcacggcctacttgtgggggaaagtcacataaagagaga

SEQ ID NO: 221899 - DNA, 366 bp, Homo sapiens
gctgactccactcctaagcctgctcgccaaccgcagcttccctagctggtattttaatgcgaagggttgggaggcactgccttaataggaattttgttttgatttttaggtgttgaatcataaagctgaattgaaactgctttttagatgctgtcatttgggggtcaggaagcaaatggctgtgatttaatagcagcaacttctacagatcaagtagagaagggtacttcattgatgaagtacagtcttcgactcaaaattttatttttgtctgtgggtttaaaaagcggaaatatattttgctctcaaactaagtattcccacaaatactttaataaaatggaaaggatgaaaaggaggaatgct

SEQ ID NO: 221900 - DNA, 373 bp, Homo sapiens
tcccctttccactaatgttgatgttatatatacataatggcattatgaatatacagcattattctaaattaaaggttgaattacagtgtcaaatgacagagaggaggctgggcagagaagaccttagatgtctactaaaaatatcttctttgcaatgctattgtgatgaatagacagaacatatgtaaagctccagaccacagtgttgacagaatacctgctaattgttgacattattgccagaaataattttagcaatagagcactttgttcattttttttattttatggttttgggatgcgagacaatggaacatagcttggaggatttttaaataacagctcaattgcgatatgattcacatgccacaga

SEQ ID NO: 221901 - DNA, 329 bp, Homo sapiens
caaaaacttggatgatcagcataagattggctaaatacatttgtctatatctctacagtgaaaattagattttcaaagaatatctaacaacttagagaaatacttattcagttgacacttgaaccatgcaggagtcagagacactgatccccacgcagtcaaaaattttcacagaactctggacttccccaaaacattaactaatagcctaatactgactaacaccttactaatagccgagtaatacatatttttgtatgttgtgtgtgttatatgctatattcttacaataaagtaagttagagaaaagaaactgttattaagaaaat

SEQ ID NO: 221902 - DNA, 659 bp, Homo sapiens
gaggagagaaaaaggaaattctttgtcatttgtgttgtccatttacttgtgttatacctgtattaacttgttaataacctcacagaaaaggatataaaagaaaactcaaattatatgtaattctaccacttataactgctgctagcattttgtgtatttccttaaagtttgtctaaaccattttaacataaaaatccatattgagctcatgtggcagttttatatcctagttttttctccataatattgtatctaaagcatttttccaaatcattaaattcccataatatttttagggacaggctagtattttatagaaatctccaaatttaactatttttctatggttaaatatttggattgttgaacatttagattaagtttttaagtaattttataagtaatgcttgtagatgggtatttgatggcattggaggttattacctcatgatagacaagaaaggtaagatttctgggtgaaagagggtggactttttgtggcaagctcctgcaacattgttaaattgctttctataaagattgtacagttaaaattcccttaagcactgtaaacttttgcatatcaccatacctttaccagcagtgaaaattttcttttcaaaatttgtcaccttgctaaataaaaaagaagttgaggc

SEQ ID NO: 221903 - DNA, 435 bp, Homo sapiens
tcggctgttcttcctgaggaaatacaccatgttaccattgaggaagttcttcttctctctttccccgtacatttttattgtacgcagaaagacagaagaaggaagccctgaaggaagattgtgtatgaacccaggattctgttattacgtctgatgtttgtttctagttaaaaatgagaagtaatttttgggagggagacagaaatgggaaaagtttataagcgagccagtggaaaaagcacattcattatcagtgtctttctcactgagtcgtttgaagttggaaaattagcagcttctttgaagctcataagatctttcatctttgtgtatgtgagtgtgtgtgtgttaatactaagtggagattctttctcttgccacttatttggtttttctgctaataatgaaattataatgagatccctgatgggattt

SEQ ID NO: 221904 - DNA, 482 bp, Homo sapiens
tgcactcaagagagcgacgatgagaaaacccttcgtggcagacagatctcgccaggaacagacaagttgatcaagctgtaaactgtcccaatctttagtccaagtgtccttgccaagaacagctgtggagattatgggcagaagacagatgagaggagagcagtcttcacatgagtccttatcaagacccaaatatatacggcattgctgggagccgtctctgatgtgggtgaaagagagtggcacagaccaagccgaggtcctggtgcctcctttcctatcctacaaatcttgcctggagttattatgtacctgctgattttccttctcctctctatgacacaacctttctttgttgtctccttctccctctgtgacttaaaccgctctccctgcccatcttgctgccatctcacctcttccagagacttccagaggattggggtatgaaatgcacttaataaatcattgcttttttcatt

SEQ ID NO: 221905 - DNA, 356 bp, Homo sapiens
gtattttactttctgcctagtctttgggtagatgctagtgttcactgagacctagctctttggctcagcagaataatgtgcctgggggcttcagacggccctttgagggatgagggtcaccacagggaaggccagctccaaggggcccttggtgtctttgaactctcgcctttgactttcaggcttcataatgaatgcttggtcccttgactatgagtcatttagaaccacacactcattgagattttgagatggaaggactggaagtcatgtggttcaaactcatatctccggccccgttgctcagatggaaagactgagtcctgggtgagggccttctgatataggtatgagag

SEQ ID NO: 221906 - DNA, 629 bp, Homo sapiens
gaagacttactgacactttaatgtgctgacagtataggcatactgaaagttggaatttgggagaacacctctagatagacatcaagcccataaagtgaacttgacaagaaaaaaataatttaaaccatgtaggagattatgcttgcccttctgctcactgattatatgcctagaatcaacacaaaataggagattaaattttgctgctctccattgggtctcacttcccaagtgtctctcagaatgtgagcatcttactatgctgtcagattctaatatttagagccatttatttttcccatattataggccatatacacaaacctactctttctctgatatttaacaatgaaaacatgatttattccaatagtggagggaaaacgggaagtgctagacttccagagactgcatatttataatgtatatttgggcaactttagggatttccaaggttatctttgactaaatgccatttttgctttccttggatcagtatattcagacagtgaagtgaaaattcttgttacaagaaacaaaaaacaccaagatattaaacaactctagaatactggtttggggaaaccaagaattcattatcctgcatactgatgtcagctactttattt

SEQ ID NO: 221907 - DNA, 548 bp, Homo sapiens
aaaaaaaaaaaaaaaaagaaaagaaaaagaaaaaaagtgttgtagattagttgaggatatatatagggagaagttacttcaaaaatgttattttttataaaagtctttttgactgtgtttctcacccacttaaacacctccagggtagagactgtttcttatttatatatattcagtcttgtatatagaggatcctttcctcatgaatgtttatagaataaagttagacattagaaacaagaatgagccttttgcttcttgttgcctgcagggctaaggcgaagctcatggaataagtctaggatgtttgtttttatatgaactgtggtgtaatagaaagagagcaagaaagaacagcagtaagtaggacaagaattagaagctgataagttagtccttctactttagcttagcatttaaagcccatcccactattcttcagcatatgattcagttgatgtgaaactctcactggcttttcatagctctatacatttgcacatactgttctatatgcataaaaattcttttattcctttttcacctga

SEQ ID NO: 221908 - DNA, 415 bp, Homo sapiens
gtctggaagtaggaattggttgattgggggaggggagagccaatgtaaatcagagaagcaataattactaggtcaagaaatagggcaattaaaaaaataattcatggcaagtaggagtgagatatttacattctgaaattaattatggtactttttatttaaattaaaatcaggaagaaaagttcaggaaaaagaggttcagggaaattttatatatattcatctcaactacaaattagtaaagatcttatattcaacaaatgtgtcagagtccattaaagacattagaaaaccctatttcattgtaactaaactgcttgacattttaacctccaaacttttttataatcaaatgtagagattgtgtctgtcttgataagtctacatatagtatccatgctgcaagaataccaaa

SEQ ID NO: 221909 - DNA, 587 bp, Homo sapiens
gaatatcatcatatcgatgatgcttgtgccacctaacctcacaaagttgtcaagagcaagtgagataatagaaacatgctctgtgaagctgtgggctcttgggaactgtaagtaccactccttagaacatggctggcgtttacttccctgctacttgcggaggaactactgagttggtgactcatttaatcaatggggatttatggagcacctgtgtaagcccaaaataagcactgggtctcttcttcccctcttccctcctacgtcacagcctcattctgtgctgattcacccttatttctaggttctaacctattgacctcgctgttcacagcaaattaagagagaagagtttatagcggcaagaagtttttatacctgaaagctggatagtgaagaagacagaaagtttattacaaaatcggtaatgaattataaagaacaagttccttaaggtcagttagtaggttcagatagtccttcctaaaaaccgtcagtagtgcctgagaatatcagctatagcttataagtatttatctcagcgactcttagtcaccacagaacagttaaattataatcagcttagc

SEQ ID NO: 221910 - DNA, 1089 bp, Homo sapiens
actcctgagcccttgggtactagtgttccttacatcgaacaagaactggccgctgtttcagaccggaagggtgcagagatgagatgcctgttgcctcctaagagagttggacatttctattttgatttgcatttcaattgaggttgatagggagtgaccttcacgtctgaatgacctgcagatgagaacagaatagacttgattatgaagcaagaaatttttaaaggatttatctgatggaacatcaagaggattctttctttcttttaagagatatgaggtctcactctgtcatagtggcacaatcatagctcagtgcagccttgaactcctgggctccagcgatcctcctgcctcagcctcccaagcagctgggactacagatgaataccatcatgcccccagctagtaagagggttctatgtgttgattcactgggaaaccagagactagagatacctgtgaagacactttcaagaagttagaagaattacccttgaatgaagaaaggagctgactagaagtagtttattgaataacacacaaagattgtttcaaacctacaaaagataaatgtgaggaagggatttggggaatcctcctatgtcctccagtctggctatacattaggatggaacagaaatcctaccaatgtgatgaatgtggcaaagctttcagagtgcatacctcaatggccatcagaaaacctatactggagtgaaaccctgtgaatgaatgagtattataagacattcaggtagaattttccatttttatgtcagacatttttatctctagaaatcgaattttaatttttttaatatcttttgtgtctgctaaacaaattcaatccttccccttgatttttgcttatatagtcataatatcattaatatccttgtttgttgattctttgtgtcagttctaggtcagttttgaataactgatttttctcatcaatacaggttgtattttcctatttgtttacatgcctagtaataactgtatgtcagacattttccattttaccttgttggagacagaatacttttcattcctataactattctagggagtggaggatgcagt

SEQ ID NO: 221911 - DNA, 251 bp, Homo sapiens
cttacatcgaacaagaactggccgctgtttcagaccggaagggtgcagagatgaaagacaggacccagggtctcaggatgcctgttgcctcctaagagagttggacatttctattttgatttgcatttcaattgaggttgatagggagtgaccttcacgtctgaatgacctggtaggtgacttttctggtctcttcttgaacttatgcaattctcactataaataataacatgacttataaatcaccctct

SEQ ID NO: 221912 - DNA, 289 bp, Homo sapiens
ggggaagagaggcggaactcctgagcccttgggtactagtgttccttacatcgaacaagaactggccgctgtttcagaccggaagggtgcagagatgaaagacaggacccagggtctcaggatgcctgttgcctcctaagagagttggacatttctattttgatttgcatttcaattgaggttgatagggagtgaccttcacgtctgaatgacctggtaggtgacttttctggtctcttcttgaacttatgcaattctcactataaataataacatgacttataaatca

SEQ ID NO: 221913 - DNA, 388 bp, Homo sapiens
gaaactgggagggccaacatctctgcttctccctgggcccagggccgctggcggcgggcggcgggcggcgggcccttccgcggacacttgtcttccacgctctgatgcccaggcgcgctccagaactctatcggctttggcgtattatcctacatccctcccatcggttctgcacggctgccctggaggcctcttttccttcagggaagaaagggatccaaagctagcggtgaaaatagagccagcggcctggcgcggtggctcacgcctgtaatcccagaactttgggaagccgaggtgggcggatcacgaggtcaggagatcggtggctaacacggtgaaaccccgtgtctactaaaaataaaaaaaaagtagctgggtgtggtgg

SEQ ID NO: 221914 - DNA, 599 bp, Homo sapiens
  misc_feature (372)..(372): n is a, c, g, or t
cgtctagaggatccctgctgatgtactgcttcagctgcttctttcacttagcgcttcaaacttcatgaatgggttttctatctctttgatatctgtctcttagatatctatctcttagatatctttctttgtttttgtaccttcatccatccaatgtatcacctgaaggagacaatttgataccatggaacttccaggccttgtaactgtgtgaggtaaatcatacccagatagcttcagtgaggagtatatttaatttctgaaacaacaggactcttgagaagcatgggtggtccaggcctcatttggctttcagatggaaaaaaaaaaaaggtaaaattccaacagtaagaccgggtggcaccaaatggnacaattctccaggtagccatatggcggggcatcttggtctcgggggggcgcccttacagacgggaaaggcgggagtaaagggccccaagatagggatcccttaatacggtgacgcacgacggccaccgtgagaaattcctttgaagacacaatacgccataacagcgtcctccccagaaagactgctggggggggaagcctgactgggggaggtgcaaacgctggcc

SEQ ID NO: 221915 - DNA, 576 bp, Homo sapiens
ataagtgttctgaaggtacattagtttgagaactgctgtttaaagtctattgcaggacttcttatgtaagcataatcagcctcttacatactagtgtgcaatgtgaatgtctgagagggggtttacttacactgggtttctcaaatgtatttgactgtgataccattcacagagcatctatcaggggcaacgtttcatgtaataaactctggaaaatgtccaattttaaatttcagctctgccttgcattctacctgaaccataatgcctgtctaaccttagccacatccttcacccaaattctgtttgtaactcactgcaacagagagctgctcactgacttcaagctttcctacttgctattgctctaccttggagttgtctgtaaggattttcccatacaaattgagcatcccaaaatataaagacccaaaattgaaatactccaaaatctgaagcaatggcatgacattcaaaggaaatcctcaatgaagcactcagattacagattttttgattaggagagctcaaccggtgtgtattctgcaagtattccaaaatatgaaaaaaaattga

SEQ ID NO: 221916 - DNA, 440 bp, Homo sapiens
tgtccacacacttcttttacagttttactacccaaatcatttgctcttgctcatcagctttgcaaattaatattttgttaaatgcaccagggtagcttatttgaaaagaatgctaaagtaatttttttataaatgactaataaatatacctgaaatgacatttagtaagtttaaggtttcttatagtagggtaagcttgtgtttcttggtaaattgcacactttccaggatattgaaatttattaagaccaatagcagcagcattaataatgatgataataactacccattgattttgccccaaatatggggtagatgctaggtattttatcaactcttaaaataagactgtaagctatttttatccctattttaaacttcagaccttatgaacaaatccagcatctcatggatgattatgcttttacatatttgctttc

SEQ ID NO: 221917 - DNA, 165 bp, Homo sapiens
ccctgttgcttactatcttatctcctgtctgtttgctccatccattccccattagtcagctgaagatgctccctctcagttagctttctccattttggtttgtagagacctttccctttcctggatgttgaggtcatcttggcatttgacccacacattgtatgg

SEQ ID NO: 221918 - DNA, 652 bp, Homo sapiens
ccccaacataaacaaaatgacaaacacttgagatgatggatatgctaattagcctggtctgatcaccatatgtattaccacatccctatgtactcccatgagatctgcaattattatacgtcaattatttttaagattaaaattttttaaattgaaagaataaaaagtttttaaaggtggcaggtgctacatagatggataagtaatagacatgaaaaactggtagactaaaaactgttgatagtgattagatgtttttattatataatctttaaaactatttctactttttatagtcttattttcatagtaataaaagttatagtaatattataattataaaatattataatactttataatattatacagtattatagtgttattttcataatactataaaaagttaataataattccaaggctcacaatcctatattttataatttaattctacatatagtgcatatgtaggataccaacagcaatatgtagcttcagagaaagcaagagaatttttggaaaaattttgaaaccgtaacaatgacactgaaacatttcagtaatctgtaattggagatggcaggttgaacacttgtatagccaaccttctatcctaaaacagaacagtgaaataatttttataagggct

SEQ ID NO: 221919 - DNA, 242 bp, Homo sapiens
tatagaagactctctacataccaggcacagggtgtgtgtgtgtgtgtgtgtgtgtgtgtgtgtgtgtgtgtgtgataagttacaataacaaccctataaagcacaaaatagtatccttcccactttgcaaataaacaaattgagacccagagaagttaagtatctatccaaggtcacacaggtggtaagcagtggattcaggatttgagtctaggaagcctgagttggggagaggggttggg

SEQ ID NO: 221920 - DNA, 416 bp, Homo sapiens
agcaatgtgtatgcattaaccttttacaaagaaaatgcaacagcaatgtttttatttcttacattattttctgcaaactttaaaatttaacatttgtgttagttatatttgtaagattataagcttgtatttcaggcatatttttaaaaacacagggatatatgcaatatgtacgaagtcatctctggtgctttgcactttaaccaattcattcaccatttaaaaacaattaaaaaattaattaagctggattctgcccttggatacacacaacaaaacccccattgaagtcaatggaaattgtgcatgcatatccaggggcagaatttggcccgctgtgtttaattcactctgatcattcctattaattcaatattaatatttccgttcatttattcaattagttctgtggtatt

SEQ ID NO: 221921 - DNA, 926 bp, Homo sapiens
aatcaacgagaacaccctgaaagcggtggctctggctatgccgggaagggcctggggagtttccagtacaggctaggctgggaagcagctgtgagaaggagtgtgtcggtcaggactttggagtgggacctgggccgtgctgggtcttgggagttgggaacgaggagggctggctggggctgctctgtcttgggagctgggaatgaggagggctggctggggctgcctctgtcaaggggctggcaggcaagaggacgtgttgatgtttatttgcttggctgtggagtatcctgaagggtggatgggggagtgggtgatcggaacagtatgttgacttatgggtacaggagggccttgaaatgggaagagactagaagctcagaccttctggacccacggggggagttgggaggctcctgtggtgttgatgggagaagtgatgacattttgcgttagagaagataatgagagtgggaaggctgtggtgaacaaggattgcaagagtcagggaccccagaacaagaagcagggttgggggtggtgctgaggccacacatttgggagcacgcgttgggtgccctggctgagctctgcactccaggccctgggtgtgtggggtgagcagccaagccctggccattgacatcctcaggttgggagcagacactaaacaggctgctggtggtggttctctgaggaggaataaaccggttagagaggccaagtctgtagatctcttgcaggtggagactgaaaggaggtggaatgtgtggctgtctacaggtgtatgagttggttctcatgctgctataaagatgtacccgagactcagtaatttataaagaaaaggggtttaatggactcacagttccgtgtggccagggaggcctcaggaaacttacaatcatggcggaaggggaagaggc

SEQ ID NO: 221922 - DNA, 1002 bp, Homo sapiens
atgccagaatgcgacctctacgcaagactgcgacgtctatgcaagactggacctctctgaaatggaactgggatccgaggcgcgcctgaagggtcggagcggtggctctggctatgccgggaagggcctggggagtttccagtacaggctaggctgggaagcagctgtgagaaggagtgtgtcggtcaggactttggagtgggacctgggccgtgctgggtcttgggagttgggaacgaggagggctggctggggctgctctgtcttgggagctgggaatgaggagggctggctggggctgcctctgtcaaggggctggcaggcaagaggacgtgttgatgtttatttgcttggctgtggagtatcctgaagggtggatgggggagtgggtgatcggaacagtatgttgacttatgggtacaggagggccttgaaatgggaagagactagaagctcagaccttctggacccacggggggagttgggaggctcctgtggtgttgatgggagaagtgatgacattttgcgttagagaagataatgagagtgggaaggctgtggtgaacaaggattgcaagagtcagggaccccagaacaagaagcagggttgggggtggtgctgaggccacacatttgggagcacgcgttgggtgccctggctgagctctgcactccaggccctgggtgtgtggggtgagcagccaagccctggccattgacatcctcaggttgggagcagacactaaacaggctgctggtggtggttctctgaggaggaataaaccggttagagaggccaagtctgtagatctcttgcaggtggagactgaaaggaggtggaatgtgtggctgtctacaggtgtatgagttggttctcatgctgctataaagatgtacccgagactcagtaatttataaagaaaaggggtttaatggactcacagttccgtgtggccagggaggcctcaggaaacttacaatcatggcggaaggggaagaggc

SEQ ID NO: 221923 - DNA, 854 bp, Homo sapiens
atcaggcaaattaacctctctgtgcttaacatttctttatctgttaaatgtgcataataatagtcccctacctgtgcagtgcatcatgtagtaggaggtacttttgtaactaatatggaattgcagaccagtatcctctttaagtaccatcctcaccaaagcctgaatggtaaagttagaaaatactgtggcctacaggattataatcaggctctcaattacctgtctaatcatatcttctgccattcttgccctagctgtcttcactatagctagatagaccttcttgctgttcccaaacaggcagagcacccacctttatacctgcatttcccaatattgaattttcttcccttagatctttatgtagtagtctcatttatacactattctatattatcaggcctcagcttaagtatttctgtcttagaaaagccttccctgttctaactgaaatagcttttcaccatattatatcttttgttccaaatacttgtacttggtgctttttaatgatttcttattctttacaattctaatatcttgctgtatttccttaagaattacttatttgggctgggtgcagtggttcacgtctgtaatcccagcactttgggaggctgaggtgggcggatcacattgtcaggagtttgagaccagcctgggccattgtggtgaaatcctgtctctactaacaatacaaaaattagccgggcgtagtggcaggcacctgcagtcccagctacccggaagaatgaggcaggagaatcgcttgaacctgggaggcggaggtagcagtgagtcgagatcacgccaccgcactccagcctgggagacagaatccatctcaaaac

SEQ ID NO: 221924 - DNA, 236 bp, Homo sapiens
cagaccacatatataaagagtgcctacaaatgaataacaaaaagtcaaactactcaaacaaaaatgggcaaaatacttaaaaagacactccaaaaagaatatgtacaaatggccaatagcaaacaaaaaggtactcaacatcattagttatcaggataaagctaattaaaatgacaatgacatacaatttcacatccatcagaatgactaaaatcagaaagaccaacaataccaaa

SEQ ID NO: 221925 - DNA, 343 bp, Homo sapiens
cctgtgtctggtctttgatttccatttcatgtgaggtgctgctaaaactgatgtttgttagtcactgagtctctgttgatctaaattcagctgtttctttaagcattctgtagtccggccctactcccacgtatccaacctagtctaccctagaatccactaacgctttattatgttacattcttttagttctctagcttgtcgtctctccctcctctcccctaaggatgaaacaaaacaggcatgtatagattcaagtttggatgtcttgtatagctttcagtttcggtaagtccttcaagggccgacttatgtctctccttttctattaaaaacctttacc

SEQ ID NO: 221926 - DNA, 582 bp, Homo sapiens
ctgtaaatggggtcctcaggcagcatttatttttgcagtccaaaaatagtgaccaaacacctactgtcagctaggcgagagttggggttcttgcttcatctgtcttgacaccaactaactaaatccctgttaaaatccaagtgcaagatggggaggaatctgagatgaaaattaggtggttaaaacaggggtcacgaaaagttgatttggggtgtttggtctctgtaggttacttatggagccccccataaaatgattaggtaatctatggagccagggaaaaattccaaaatcttgaattggcacagtttatttatatatttgaacactatgttagatttgtctcgtttttattgagagtgtatgtgtgcgtgttgattaaaacctaacagattagaaggttggagaggaaactgtccttagatgacccagccttccattaccatgtggagtagcatatgatgcaacacttaaagtattgagccatattcatatcattttctccctgctgtgttttccagcatttaaaaaacatggtcaaaacttggccctttttttctcaaaatcgctaaagtttaatgg

SEQ ID NO: 221927 - DNA, 219 bp, Homo sapiens
gagtgattctcataccagtagcatgagcatcacctagaaacttattaaaaatataaatttttaggttcaaccctagacctactgaatctgaaactgggagagtaagactgaattttcagctctccaaatgattctcctgtaacccaaagtttgagaaccactggtctacagcggaggtgctcacccatccctaggcgtcaatatcaactgtgaacatta

SEQ ID NO: 221928 - DNA, 498 bp, Homo sapiens
accggaagtggaaatcctgtttcctgtaggcatttttgaaaccctgctttttggatctgtagcaaatccagtgcaggcaacattatgtggaaatagaaacagggctcctgctaggagattgacattctggctttcctttggaacccctcactgactcatcgcccctgaagcaggagccagcaggtcccaaggctcccctgctcctgtccctgccccagggcgaggtaggaagccggaagcctgggcaggctgagcccagccgactggaaccagggaagagcctgtgggtgggtggaagggagggaaggaggccagattcctccagaactggggaagagaacaggttttgaagttgggggagggtttgggtttcacagtgatggtttcatgataccctggagggttgcacactcctggtgcatttttgtattcgtgctttgaatacagcccgcttcctttcaaccctccgcttaaaaagttttgatgttttaaggaaga

SEQ ID NO: 221929 - DNA, 480 bp, Homo sapiens
gcctcagtaaaaagctgttaaataaatactttttaaaaatggaaaacacaccagaatcataatggacatattggcaatgtccttctcaataaaaactaaagaaatgatctagatttgatgttcctaaaaggtaaaataggagcaggatttagctgtagttttctagcaatgccctttttaagtaatacagcctcagggcaatcccttaattaatattttccgctgtttgaagtaggtatttttatctccatcttataaatgaatgaaatggacctgagcatgattaaataacttgcccaaggtcacacagctagtaagcttccacactagtacttaattccagtatgttcctcctgaaagcccacactcattctccatcaccaccctgtgaattggtttaaaaaaaataagggtcactatgatggtccttgtggcagaaccacactacagagagaggctacaccagaaagaggaaggcct

SEQ ID NO: 221930 - DNA, 538 bp, Homo sapiens
cgtactttgacgcgttctcctttttaagatgacaagattactgctcatctttctttttgaaatgaagtctcactctgtcatccaggctggagtgtagtgggtgtaatctcggtctcactgcaagcctctcctgacctcaagttatacacccatctcagccttccaaagggctgcgattacagctgtgaggtgccacgcccagcctatgtatttatttatttttatttttgtagaggtgaggtctcactatgttgcccaaactgatattgaactcctaggctcaagtgatcctccctcctcggccttggaaagtgctaggattacaggcatgagccactgtgcctggcccactgcattattatatagaggcaatcagcgttaccttcctgagagatactgaggctgaacaaacatgtcttgtatatgcatttgcatctttttgttgttttaacacaagtggcagcatgctatttagacatagccttctgtacctgctgtacctggctcttctcacttaccaatatatcttggaaattat

SEQ ID NO: 221931 - DNA, 543 bp, Homo sapiens
atacatgtctagcaattttcaaaggcatgctaattcatcatgctttctctttcaaatagtttttttaagagccctctgcttattccagtccccccctttaaaatcttttaaaattattaataacctattaactttgagcacttcattaaaatccaaaaaatttgagggagtacatgtctttgtcctttacctttagaaccctcaaacatagcttggtattgctgtttttaaaattttctggagcatttaggattcacttagaaacaagcctttagggagaaaaatttatctagcaccactcactctatttttttgcactgactacttctatttttccccctttcatttccctagacttttcaatgcttttttataaaggtgcttgagttctgtttctcaacagctccctcatttattgaatgattcacacagtcactggaatattataggctcttaataaaatttttgaatgattgaaagagagaaaagtattttacctgtgatatattgatatttaaataaactagaacacttaaaggaaaa

SEQ ID NO: 221932 - DNA, 596 bp, Homo sapiens
cttctggcactgaagcagctggctagttctagcgcctgtgcactccagttcccacccatgaaagagtcagggaaaatttcctgcctcgctatcttgtcctttcttccaaaagaaaggaatcattttgtcatgtgcctcctttctaggaatgagaaatacagtcatgtgccagattccttttgagcaacgcagcattaggcgattttgttgtgtgaacatcacagtgtacttacacaaacctagatggtatagcctacaacacacctaggctgtatgatataatcatctcgtcatgtgcctcctttctaggaatgagaaacacagtcatgtgtcgcatgatttcttctgagcaatgcatcatgaggtgattgtgtcatgtgactatcatagtttacttacacaaacttagatggtatagcctatgacatgcctaggctgtatgatacagcctattgctcccaggctacaaacctgtacagcatgttactctactgaatactgtaggcaactgtaacacaacagcaaatatttgtatatctaaaaatatctaaatatagaaaaggtacggtaaaaatatagcattataatcttatggg

SEQ ID NO: 221933 - DNA, 365 bp, Homo sapiens
taggcatttgttttcatcaggtgaagatgaaatgcctcttgcttaaagaatcagattggctgggcatagtgtctcagacctgtaatccccaaactttgagaggctgaggtgggaggatcccttgagcccaggagttccagaccagccctggaaagacagggagaacccctctctccaaaaaaaggaaacaaaaataaaatatagatggttgtggtggtctgtgcctgtagtcccaactacttgagaggctgaggtgggaggaggttcagttgagcccaggagttcgaggctgcagtgagccttaatggtgccactgcactctggccttggggacagagtgagacactgtctaaaaaagaaaaaaa

SEQ ID NO: 221934 - DNA, 636 bp, Homo sapiens
ctcagctgtgatgctcctcggaggctggctcctgttggccttcaatgcaattttcctcctgtcttgggctgtggcccccaaagggctgtgcccaaggagaagcagtgttccaatgccaggggtgcaggcagtggcagctactgccatgattgtgggtctgctgattttcccaatcggccttgcctccccattcatcaaggaagtgtgcgaagcctcctccatgtattatggtgggaagtgccggctgggttggggttacatgactgctatcctcaatgcagtcctggccagcctcctgcccatcatcagctggccccacacaaccaaggtccaagggaggaccatcatcttctccagtgccaccgagagaatcatctttgtgccagaaatgaacaaataaaaatctcctgggagtagcacaaagggcacactccagagttttatgaaatcatcatgtagccaacttcaaatcccatctctgctccttcttgctgtgtgacttcaggcaagccactttacctctctggaacagttttttcttctggaaaatgaaagttgaaatcatacctacctcataaggttgttctgagaattcactggagatgctctgtgtaaataaagcactttgcaccatgt

SEQ ID NO: 221935 - DNA, 493 bp, Homo sapiens
  misc_feature (15)..(15): n is a, c, g, or t
  misc_feature (34)..(34): n is a, c, g, or t
  misc_feature (70)..(70): n is a, c, g, or t
  misc_feature (137)..(137): n is a, c, g, or t
  misc_feature (156)..(156): n is a, c, g, or t
aaggtggaaggcccncttgaagcccaggagtttnagcccaggtgggcaccaaagtgagatcccatctccncaaataccaaccaaaaaccaagaaaccaagattgagaaagaggttgccataatctctagtagtctgnacagtcttcctcttcttcnttttttttttttttttttttttttttttttttagacagagtgtcgctctgttacgcaggctggagtgcagtagggcaatcttggctcactgcaagctccgcctcctgggttcacgccattctcctgcctcagcctccaagtagctgggactacaggtgcccgccaccacacccggcctttttttaatcagctggtggaatgtgcctgtggtctcagctacttggcagactgagatagatcactggatcactggagctctgggggtcaaggctgtagtgagccatgattacatcactgcactccagcctgtcagcagagggaagaccctgcctcaaag

SEQ ID NO: 221936 - DNA, 429 bp, Homo sapiens
gagacagagtcttggtctgtcactaggctggagtgcagtggcacgatctcgacctaccgtgcaccgggttcaagtgattctcttgcctcagcctcccaagtagctgggacgaccggcacacaccaccacgcccagctaatttttctattttcagtagagatggggtttcaccatgttggccaggctggtctcaaactgacctcaggtgatccgcccgccttggcctcccaaagtgctgggattgcgagtgtcagccaccacacccggcctttttttaatcagctggtggaatgtgcctgtggtctcagctacttggcagactgagatagatcactggatcactggagctctgggggtcaaggctgtagtgagccatgattacatcactgcactccagcctgtcagcagagggaagaccctgcctcaaag

SEQ ID NO: 221937 - DNA, 304 bp, Homo sapiens
cttaaaggccgggcatgctcgtttatgcatgtaatcccagcactttgggaggctgagcttgggaggattgcttgagcccaggagttcaagaccagcctccgaggccaatgctgggattgcgagtgtcagccaccacacccggcctttttttaatcagctggtggaatgtgcctgtggtctcagctacttggcagactgagatagatcactggatcactggagctctgggggtcaaggctgtagtgagccatgattacatcactgcactccagcctgtcagcagagggaagaccctgcctcaaag

SEQ ID NO: 221938 - DNA, 825 bp, Homo sapiens
tggtgtttataaaattattggtaaaatgatgttaccaaaggtaatacatagaagttaaaatagttgtgttagagatttttccctcttaatgacagatttgtccttttaatcataatacagagggtgagaaggttcaggaaagtgtacatataacaaacaggacattttgttatgactccaaatgtagataatttttcacatgcgttaaacatagttcagaggttctcagctggtggctgcacactaggatcacctggggggctttaaaagtgaacgataaaagtgaatgatgaagccaggcatggtggctcatgcctgtaatcccagcactttgggcagccgaggcaggcagatcacttgaagtcgggagttcaagaccagtgccactccactccagcctgggtgacagaacaagactctgtctcaaaaaaaaaaaaaaaatagtgaataatggtcacctcacatccatcagaacggctaaccaacaaaaaacaccagaaaataacaagggttggtgaggacgtggagaaatcagaagtcttgcacgctgttggaggaaatgtaaaatggtacagccactgtggaaaacagtatggtggttcctcagaaaattaaaaatctaattaccatgacccggcaattccacttctgggtatatgccccaaacaaatgaaagcagagtctagaagagatatttgtacaccatgttcatatcagtattattcacagtagctaaaacatggaagcaacccaggtgtccattgatagaggaatggatcagccatacaatggcatattactcaaccttgaaaaggaaggaagtcc

SEQ ID NO: 221939 - DNA, 494 bp, Homo sapiens
aacccaaacagactttatctctgccttcatagagcttgctttagtgggcaaatacagccataaatgagtaaatatttactaactcttcattatggtcagtgtcgtgaaggaaaaaaatgtgggatggcctttcggttgcattattaggaacgatttccaggtcaggaagtgatgcttctgcacccagcagtacctgtcagtgtgaaatctggggtggagaccaggtcagagctttggatggctgatgacacccaggaggaagaggcagcctctacacgcaggtgggacagtgagcccctgccttgtggtctgtgctgagcttacccacaatgcaagccaaggcatcagctcccacccacaccccaagggacctgcaggaaaccaggctgcatttcaacaacaagcagaaagcacagagctttacacacaacctaaatacatcaaccatttgaagatgctaaactccatacaagagcatcaccaaactccacaaa

SEQ ID NO: 221940 - DNA, 163 bp, Homo sapiens
acgcctttttctttaaaagtctaacatactagaaaacatgctgaatgcaaaaatgccctacgtgatctcaaaaggtgatagaaaaaatcgaaaaaccacttctagatggtacatgctgccttcttaaaccccataattgcactttattaaaaggcttcaatgt

SEQ ID NO: 221941 - DNA, 403 bp, Homo sapiens
caaaattcacacacacacacacacacacacacacaccagcagcaaaattcagtctccaaaacttaacatttataatatatgtccaggatataatgcaaaattacttatctaaaaagaaccaggaaaatggaaggcatttttagtagagaaaagaaaatatggccacaataaattttaaaaatatgaaatgaaatggaaaccataaaaaaatgaaaattccaggagtgaaaaatacagcatttgaaattaaaattgttgggtagatttgtcagccaaatggagaagaggaaagattaactgaacttaaagatagatcagtagaaattgttacgcagttggaagatgagagagatgagagagacaaagattggagaaaaacaacaacaacaacaacaacagagcc

SEQ ID NO: 221942 - DNA, 471 bp, Homo sapiens
gaggaaatacaactccagagattccttcagtgatcaagatcagtgggccataatatttggttagagtttctgagaacacaggaagcaatgccacactcaggccaccacaatggagctgatttggcaggacttgttcaaacctttcaccttaaagcacgtgatccttcttcgtacattttcttcacttgggctgcttaagtcacagcctaacaactttgaggcaaaactgagaactggcatattctcctgcgtttcttctaatcgagtcccatcatccagctagacatgagagatcaaaccagggagggtgacctttctccttcccacttttcagagtcattggggcaactttttgacttttgtgaccaaagaaacattcccccaaaacatttatttttcattgtagggcattcagctgacagctgcattttagaaagttaccatgcctgtgagattctcatgtcaaagacc

SEQ ID NO: 221943 - DNA, 474 bp, Homo sapiens
gggggtgacctgtgatactggaaagggtgggataagcacagtagaagaggtaggaacagcattttgaggaagggcaatctaagcttctaggaagaggtggtctttgccccaggtcttgaagatcagataggaaggaataatggcaggaatgctgttcttccttccggctaggcactaggaaaggtcagggtgtgcaggtgttgcaaagggtatgtgctgcagagtggcctggcatgaggcttgcaaagtaggttggagccagtttgtagaaggcctcaagggcccaataaggcaaactgacaggtgctgtggggaacctgttgtgtgtctgtgcgggtgtatggggatgccctgtggaatgttctgagctcattcagacccatatagaagctggggtcactgataggaccatggcggatgctgttgcctggagaacttccaacctgggcttgtggcttaagcttaatgcaggct

SEQ ID NO: 221944 - DNA, 355 bp, Homo sapiens
gaaaaccaactcaacaacttttatctatcaatttccattacagaatcaagaatatttttaaaaggtttataaagaataatacttgcttcttgtatttctaaataactatgcatccattcatccagaatgatcatttaaattggtggtctggtacctgttaagctgttacaactgaatctttctgggaggaagactggtcttcagggacatagagctagaccctataagtccaggtatggagctgaacttgactttagagattcctggagaatgttaatagatacactgtgttctgtctcccattcgtctccttatgttggctcttactgaattcttcttcagccagcgttcttca

SEQ ID NO: 221945 - DNA, 387 bp, Homo sapiens
ggagcctctccccctgacatctccacacacctctgccgtctcgcttcccctccctctagcatcctgtggactttgggtgctggacagttatgggccccagtcccagccctgccacctcgtagctgtgtgacttggtagagttaaactctttgagtctcaatttcccttttctacagaagaggaatagcaagactccctgcctcagaaggctgctgagaggatgaagtgagttcaggcatgttaagcccttaaaactgtacctggtacatatcaggacttaataaatttgagtattgtgtgtgccccccacacacgtaagcatgtgcacacctacaccctgcaaacaacgtgttcctctgtgggacccatgcctggaactggtcataa

SEQ ID NO: 221946 - DNA, 431 bp, Homo sapiens
aagtagagatggtgtttcaccatgttgactaggctggtcttgagcttctgacctcaagtgatctgcctgcctcggcctcccaaagagctgggattacaggtgtgaactactacgcatgacctgtagcttagtcttttaatgcagtcatttttaaaaaaagagatgtggtctcaacatgttgtccaggcgggaatgcagtggctattcacaggcatgatcccactactgatcagtacaggagttttgacatgctccgtttctgacctgggtgagttcatccctctttaggcaaccttgatagccctcagctcctgggaggtcaccatattgatgccaaattcagtgtagacatttaactggcatagcgcactgcagcctagaattcttgggctcaagcaatcctcccacctcagcctcctgagtagctggga

SEQ ID NO: 221947 - DNA, 363 bp, Homo sapiens
gaggcaggagaattgcttgaacccaggaggcggaggttgcagtgagctgagatcttgccactgcactccagcctgggtgacagagcgagactctatctcaaaaaaaaaaaaaaaaaaaaaaagaaaaaaagaagtcctgattatggaaaatttcagacagacattaaagtagagagaatagtataaggagccccaacgtatccattcccagcttcaatgattatcagcactttaccattcttattttgtctattgactcctctgctgtgtggctggaatagttttttaaaaaagctgtaaatattacatcatttcacctgcaaacacttcagtatgtatttcaataaataaacgattaaaaaa

SEQ ID NO: 221948 - DNA, 234 bp, Homo sapiens
gagaaaggatcttgctctgtcacccaggctggagcgcagtggtaatttagctcactgcaacctccactgccctaccctgccccgggattcaagtgatcctcccatttcagccttccaagtagctgggaccacagagtcagctacattttttcttctcaaatcctgccttcaaaatgttcattctgtaatttggaatgaactcttcacaaagcatgtgcaggccgggtgtagtgg

SEQ ID NO: 221949 - DNA, 490 bp, Homo sapiens
tcttaagtcaccattaaattttggtggtgggacaatctcattagctccttcaaaatcatgtggctttgcataagtcttttgaaaatgtattttcagggaatttacagatggtgaaacattgttttaatccaaaccagttaatgctttaaatctacctttaaaaaaattgtactgtttttcgaagtacttaaagggagtggaggggtagaaagcatataagtgaatccatctcactgtggcaaactgtttttcaagtaaagtcataataatgaacaacacatgatctgaaatttgatcagcaaacatatccttatgccaaggaattttctttttttctttccttttttttctttttcgccattcacataccaaggttctgtaaatcagtaaaccaggcagagagtaactattgtaagggggaaaccaaatcataatacccagagtggcccagaagctgtctttctgaagaaacattaacgccaccaccacc

SEQ ID NO: 221950 - DNA, 387 bp, Homo sapiens
agcagcaaaactgtattaccaacccttgccaggtaatctatttttcaatctttcctaagcataccaaagtgctgattttcttttctaatggcccctatgcttgtgcagatgtttttgtcgtcccagcccaggcttcctgtaggtccttcctttatcatgcgcctgtaaactcagaacccatcaaattccataagaaatctggcttatccactaccatgtaaagggaaacgtacgtacttacggaaggcagttgtctctttcacagctctctgtttgctcttctaggtttatcttggagctcctggggactctaggaattccacagcctactagagtttcatctacttttgcagattgctaaatcttagaatggagacttgagaattc

SEQ ID NO: 221951 - DNA, 391 bp, Homo sapiens
ctaagctaaagggaaaggtcaagctaggaactgcttagggccaaccttcctcccgttctactcaaagtcacccctctgctcactgagatatatctgtatccgattgcctcctttggagaggctaatcagaaactcaaaagaatgtaaccatttgtttcttatctatgtatgacctagaagccccctccccacttcaagttgtcctcctttgcttcaagttgtcccaccttccagaccaaatcaatattcatcttacataaactgattgatgtctcatgtctccctaaaatgtataaaaccgaattgtgctctatcatgtcatcaggacctcctgaggctgtgtcatgggagtgtgtcctcaaccttggcaaaataaactttctaaattaaa

SEQ ID NO: 221952 - DNA, 397 bp, Homo sapiens
cactgccatgtgatatactttcagctttgatgtgaactcaaagagaagactgctttcaattgtaggcctatgatctttgcttgattattttacttcatctccaaccaaattcttttcactaatttttgtgcagcttgcaccgaataaggcaatcttcagtctcagtactgagctactgcagtggttcaaaaagatctgtgtcctcgatgtgtactgttttccctatcagttgtcacaggcagtgatgtgcatgacagggtgaattgtataggattttatattccatcagtttggtgtatatatatatttggatatatatgtatataaatgtctgttagaatgaatgtgataatggacaaaaataaatgtctattagagtgtttccctaaaattaaaa

SEQ ID NO: 221953 - DNA, 370 bp, Homo sapiens
ggaccattcctactcctgacatgctctttcctaagtccttcagcaataagaaactgtgcccagaacaaaagttatgttttattttatgccacaaaattaggagtggaaaagaaatgtgaatatcttatgagaaaaaaatgcaagttaaacttcctggaaaagacctgaattcatcgagctttggtgcttgtatactataagctcagacaataaaattctacccactctctttaactgaatgcggtaatacttttgacaacaactttaaggtgtcaaggagaaaaatatttttcatggttaactgtacagcctatcatctttatttcagccagaaaactgattagtgttcattgatagaagatgtcgacgc

SEQ ID NO: 221954 - DNA, 533 bp, Homo sapiens
tagtacagaataacagctgggatacagctctgaagtgaggaaactgcatttgaaccctggttaaacaaatgctgggtatgagttcaacattacaatgtataaattacatttatactacggtgtaggctatgttacattattctgtaaagaagcaatatactccttcattcttccacatactaccttgttccaaaaaatgattttaaatgcctaatagaattaaactgtaatgcgtgctactctgctaaaaccactttaaatatgctatctcatttattcctcaccatgattctctaggaggttcttggctcactgcaacctctgcctcctggattcaagagattctcctgcctcagcctcccgagtagctggggttacaggcatgcgccaccatgcctggataatttttgtatttttagtagaaatggggtttcaccatgttggccaggctggtctcaaactcctgccctcgtgatccgcccacctcagcctcccaaaatgctgggattacaggcgtgagccaccgtgcccgg

SEQ ID NO: 221955 - DNA, 377 bp, Homo sapiens
atctgacaaaatcactccgaaatcctcacattatatgatggatatggtggagaaatgtagactgggttgttactctgtttaggtgaatatacagctgcttgagcaactacattcaaacctcatcgatagtggaatgatgtttaacctggagagagatctcttgttctctttcttgttctgatattctttgaaacctatagttgtgaacctctttattctagaagtgaattttaatgtaaagaattttgtccaaagtaatgttatactccagctcaggaatgtacatatacatacacacaggggacttcaaaaagtttgtagaaaaattgaaataaaagataaaaatacgaaataaaaatttctcaacataagctcca

SEQ ID NO: 221956 - DNA, 391 bp, Homo sapiens
acattaccagatttcaagacttattataaagttacagtaactgagataatcttgtatgggcatgtggatagacatataggtaagtgaaacagaatagagaggccaataatagatccgtacatatttgtcattgattttcatccaaagtgacaaggcaattaattggggatagaatagccttatgaaaaatggtatgaagaacaccagagacgtggaatcaacctaaatgcccatcaacagtgaactggataaagaaaacatggtggccgggcgcagtggctcaaacctgtaatctcagcactttgggaggccgaggcgggcagatcacctgaggtcaggagttcaagaccagcctggccaacatggtgaaaccccatctctacaaaaatac

SEQ ID NO: 221957 - DNA, 398 bp, Homo sapiens
tgtttgtttgtttgtttgttttgagatggagtttcgctgttgttgcccaggctggagtgcaatggcgtgatctcggctcactgcaaactctgcctcctgggttcaagtgattctcctgcctcagcctcccgagtagctgggattacaggcatgcaccaccacgcctgactaattttgtatttttagtagagacggggtttctccatgttggtcaggctggtcttgaactcccaacctcaggtgatccgcccgcctcagactccaaagtgctgggattacaggtgtgagccaccacgcccggccctgaccaacatcttgactgaaactcacgagacactgagccacaaccttccaactaagctgttcctggatttctgaccctaggaaactgtgtgagg

SEQ ID NO: 221958 - DNA, 816 bp, Homo sapiens
gccaccatgtgaagaaggtccttgcttcctcttcatcatctatcatgattgcaagtttaggcctcctcagccacgtgcaacttttatttcaccctgaagccaaagagaactttctgaaagacaaatttgctcatgctataatagttactgacaaatatttaaaggactaagttgtgtaaggaatctacactgtcaggcagaaccaggattcctggaagtagaactgggctgcttcataagtctgacttcatatgacagctagattcaaaaggatgaaatcagtagaggtgagacctcttgatgccttggcttggaagtcacatattctattggccaaagcaaatcacaaggccaccacaaattcaaggagatgaagaaatagactctacctctcttgattggcttataatatggtcagttcttcagaggaagaggaaaatttcatctggcctcaaatctcagtgatcgcatttgtgggaacataatgtctgaagtaaagactaagtagaagtctgacaagcaaaaaaagaaaaaaagacaaagacactccaagcaagagaaacaacctgagcagaagcacccaggtatgacagaaaacgtagagaggaaaggcttccaaaagcaacagagattcacaggaagctccacagaaaaacgggtggtgcaaaaaattaggcaagagggaaaatggggttaggccatgtaccaacatgttcatcattatacagtgattggacttggaaaggcagaagagaagcaagagccagcatcctcatcttataaacagaaaagctgtctgggcgtggtggctcatgc

SEQ ID NO: 221959 - DNA, 559 bp, Homo sapiens
gccaccatgtgaagaaggtccttgcttcctcttcatcatctatcatgattgcaagtttaggcctcctcagccacgtgcaactcttataatatggtcagttcttcagaggaagaggaaaatttcatctggcctcaaatctcagtgatcgcatttgtgggaacataatgtctgaagtaaagactaagtagaagtctgacaagcaaaaaaagaaaaaaagacaaagacactccaagcaagagaaacaacctgagcagaagcacccaggttgaagtcctaacccccaacatctcagaatgtggctttatttgaagagaggattacctttgcagaggtaatcaagttaaaatgaggtcaatatagtgagtcctaatccagtatggttgatgtcctcatgaaaaggagaaatttgaagacagacacaccaaaggagaatgccatgtggagacacagggagaagttggcaatctacaagccaacgagaatagcctggaacaaattcttccatcacacccctcagaaggaatcaaccctgactgcacctccattgcagagttgtagc

SEQ ID NO: 221960 - DNA, 490 bp, Homo sapiens
taaagataaagtggtttccttgctatgactttccccttgctgttgatgagctggtgaatgtagcaagctatgtgacggtcattgctgacaagtatagactactttcaggtctctggagtcctcagagtctggcttttctttatattattttatagtaaatggaattatcttcacaaataacttccatctgttttcaaataaatagaaatttgatacatagcaaaacggggtattcgtctcacagtcctacagtacaccaaacaaacaaacaaaaatttccacaacaggtctggctaacaaggagagaaaatatttttaatgttttaaataacatatattctccacatatttaaaagtctgtgttcacactaaaaaaagtgaactggtatgctactaaaagtcaatatggcctcgaattccagagataaagtaagtctacatattcatgaagcttatctctactgccttaaacactggtatttttatctac

SEQ ID NO: 221961 - DNA, 605 bp, Homo sapiens
gttctggagcgttgaagtccaagattggccaggcatggtatctcatccctgtaaccccagcacttaggaggccaaggtgggcagatcacttgagctcaggagtttgagaacagcctggacaacaaggtgaaaccccgtctctacaaaaaaccacaaaaattagctgggtgtggtggtgtgcacatgtagtcccagctactcaggaggctgaggcaggaagattgtttgtcaaggaagtcgaggttgcagtgagccgtgattgtgccactgcactccagcctgggtgacagagcaagaccttgtctccaacaacaaaaaaaaaaaaagttcaagatcaagttgccagcagggttggtttctagtgagggctctcttcctggcttgcagacggccaccctcttgctgtgcatggcctttcatctgtgtgtgagtggagagaaattgagagagtgctagctggtgtctcttcctccttctatggggacgccagtcctattggatgagaacccccacccttatgacctcattaaccttaattacctcgccaaaggccctgtcttcaaatacagccacaatgggggttagagcttcaatgtaggaacctg

SEQ ID NO: 221962 - DNA, 264 bp, Homo sapiens
cttttgatggcttcctgaaataatgcatcttttgcaagaaagattctcaacctcactttgcaaccagcttgcaccgtatttgcatcatgggaggagccagccttaggctaagctgagaggggagtctgagtggaggctcattctgcaagtgttcagctcatttggaaaggtttcatcttgagatgacgtttgcttccccacacaatctccaaaccacagggacttgaacagcaaagacttccagtacttttttttttttttgag

SEQ ID NO: 221963 - DNA, 286 bp, Homo sapiens
tggagtgatgggtgcacagctctgcacatttactacagtcgctgaactgcacacacaacacgggtatattttattgcatagaaattgtattaaagctgttaagaattttacttagattagcatttttcccacactgtgccatcaacttagtatatgattagattcattgtttctaactgtatttaaatttaatgtttgtcacattttgcttgctaaatttttaaaattttaaatttctaaagtcccccaaggtgtatatttttagaaaaattattcaacggaaaaa

SEQ ID NO: 221964 - DNA, 284 bp, Homo sapiens
taaggtgtgtatactagaggcaggttcaccttgggaagacagacctggatgcagtctcaacgccttttgagcgggaaactccagagtctcacatgctcagagcttggttagaagagggacactggtatttcttctaactcatagctttttggggatgacatagaaaacagaggaagactacagcagcaaggccctctaacgagtgaggcccagggcagcccgtccccacaacctcccaacccccttgactgtgtcttagggcagtactgatggcaacagaatat

SEQ ID NO: 221965 - DNA, 403 bp, Homo sapiens
ctttcatgcttcattctggcagggctgaatgtcttatgcatagccagctaactaaattcttaaaaggtgagaccaataaacagaaatctcaaggcagctaccctactgctgttcctcttgcctaaaaaaaacttgtccagagtacagacttgtccagagaaccctaatgaaatacctggttattctctgaaatggtttgaacctatttattatgtgcagaattgtttcaagctttgtagtttgtctttcctaaccgtatttctagtaaataagcttttgaggttatttggaatatattttaagagctataaaagtatttatacctcaaatcagtctatatttccacccatgataatttttctaaggaaaagaaaataaatataaagccatattcataaatacc

SEQ ID NO: 221966 - DNA, 476 bp, Homo sapiens
tgtattttttagtacagacggggtttcaccgtgttagccaggatggtctggatttcctgacctcgtgatccgcccgactcggcctgccaaagtgctgggattacaggcataagccacggcacccggccctctattcaaattctttagggccaaatatgcttgggtatgctgatccatatctgtcacctgaaatatttttcagttataaataaactattgacaggtgaccacacattgctgatccttgaccatctctgaagtaatatagaggaaaggcgtctcaataggtcagtagactcatttgagagttggcttcacctactattcaactgctctgttttggtgatgtagaaaagttcattttgtcatcaaccttgatcataggattttctctgtaagactgaaggatcaaaacttctctgaaagtagctaattcactgtcacaaagatgtaaagaatgtctgtcgtttctttgg

SEQ ID NO: 221967 - DNA, 496 bp, Homo sapiens
gctagaatgactatataatttactatttagattttgttacttttgttggtaaaatgctaaactggacggacactgggaaaacagagaaagaccagggctgttacaggcaaatgggggaaatatacgatgtcttaggtgtagaccagaggagtggcatcgtcttggcttttagcagagcacccaggctgctattttcagactagaatgaaagtgagcaagcgttaacacaaagacagttgtaggagcctactgtaatatccaggtgagaagtggctgaggcaatggcaaattctgggtgttttgaaatgcaaggccagcaggacttcggaatggaactgatgtggagcattagagaaaaaagattttgagatgaaacaattgtaggaacggagttggccttaatatagctggagagactacagaagaagctgctttaggagagtcaggggaggggaaacaagaagctccagtagccatccaagtggagatactgggt

SEQ ID NO: 221968 - DNA, 533 bp, Homo sapiens
tggatgtgggttatagtctgcagatatcaagacaagtttcggtaattctatcccaagatgtgcttcaaaatgtatctgttaccattatattagaagtagcatctgaaaatgtgaagttcctaagtaaaaatcagggttgctttcctaaatatgccttttttaagattacttttcctattagagtaagaatcaggctttaataatatacatttcattctaacagtcaagtattcataggacgactataggaattctcctccctaacgctaactgtgtttccacaattgctattcccaatgggtaaaaacagggagacacaaagatacagaaatactccatttgcctctttagttgttttcccagtcaggaaaggatttaaaactgtagcatgaagtgaaatttttgaatgactgtggattttgtttatccgttgtgcttgttctccctacatcagtgatgataagatattgtcaaaataatatttttccatactataaaggcaaaataaaagcaaggacatatgttctaataaa

SEQ ID NO: 221969 - DNA, 558 bp, Homo sapiens
tggatgtgggttatagtctgcagatatcaagacaagtttcggtaattctatcccaagatgtgcttcaaaatgtatctgttaccattatattagaagtagcatctgaaaatgtgaagttcctaagtaaaaatcagggttgctttcctaaatatgccttttttaagattacttttcctattagagtaagaatcaggctttaataatatacatttcattctaacagtcaagtattcataggacgactataggaattctcctccctaacgctaactgtgtttccacaattgctattcccaatgggtaaaaacagggagacacaaagatacagaaatactccatttgcctctttagttgttttcccagtcaggaaaggatttaaaactgtagcatgaagtgaaatttttgaatgactgtggattttgtttatccgttgtgcttgttctccctacatcagtgatggttccattccgtcaaacccataccctcccagcccatcctggaaagacacaagatggccataacgtagtaatatctaaaatctggaaaaagttggcggcc

SEQ ID NO: 221970 - DNA, 497 bp, Homo sapiens
gtacaacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggcgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcga

SEQ ID NO: 221971 - DNA, 943 bp, Homo sapiens
gagccttaagatagtaacttggcgcatggtctaacagcacgcgtcattttccccctttgtgtggagaatgatgagaccaatattggcccaattagccagctgtgcgtcttttatgtttggaggatgtttatttccaagcaggcactggcgaataatctctcggacgccagtttgctccgcgtgggtttattgccagcagctgctatgtggaaggtggggatccagcggagctggaatgaggagacagggacctggtagggcaggtcacaggccctcagacccccaggctcccaagagtgggtgagatgccacttgccaaccgtggaggcttttgatgccattggcttcccccaaagaaataggaaatttctcagaaagctgatttcagtgttttcctttagtgtgggagtaaccagctggtggtggagaagcagaaagctggggaaacaaatccctaaagaggccttgcccactctgctggcatcctgctgggagagacaggcaggtgcagggctgggggtctcacagcccccaaactgactgttaagagcaggtttctctgcttgtcctcgaagggtctcgactgagttttgttccccgccataaccggggggtctcccccgagggatggtggccctttgtggaggcagcagggcctccagtttgccttcccggggagcctggctgggtagctgttagggctggaagactgagccatggccctgctgctgggggctcccctcgcctccccggagctggcctgagaggtcccgaggcggccggcgagccgtctggacttgggaatgagctctgactggtcaaggccagttcactccccaagttgtttgaaagctgggcgtcctgcaggtaaacttcagcaggtggctgcgttgcctgtgaggttgtgtgggggatcctggccctggatcctgcaggctctctt

SEQ ID NO: 221972 - DNA, 405 bp, Homo sapiens
tagtctatcccgcaatagtgtttaagcttatttcaggtatttcaaatggagaattcaaagcatccactttaaatgagtcttaaaagtctattctcttctaggagtaactattggtatgtaaaaacactacattaatacataaagatttcctaggaagtaaattataagcacgaaacttgtgccatacaaaatggctacttgtttaaaaaattgttcagagaagtcagattaggtcctattggctataattggataatggaaatccattttatatgcattaccaaactctcatcaaatcatacctcaaggcaccaagaggcaaatcacctcttgtattaaactagatatggccggtgaataatgggtgcagaggtggtcatttccatgagtggaaccagatataga

SEQ ID NO: 221973 - DNA, 539 bp, Homo sapiens
ctagagtggatatactaatatgtgacaaaatacacttaagaatgttattagaaatactgagggactttttataatgttaaaaagatcactctacctggaagatacatgcatacatacatacatacatacatatacatatacatatatatatattccgtatatgtatatgccatatatatgaaaatattcaaataatggttgaaaacctctcaaatttgattaaaatatatatacatctaacaacagaggcccaaatttatgaagcaaaaactaatagaattgcagggagaaatagacaattcagcaataatagttggggatttcaataccccattttcaataatggatataacaataaaagatcaacaaaggaataaagacttgaatgatatcatttgcccactacacctaacagacatttatagaacatgccacgcaacaatgaaagaatataagttcttctaaagtgcatattaacaattcccagtatatataacatcttaggtggataaactagtctcaataaatttaaaagagga

SEQ ID NO: 221974 - DNA, 448 bp, Homo sapiens
cagtagtgaagatccctggaagagggaggccatgaagagggatgcagatacctggcaagcccacctcccttctatgccacctgccagccttctctgacattcccaaaccagggaccaacaccgccaatcagggaagatttacacgcatttaattatagaaccagttcaagtctctggaggctggatgtccggccttcaccctggcacagtgggctgtgggctctgcggtccagttgctagtcaggagacgtcctggtggcccctgattcgtgttcacgttcacatcactgttcctgcggttctctacacattcaccttggtattagctctctttgcccctggtccagcatacctcttcagcttccaagtatgggtcaccttccttatgtaaatttcctcttgggactgtattttcttttaaataaaaattggccttgtccgagaactt

SEQ ID NO: 221975 - DNA, 672 bp, Homo sapiens
gagcactagcggaaagaaaggcggcacgtcagggcaaaagcagcttctgagggcgtctccaagcccagccctgcctccttggcagtgaggtatgcccgcaacctccactttgctcttagtactggggccaaagtatcctgggtgtaaaatggggatgatcctttccatgccacggggtcctgaggatcatacacaacagtgcccctaaagcgcctggcacagcacctgaccggagcacacgggcaacacacaggcaacaaacaggagctggaagagtttcctgtggctgccagaacaaacaccacaaaccagatgtggcggtggggggtcatgcacccgacatttattttctcaccgttctggaggccagaagtctgagatccaggtgccggcagggccacaccccctctgagggctcggggtaagaagcgtcctggcctcttccagctccctgtggctccaggatcctgggcttgtggctgcgtcgctcctgcctctgcctctgtcttcacgtggcctgtccccatgtatcttttcctctcctcctcaggacatttgtcattggatttagggcccacccagaatccaggaggggctcatcttcagatccttaatgacatctacaaagaccctttatctaaataggtcagattcacaggtcccggcggttag

SEQ ID NO: 221976 - DNA, 426 bp, Homo sapiens
ttttcctgtaaagacggtgttcgccttgttgcccaggtgggtcttgaactcctaggctcaagcggatccgccacctcggactcccaaagtgctaggattacaggggtgagccaccatgcctggccagctttgcttttgaagtacaatccaatcagatcactttgcaccaccatctttactaccaccctagttcaagctactatcatttgcagctagaattactgcaaaagctgaactatcttcctcctttgggagcatgagaagtaactattaaaaaaataagtcagactggccctgcacagaggctcatgcctgtaatctcagcactttgggaggccaggagttcaagaccagcctggccaacatggcgaaaccccatctctactaaaaatatacaaattagcctggtgtggtggcgcatgtctg

SEQ ID NO: 221977 - DNA, 511 bp, Homo sapiens
aattagaatgaggtacaaaacagatgagctaatggcaaaagactgatccaaaaaggttggccatggcatctaacatcaccttgtaacctgagttacaaatagaccttttctttcagaattgagatacgggagtgctgtgatcttttcacattgtcctattggggctggtgagaatatgttttattcagttttcatgaaactattaaaatgatccattatatgttcagcacattgtgttgcacataaagacttttttttctattgttctcgtgttccccaaggtcttttactgctagcctatgcttctgaatgtgtgagggatcaaatgagacttccgattatatggcaaatagcatcatcttgaattttgtgaaattatttctggataggattaaatccagtatctgacattatggtttagctcatcgcttcccaacctgtaagctctcttctcaatggccagtggatgctttgggaaataatttaaatctgcggtgaaataattggtcca

SEQ ID NO: 221978 - DNA, 677 bp, Homo sapiens
gctccagcctgggcaacagagcaagaccctgtcccaaaaaaaaataaaaaggaaacaacttactatctaccacatcaatgactgtaagaaccacctgagatattataaagcacttagaattgtatttggctcatattaaccaatcaatattagctacattactgttttgttgttgttgatatactatgctatataaactttgacaataccaatcatatgctgtgttgttcccaaatcaacttttgtgtaatgtaaaagattcataaaagtttaatattttacttttatatatgctcaataaatatctatagaatacatacatttttgaacaatgactcaccagtatgctttattaaaaggaattcgcttctaattttgtttcctcttttgggaaaagtaacaatgcttaccaactttcttcccctttttatgtcatgtgaaactatcatatgcaatgccatatggtaaacatgacaaatggtgcaaaacactgttttgactgaaactcatttgcctcctgctaaacatcaattcccagatttaaaaatattgttatttaaatgccaaccatttctaggtcacacctacatgaagtaagcaaaacataccatgatagttgaccaaactatttcatttcatacatctcttatggcaagaactataaggcataaaatgcc

SEQ ID NO: 221979 - DNA, 319 bp, Homo sapiens
agaaaaatggatttctgtcttttgtagtaaagtaattgggcaccactgcttggcaggagctggtgctgttgagctagctctagctgccacaggttgataggcaggtgataaggcagcttccaccagggtttgcacaggaggcctacctaatatgctgtctgccctaagggcctatgggaacacagttggattattatgttaatgcatgagcccgctgccctcttcctatcccagctgggttccctgttgttaggaactgctttgcactgacagtggagtaatatgcttcatgattgaaagggcaaaggggcttgaaagg

SEQ ID NO: 221980 - DNA, 278 bp, Homo sapiens
cgggcaggtggtgccgtcctcctcttttcaagcctaacgcccagtgcagccctggtagaaaccctctctggcagatgaggcactgggagatgagtgtccaagaatgagaagaaagaggaatcatcctaatgataaaaagtgctatgactggctgcctgcgatggctcacgcctattttcccagcgctctgggaggccgaggtgggcagatcgctggagcccaggagttcgagaccagcctgggcaacatggtgaaaccccatctctactaaaaagaca

SEQ ID NO: 221981 - DNA, 420 bp, Homo sapiens
tgagacggagttttgctgttattgcccaggctagagtgcaatggtgcgatcttggctcacagcaacctccacctcccagagtcaagcaattctcctgcctcagcctcctgagtagctgggattacaggcatgtgccaccatgcccagctaatttttgtatttttagtagagatgggttttttccatgttggtcaggctggtctcaaactcccggtctcaggtgatccatccacctcggcctcccaaagtgctgggattacaggcgtgagccactgtgcccggccaattatccctttttgtgtttttttggggggttgggggaagaacagagtctcactctgtcatctaggctggagtgcactggtatgatctcggctcactgcagcctccgcctcccaggttccagcgattctccggact

SEQ ID NO: 221982 - DNA, 529 bp, Homo sapiens
ctaagtgaatgaagccagagacaaaggccacatattgtatgattccatttatggactgtccagaatagacaaagccatagggacagaaagtagaatagtattttcccagagccaaggagtgagggaggataaggaacgactgctgttggatatgtgatgtctttttaggctgatgaaaatattctggcattagaaagtggtgatggtcactcaacctcgtgagtacactaaaaatcacttaactgtacattttaaaaggctgaattgtatgatgtgtgaattatatctccataaaaacaattaaatattctgaggagaaaaaaagtactactgtctcctgagagacactgtctgctgtcaggaagttagagttgctcagagccaaattccctgatacatgataaacagaattacataattatagtcctatcccagttctctcattttacacacaagtacactgatttgtccaaagtcccacagataatgagtggcataatcagattccaagtttcccaaactgtaatcc

SEQ ID NO: 221983 - DNA, 377 bp, Homo sapiens
cagccttaggaagatgccagtaaaaaatggaagctattaaaagcaaactgagttgatgaattttcctcaatttataatgtaaaattattcttggtgtagtgctgtctacatgatatcggattttccattattagaggatttaaaagccactttggactaaaggttatttacatttctaatttctcacattatatgatggggcataactttaaatagtggcctcccaaacacgtttttataaagggacaattgttagctttctgatgaatgtttcttttacatgtttatttttttcatgtgctgtattctgtttggctccaactagcagaaatacccagcatttggagagtcttctcatctgagcatccagctgttta

SEQ ID NO: 221984 - DNA, 112 bp, Homo sapiens
tgctggaactgcgtgtgctgctttctagaacagataatgaatcacagagctgctcagatggagaaatccaaaagtgcctctttgccttatctcccccttctgtcgtcttctc

SEQ ID NO: 221985 - DNA, 284 bp, Homo sapiens
tgaatttttgtagagacagggtttcaccatgttggccaggctagtctcgaactcctgacctcaggtgatctgcagaagcagcccctcttctgcctgctcctcctccagcaggcccaacgccaccttgtcaaatcctccctgtttgctcagcccatcaacgcttactcggggccctgggacgctgctccaccgagccgttagcctgtaggcctggcctcagcctcaacccaaccctgcccaagcacccggaaagaccccaagggagtcctcctggggattccaga

SEQ ID NO: 221986 - DNA, 446 bp, Homo sapiens
ggtgagtgcgagtgtctgaagggccagggcagcgccaccgaggccactagcagatactgtcacctgggcagggactggacatttgtggatcactctgacccttatgcctaaaccccaaatctcctgtcccctttgccagtcatggcctctcccacattggcctccactgctctctccagggagagagtttgactaattgataatggctttgctcttgaggctttaggagttcgagaccagtctgggcagcatagtgagatcccaattctacaaaagagaagacagaaaattagctgggcatgatggtgtgagcttgtagtcccagctacttagaagagcctaaagcaggagggttggctgaacctgggaggttgaggctgcagtgagctatgattggtgccactgcactacagcttgggagacagagcaagcaagacctggtctct

SEQ ID NO: 221987 - DNA, 206 bp, Homo sapiens
tgagacagtgtcttactcagttgggactacaagtgtgtgccaccatgcccggctatcttatctacctatcgacctgagacagggtctccccttctgttgcctgggctggagtgcaccggtgtgatctcggctccctatagcctccacctcttgggcccaagtgatcctccaacctcagtctcacgagtagctgggattacagctgc

SEQ ID NO: 221988 - DNA, 473 bp, Homo sapiens
agtaaaaggattttcctagcatgaaggtagcttccaccaatacaagaagtacagacattagggcatgtttggaaaagcagatagtccaattgtttggaaaccctcagtggggaaaaactgaagccatggtgtgtgctttgtgcacaagaaaatcagggataaagtgaaagttaagatcaaatacattagagcagctgagcattattagggtgaacttgacaagtcatttcaagtctccgtgtctcagtttttctatctggaaattggggaacatcatgtgataactcatgagattttaatgtttattaaatatgttattacttgtaaagtgcttaaaatagtacctcatatagcctcatatagtaggtactcactgtgcatgtgtgttgtgtttaaacaaatagtccgtaatttgaacatctgaagaatttcaagaataacaatctgtggaataaagttgagttttaaaatta

SEQ ID NO: 221989 - DNA, 294 bp, Homo sapiens
ctattgagaaagcactatagaaactttgctaggtattaacgttaaaaatcgtaaaacattacattttccatggcagaaaactgataaaatcattgagtagtcaatttctgaaatgtttcttaattttagaataatatgggtaaacagccaggtgcagtggctcacacctgtaatcccagtgactcaggaggctgaggtggaaggatcactcgaggccaggagtttaaggctgcagtgagctatgatggcacgatctcgtctcactgcatcttccgcctcatgagttcaagagat

SEQ ID NO: 221990 - DNA, 407 bp, Homo sapiens
gaggctgaggtgggtggattcattgagcccaggagtctgaagctgtagtgagttttgatcaggccactgcactccagactgggtgacagagggagaccctgtctcaaagaaaaaaaaagtacaaaataagtggaatagtacagtccatgccctgtggacaaggcttccttcattgaagacagtttttgaaattgatccatattgtgcgtatcagtacttcattcctttttattgttgagatgtattccattgtatgattataccccaatttgtttattcgttcacctgttggccttttgagttgttctggctattgtgaataaagctgctataaacattttatgtacaagtctgtgtgtgggcatatgttttcatttcttctgtataactaggggtggaattactgg

SEQ ID NO: 221991 - DNA, 1151 bp, Homo sapiens
gcaaataagatcagggaaagttaaatatagccaacctatgtatcgaactatgacaagttacaggtttaggcacatttaatgagattaatggagcataattttcacaattataatgtattctgaccagtaattgatgactgctaattgaaaaagttcactgtagagtttccctctaaagctgagaatcagcagaactatgatggtttagtgaacgtgggaattaacgagcactcagctgatcacaggagcctaggggtagtggaaagaaaagcaagagtaggtcatcattgccttatttcataatgcagaggcttctttaaattcacttgaagctctgtgcatttcattagtttctctgctctgttctctgcacaaatgcagacaggagaaaaataatattcaacatccctctgaggaccatagctgagtaaaaaagatgcttgtgctgccacaaacaggggtccacctggaactcaagcttgctagtaattctgagaggttcccctatccctgcctggcttggaggtaaagtgatgtctttgggctaccgttaaattcaaaccctgcagagagtcctcttttgctcactcaagcttatttcaaaacgagcctcacgcagagagcccagatcagtaggaaagactgacgctacattcaggcacggagttgctccctgccctgctgttactctgtatgtcttttgtcctgtcaaggctgagaaacatttcttgggagatatcccataaaattgtcagaaaacaggggagaggcaaaaattaaacaccaaagtcactaacttaaaagaaagcaaatgtaattaggggaaaagaaattttcaccttgtgtctgtgttaacaaaggtatcatccacttggaataacccagatatcatttttgtcccccaactactgtttacctttgcatgtctctcatctgtaataccactaggaattacacggcagtgagaagaggaaatgggtcagcctccggctttaaagtagttaagtgagcatttatgtagtacgattgtagcaaaagggaaagtaggcagcagagcaaaagggactcactctctgagtgagcaagtcaagtttttcattactttgaaaattgcatcaatctgcagggtgcccatgtaatttacttattgt

SEQ ID NO: 221992 - DNA, 495 bp, Homo sapiens
gactgtgtttcacaggaggcattttagtgttgttgttccccaatggctaggcagaggcagacaaagagaacattgtgtatcatcataatttgtcttcaatgacctttctttttgtgtcattcaccaccacctgttcctcaaaacaccaccatgtgaaccccaagcccaatggctcaggcttgccctctttccacccacgttccaggatggatttttccaggaacaggactaatgactcttaacttttcttctaccatctagagatggattataaggtagcaacccaagaaaatgggtttggacattcaaatacttgagtttaagtccagatgtgcaaacttgggcaaagccatttaacctcattcatcaacttgtcaaataggaaagataatacttacccgggatgaattccagttttggtgagcttgacattttcactatttgctggagccttctttaagcaaaagaataaaaatttatgatatgaattgggta

SEQ ID NO: 221993 - DNA, 727 bp, Homo sapiens
ccgttcctgataaaaatggcaaactgtgcctaaactgtgcagaccttatggtttatgctaaacacttgccttgcttctggaggcctggaattttggtacctgctaggtaaagtgtgtctacgttaccatccgcaataaaaaccctgggtactgagtccgtgatgaacatccttggtagacaacatttcacatgtgttgttacaaattgtaggtggggaactaagagtgtcctgtgtgactcaaatgggagaagactcctggtttccctggacttagcttcatgtgccttttccctttgctgcttttctttgtattctttcaccatagtaagtcatagatgtgaatatgactatatctgagccctgtgagtccttctagtgaacaaccttgtggttgtcttgggcacttccaacacaacttgtcttggtgatatttggccagcaaatgtcaacattaccaaagaaaagttggaggtggatggctttcacaataaaatttatttacagaactcctttaagtacaattttactcattattcatttgctcattcatttagttacaaaacttttgtcaaacacacaatatgttctggttactcccttagggactgaagggaatgagagagaaatacagagaggagaacatcagattcctctttacaaggggatcacagtttcaagacaccttctgatagggagataactaaacttcagtgggagagtgttca

SEQ ID NO: 221994 - DNA, 978 bp, Homo sapiens
gccattcgtaggcactgctggcctcatgctccagacagccctgggacaatgggccaccaagggaaatcaatgattgcgtgggcgcaggtgacctccagcctgcttcagggccacccttgttccccatgccaactccctccttcctatgggctcccaagaaatgggtggcagagaccagcctggtgatttacctcctgcctttccgtgacttcctcccagtcctgtgcatctcatgtttaattatgaggctgtggaaggtggtgatattaattatagggctgaggttgtgttacttggagaaagtcagtgcacatgtcatttgattttcctcaagaaggaaaactgtattttttccgatctcaaaaataattccagggaaataaatgtgtacaatcacactttggggtttaaaactaacgagtttcagttttaaaacatgttaaaaacctttctatttggagaaagctggaagaatccactttggggatctggcggttctcaggagctgtattacctcgggatggtctcactggttggtagcagcttttgtatgaggaggggcatggggtcccgacttaggcagagaaggctttgctgaagaggtgcaaagcccagcttagggctgggttttctacagaccaggaacaaaagcattgcttggcaagatttcttctctgctcagagaaaacacgcagattccaaagagtgagatggagagaatttgacatgtcttggtttgaaaataagtcaaaagaagtctaatattaacaatagcaataataataacaaccattaattgtgcctgcgttaggtaccaggccctattctaagtgttgtgagtgccctctgtcatttaatctccacggagtcctgaaggtgcttcccaggtttgtccccatcacacagatgaggcaatcgttctgttaagactgtccttgggtcattatgtcagcaatgaaatcggtgctgccattacta

SEQ ID NO: 221995 - DNA, 394 bp, Homo sapiens
gaggggaaaggggaaacattaccccaaaactgacagcaactgaaggaatgagaatctgcattcgccgtgggtctgagaggctcaccctgcttccaaccaggacagtggagaggggacctgaggtcagagacaccgtgacgggcgtcttggaagttaaaaaactgagggtgagttttgaaataaattcaacaggtcagtggttgaaataattgtatttggttacctaacagagttaactatcaaaaacaattcttaaaaattacatagtagcaaagaattataaatgaaataatgtgcaacattattacatttgtacatctcaaagaaaggggcaattttccaggaaaatgtggttttccaaaaattgtctcaaaaggaaacctgaacactttaa

SEQ ID NO: 221996 - DNA, 697 bp, Homo sapiens
atatgatggcacgaatgacacttgaaattcttagggaaggagaatggtttacagatttcagaaactgaattccaaccgaatggaattcaggaggcctgaatggtcatccgagcagtgctgtggtctctgtcctgcctacatttaccctgagttacggtctgaggtgaagatgtccaaactctgaccctggtctcctcctcctgttgcctctgcaagcccagctccttgacctgcctgcgcaaggtttctgggtctaggaatgctgctttcatgttactgtcctggttctcaagcctaggggctctggtctgcagaccctgactcactgggactgtggccaaatactcctgcccatctagattcttctctcccacaattctggaatctcccgcccacagtcatgtaagattttctggctgccaccgtattgccagatgctcacagacctatcaggtcacttgcaaggaccctgcttctggcctcctgccctaccctgctgcagtaggatgcacaaggaaggtcgcttggccctgagtgtcaccagcagtgctagtcagtctgaaaaagtgttttctggctgggcacggtggctcatgcctgtaatcccagcattttgggaggccaaggcaagtggatcacgaggtcaggagatcgggaccatcctggccaacatggtgaaaccccgtctctactaaaa

SEQ ID NO: 221997 - DNA, 538 bp, Homo sapiens
cagttggtacacaatggaatactattcatccttgaaaaagaaagaaattctgtcatttgcaacaacatggatggaattggacaacattatgatactaagtgaaataagtcaggcacagaaagacaaacacagcatgttcttacttatacgtggaatctacaaatagagaattcacaaaagcaagaagcagaatggtggttaccagaggctggaggatgggaatggggagatggggagatgatggtcaaaaggtacaaaggcacagttagacaagaggaataagtttttcttaatccactgcagtgtggtaaatatagttaataacattatattatacatttcaaaatcgctgaaagtacatttcgaatgctctcaccacaaaaaaataagtatttgatgtgatgggtatgttaattcacttgattaattattccacattttactcatgaatcataatttcactttgtaccccataaatatacactataatttgtcaatttacaatatgaaaagtaaataaaatagaaacaagtaagtg

SEQ ID NO: 221998 - DNA, 471 bp, Homo sapiens
acaactcaaattcggtttttcacatttcacaaaaattataaacaatattttgcctgttttaatggattagatttttaaatatgcacatatatagccccagagatattaaaggctgcagttatgttttagtaatgtcattttcaaagccagccagcagcacatttgacaggaggttttatgcaatggcttcatgctcattctaagtagagataagcctggaacattctcagtgaatctgaaagagacctcgccataggcactctcagaattattaaaatgctctccccatggtcttttgtgctgaacttcaatggcagtgtattatcctttcccttttttgttcttttcccaaatgaaaaattgactccatctttaaaacaccaccaaggtaaataacagcactatacacattaagcatgtaccttcagggcagaaatgctgttggcctcaggttctgcagtcccctaaatg

SEQ ID NO: 221999 - DNA, 479 bp, Homo sapiens
tggcacgagaaccctcagatgggtctttgcaatcagtggaagcccattaatcatgatgcttgccccagattttgaaaatttccagctctacctgccaatttgaaaattaccctgtggagtattggttgaatctacctttcatgttcaccatcttcatttatgtcgttcacatcctgaattgttaaaagaggtatcattgttaaatgttgctaggtgaacaaggaatgtacttcttttcatccgtaattgttgctatttcatgcattattatttaactcattgaatttttaatgtttacgaaataagttttagtgcaactgacttcctgacttaagatttatgtgtagggctggacacagtggctcacgcctgtaatcctagcactttgggaggccaaggcgggtggatcacttgaggtcaggagttcaagaccagcctggccaacatggtaaaacccggtctctactaaaaataccaaa

SEQ ID NO: 222000 - DNA, 648 bp, Homo sapiens
gcaggcggttgcagcctggaggtgatagttgcaactggggttctctgggagagggaagccagggatgggtaagtgcagggcccaggaggctttggttctcagaggccccttcccttgaggcagggccctcaggccccacaaggttatattcagataggatgacaacctgtgtacagggcttttttgggaaagcactattgcataaaactgtttctcaaaatccttgatagtaagaatcacctggacagttgttatgtacgtggaccagcatctatttccctaaaattctaattcatcaggtgttggttgtggcccaggtatttgtcatagtcattgtcctcctcctcctccttctcctcctacttctccttccccttcccctcctttctgcttccccttctctctccccttttctccttcctcttcttcttccttatccctcctcctcctcctgttcctccttctttcttcttctttccttccacgagattcttaccatcaggaaaatgatgagatcatgatctctttagataacagaactgtgagagggcaaggcgcactgaggtttgcactgggcttgatatttgtatggaatgaagtatcatacttcattcactgagccccagtttttctatttgtaaaatgata

SEQ ID NO: 222001 - DNA, 364 bp, Homo sapiens
tatttccagcctaaaatgtgcatgtggtgcagcttcaggggaggtgattgatcgaggccacgcccacctcccccccgcctgtttactccttggatgggatggtgcatatgtcttgcttcttccttaaaatgggcctctctcggcctccataccacagtccccgggctgggagaggggtcgtggtatagaggtggggtgggggccgaccagcggcgtttatggggaccagccgccaccaggaactgttgctaggcattttatgtatttcccagaggcaagagaacatagctgtgatgtggccaggagtgcgcctcaaaaccacgtgcaaataataaatgcggaagctcccgtttcagattttaaa

SEQ ID NO: 222002 - DNA, 379 bp, Homo sapiens
ccctcatggggcttatgatctctggaagcactgctttgcacagggaagtagcaccaggagggggtaaagaaagagggactttggagccccaagattggcaaaaactatagctaatgagagaggtgaactgtagagtctagataatggggaaggagaggtgccagagcaagaagggattctcacagggccctacgggtcagtcctgaattggctttactagaactcaggcccagcacaatggctcacatctgtaatcccagcgctttgggaggccgaggtgggtggatcacttgagatcaggagtttgagaccaacctggccaacctggagaaaccctgtctctactaaaaataaaaattagccgtcatggtggcacacg

SEQ ID NO: 222003 - DNA, 283 bp, Homo sapiens
aaacactgcacaagctgggactgagggatattctacataagtactggtccagatgcttcaaaatgtcaatgtcaagacaaaggcagaggaactgttccagtctgaaggagaatgaagaaacaggacaactgaatatgatgtgtgatctaggactggactctggattgaggggaaaaactgctataaagcatattatgaggatagttgctggaattcaaatacagcccatggattaggcagtagtactgtaccaaaattaagtttcctgaatttgatcattgaa

SEQ ID NO: 222004 - DNA, 902 bp, Homo sapiens
aggatcatctgtgaatcctacaatgatgtccttttagagttaagaaagtaaaactggtttatgccgaaattttgccctttaacaatcagcccatagtgtggtgttataatggaagtccattatatctagattgtttaaaatggaactatgcatttacacacatataaagtaaaactcgacaaattattctagccacagctttttcccaaataattattaacaaagcctgactctgtctcattgcctgtcttagtgaatgcagttttgtccctatccccacccaacaacaacaacaaaaatacttgaatgtagataggctttgattttagaatatattgataagtagattttacatataaaatattctgcatgggaagaaattcccaatgtaaacactgaacaaattccagctggccagtgctgtgataaggtttcggaggaatatgtacatctaccttgccctagatgaattttacacttagtttaggacaaaagattgctaagatgacagctagtggaccatatatgagaataataaaataaagggttaacttatattgcataaggtatgggttcatagaatgtaatggatcagatgtgaaggcagagttgattctccttgcttagagtaggactttgcacatgctggtgttcaaaaaacattcgtcgctaataaaaatactagtatcatggaggcccactcaagtcctttttggaattaaatagaaagtcaattagtgtcaaatatctcaccgtgtcttaataaggactagcttagccgggcgcggtggctcacgcctgtaatcccagcactttggaaggccgaggcgggtggatcacgaggtcaggagatcgaggccagtctggccaacatggtgaaaccccgtctctactaaaaatac

SEQ ID NO: 222005 - DNA, 818 bp, Homo sapiens
aggatcatctgtgaatcctacaatgatgtccttttagagttaagaaagtaaaactggtttatgccgaaattttgccctttaacaatcagcccatagtgtggtgttataatggaagtccattatatctagattgtttaaaatggaactatgcatttacacacatataaagtaaaactcgacaaattattctagccacagctttttcccaaataattattaacaaagcctgactctgtctcattgcctgtcttagtgaatgcagttttgtccctatccccacccaacaacaacaacaaaaatacttgaatgtagataggctttgattttagaatatattgataagtagattttacatataaaatattctgcatgggaagaaattcccaatgtaaacactgaacaaattccagctggccagtgctgtgataaggtttcggaggaatatgtacatctaccttgccctagatgaattttacacttagtttaggacaaaagattgctaagatgacagctagtggaccatatatgagaataataaaataaagggttaacttatattgcataaggtatgggttcatagaatgtaatggatcagatgtgaaggcagagttgattctccttgcttagagtaggactttgcacatgctggtgttcaaaaaacattcgtcgctaataaaaatactagtatcatggaggcccactcaagtcctttttggaattaaatagaaagtcaattagtgtcaaatatctcaccgtgcccggcccataaatatttcttagtttgtaaaaatgtaacttaaaaacctaaaatatcaaaa

SEQ ID NO: 222006 - DNA, 629 bp, Homo sapiens
tctaagctcaacacttaatggctttatgaccctaaacagttacttaacctttctcaacttaactttcaatatgtgtagtattgcctatcttagagggttaattgcatcacagggagattttcattgaaggttgtttccctaagtaacttggtagctgctttgaagtttcactaagaaatcaacttgcaaaaggcagataataggagaaaagacatatacatttatttaacgtatgtacatgggatcctttagaatgaagaccaaaagatacagggggaactcttaatttttatgcttaggttcaacaaagtatggacagctatgtagaaacatgattggacaaaaagtgtatgatctaatgaataggttgagtggggaaacccagcaagtcctgtctgtctagattcttcttggcctctctgagcacacagttcttccttctgggcatggggcaggaccctctctggaatggaagggtcttatgagctacagccaaacaaggtaggccagataatttctttatggctggttttgccacagaaagtcagagggaaagttaaagtaatatttttaggttttatggctggcttgggggaacatgggttctggtttccatgacctgccttgaa

SEQ ID NO: 222007 - DNA, 476 bp, Homo sapiens
gaggagactgcgcttgaacttgggtgggtggaggacttgggtaggtgaagatagaaaccaggtagaaaaagaaggaatgtgtgttagtatttgtcaccactgagagcggccacttcaatccaccccaagtgaggtctttgtagttttgtgtgctaaggggatgggggtccacttataccttgttcatggccagggatgtatctgaatagcggaaatgcctgcagaaaggctacgtggtttcttcgtaaacaaccatgccagtagaaggcaggggtaagagtaagacttactcttcactggacactctcttttgtccttttataattctgcaccaagaacatgcattacctttaaaaaatcagtacaatttaattttcagtaacacccacagcactcactcaaggtcaccctgaggacctcattttgtgaatatacagtgtgcatgatgctgaccaatgccatctagaccaaaaaaa

SEQ ID NO: 222008 - DNA, 263 bp, Homo sapiens
gcacgaggcactattgacattttgagtcagataattcttgttcttgggggctatcttcagctttgtaggatgtttaatagcatctgtggttcactggatgccagtagcacccttccttaagttgtgacaatcaaaaatgtctccagacattgtcaaatgtcccctgataggtaaaatccccaccactacctctagtgactccacccctgttgagaattaactgttctaggataagaatggaatgaaactataacatcaagaaa

SEQ ID NO: 222009 - DNA, 515 bp, Homo sapiens
ctcaacataacatagctaatatatgacaaacctatagctaacatgatattgaatagggaaaagttgaaaacttttaagatctggaataagatgaggatgcccacttttgccacttctattcaacatagtacttgaagtcctagccagagcaggtaggcaagagaaagaagtaaaagacatccaatgtgggaaggaaggagttaaattgtccccgtttgcagacaacatgatccaatcttatgtataggaaaccctaaagactcttaaaaaactgtcttaggctgataagtaacttctgcaaagtttcaagatacaaaatcaatgttcaaaaatcacaaccattactatacaccaacaatagacaagtagagagccaaatcatgagtgaactcccattcacaactgctataaaggaagtaaaatatctaggaatatttaacataatggttaacaagggaagtgaaggacctcttcaaggataactacaatccactgcttgaggtaatccgtgaggg

SEQ ID NO: 222010 - DNA, 712 bp, Homo sapiens
ctcaacataacatagctaatatatgacaaacctatagctaacatgatattgaatagggaaaagttgaaaacttttaagatctggaataagatgaggatgcccacttttgccacttctattcaacatagtacttgaagtcctagccagagcaggtaggcaagagaaagaagtaaaagacatccaatgtgggaaggaaggagttaaattgtccccgtttgcagacaacatgatccaatcttatgtataggaaaccctaaagactcttaaaaaactgttagaataaaatttagtaaagttccaggatataaaatcaacatacaaaaatcagtatcatttgtatattaatgcattaaaagcaaactatctgaaaaacaaatcaagaaaacaattccatttaaaatagctacacatacacagaatacctgagaatagatttaatcagggatgggaaagatctctacattgaaaacatataaaacattgatgaaataaattgaagaagatgcagataaatggaaagatattttgtactggtgaattggaagaattaatgttgattacatgtgtatactcctaaagtgatctataggcagttcaatccctgtcaaaatacccgtaacattctttacagaaatagaaaaaacaatcctaaaatttgtatggaatcacagaagaccctggatagccaaagtaatcttgaggcatcacacta

SEQ ID NO: 222011 - DNA, 826 bp, Homo sapiens
gtctcagacataacgagggggggtctcgctggactcgccgggaacccgtcccgttccgacacccccggaggcagctgtcattctgttgagactctcaagcagcaccagttcaagaggcccatgttgctaagaaccaaggcatcttgctagtgagcagctgaagcctcctatcaaagccatgtgaatgagccaccttagaagtggatcgtccaaccccagccaagcctcagctgacagtggtcctgactgacatcttaacttcaacttcagaagagactctgggccaaaaccacccagttaaaccacttcctaatttctgacccacagaaactgtgatataacaaatgtttgctgttttaagccactaattttgaggataatttgttatgcatcaatggataactgacacaatatcactttgcccatttataaattatttttaagtgatttataagagccttttatatgttaaagatattaattaataatcctttgtctgttataaaagtctaatctatttctgtttattgcctttattatagtaatacaaaaaagtgttatatatattcaaatatattattcatttccattttcattttgccttatgtgtcatatttagacatttttaacctactacaatattctcaataaatatttacctatattttcttttgttaactttttctttaaagtcccaacatttaaatcatctggaatttatttggggtttggtatgtgatgaaaaactaacttttctttttcttttttttgtgttttcaccaactttatagccagttgttaaggcataattctgcatgattaaaat

SEQ ID NO: 222012 - DNA, 3435 bp, Homo sapiens
aacattctttcttcctcttggcttatattagggataggggatgtggtttgttacaaaggatgagtattttgatagcttctcattccttgaactattctgcaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaactacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatgagcaaaaaaaaaaa

SEQ ID NO: 222013 - DNA, 333 bp, Homo sapiens
ccaaaaaagtaaatataaattttatagttagaaaataagaataagtctgggtgcagcggtttacatctgtcacatcagcactttgggagattaaggtgggagatcactgggatccaggagttcaagaccagccagggcaacatagcgagaccccccacccccatgtctccaagaaaataaaaatagctaggcatagtggcacatgcttgtagttctagctattcaatgactcaagaggcaggaggattgcttgtgttcaggagttcaaggctgcagtgagctacaatcatactactaaactccagcctgagtgacagagcaagaccgtgcctc

SEQ ID NO: 222014 - DNA, 649 bp, Homo sapiens
cttgggttgagtaagtgctgaccagaacaaggcacatatatgagaaataaggaagagctgaaacacttggcctccagtgcagtagggcccagaaagtggatctgtacatgaagttcctccagatacatcagcaataggggtttgaagacttttgctcattcatctgatgctccacatactgtcctttctctttctcttccaacacatgtcatgttcctccctaggatattcgttgttgggtgaatacctagcatcctctttttatgctttagggacaacccagtctttttttgtgaatttctttcccacatggtagggagacacaatgaggctgataatcagtttcttctgctgtctcttgagagcagtatgggcatatgacctaagctaggccgactgaactcttattctcccaccaccaccaccccagacaatgagtcttgagtagaatgatgcaaagacgggaaaacgtaggtgggggttcattcatatcaacatagtgaagcagtcctggtacgaccatagttcttgttactccatagctactccacacctgccctgtgtcctttccttttctgagctctgtctgataaagctgagtgttcttgtgcagtatatgtctatcttccttgggctcagtttgccattc

SEQ ID NO: 222015 - DNA, 455 bp, Homo sapiens
atattcttataacaaatataatacataggtataaataaaatttagaatatacagaccagcaaaaaaaaaaatgaaaaaaaaaaccttaaagttcttacaataataagttatacatgtcttataaaacagcataattgtgctgtctttcaagatgttcaaataaacattgtttctggatttcctcctcctccctccatcctttaaataattatttgtagtgagtagtatctgtcttgcctgacatggaaagcagatggagatgcgtaatgcttttgctaaatctctaaatgttctcatttttgaaaaacagtaaccaatggtaaatgaaagaagtattatcactgattcctctttctaatcagtggggttttctatttactctgaccacctatttcgttactcttactggatgccaaatcattacaatgtgatttggggaaataaaagacattata

SEQ ID NO: 222016 - DNA, 598 bp, Homo sapiens
agatcttaagtttaaaaaattattctcttttaatcacaattctttagttttatgctagatcttcttggactagaggtgcatttttaatagtctaataaggatctatatcactggcatgtagatttttgttctggcatgttatttttctgaggctatgttttcatttatccggttagtaggggaatcagttttcttaagtctaatcataatcaaaagagtatcacacaggattactttgcttaactggtcaaaatttgttcctcataaaataagaaagaaggaagaaattgtctttttttttttttttttttttttgctttaaaaaatcctttgtattttagttgattataattatgccaagctttaattttggccaccagagccatacaattattagattttgctaatgagttagaatgatatttctgtaatataaaggaaatggttaatttcatttatatcttttagtgttttatctattgaaatcgtcttctattagacattgctttttcctctatgaaaagatgtttccccatttatgtaagtatatgaaaatctttgtttttgctttatttaaatatacaacttcatcaaattg

SEQ ID NO: 222017 - DNA, 365 bp, Homo sapiens
accccccaccctcgcccccgccaaatcacagtggttttacagagtaaaagctcagttctcctttgtgagaagtccagtttagctaaaacatctgggcaaattgtagaccaagatctctgaggaggggagggaggaatggaagaattgactatcttggtcagaaaatgccacacatcattcatgcccacaccctgttggcccagatcaatcactgccaccaacctaactacctggaaggctgctgggaaatgtgggggagtcccaggaatatttgacaactcctattgtcactgccacacaaccctacttgggttttctaatttaaaagccagaaaatacatggctttaaagagatatgtaatcca

SEQ ID NO: 222018 - DNA, 405 bp, Homo sapiens
ggatccccaagcatgtgccgctcctggattgcttataaactacattcccatcagaatgtctagtgttctagacatagtattcccatcggaattcccagccccagagaataggcatctttttttctcattttgctggaggtgctctgttaaaatgccaacgggactggaagtgaaaccctattagacactctctattaatgataaattgccagaaatttcctaccctgcagcatctgtctgaaaagaaatgccaagtaaggttcaagtttaataactgggccaaggtgaagcacattagtcctgattccatgtgggctaaactgtaggatgcaaaaaggatgtcataagggagcaactctcggacgctgtgttgagaagcatcaaagtacttagtttttgaaaaaa

SEQ ID NO: 222019 - DNA, 625 bp, Homo sapiens
tgttcatacttttggctattataaataacactgctatgaacacatgtgtgccagtttttgtgtggatatatgttttcatttatcttgggtgcattgataagagtggaattgctgggtcctatagtagctccatgattactcttttgaagtactgccaaactggttcccaaagtggctgcaccaatacacattcccaccagcaatacatgaggggttccaatgtctctacattcttaccaacacatggtattatttgtgttttttgtacaaccatcctagtaagtgtaaaatgatatctcattgtggttttggtttgcgttttcctaatggctaatgattgagcatctttttatatatttattggccattcatatatcattcttggaggaatagctgtcatatttttgcccatttttaaattgatttatcttttcatcactatctattatgttctttcacttaatataatgttttcaaggttcacctatgttatacatgtgtcagaatttccttccgtttgtaatataagttttcacattatgaattcttgtattagttcttatattagaactgagttgtattctaattgagttcttatattaaaaagaatcgagttgtaagagtt

SEQ ID NO: 222020 - DNA, 856 bp, Homo sapiens
atattttctgcaaatatataggagaagagtagtaaggtgtttgtgaggcagaataatggtggattccaagtactatgatcattgatatcaatttttagaatgtattagatgcatctggagtcaataatttatctggagaagtttttatatcaaactgataggtaatattaaaaaccacttagcattttggaagagaaactttagtaacaaacactgactgttttgtgtacatttattttctcacatcagtgattaaatttctttttatgtagaaaacttaaggtgcttttgtttatttgtgtaggtgagtatattaaggctcaggttcagaaatgtttatgaggatttctgtaagtgttagagaaggaactaagttctggtctagggaatattattaccagagtttatcatgtggttgtgtttgaggaggagatctaccaactaatcagcagttctgagatgaatcgcatagggcctcatgcgtcccttttatgggagaaagttattttgctttccggtacaggatacagctgtgcttctcctactttgtatttgccatatacggatagatacaaaacctcatgactgatttttccctatttattttgagtggctctgtataccattttcatgtattacttcatttttctgtttttcagttatgttctctgttttcgtatatttttggaagctagttctaagtcatgttttgtaggaaataagcaatcttaaatacatgcataggggatttctttcttctgaggatccttaatttcttctatttttaagattcaaattgaatgattaatcagtaacagtttatgttttaaataaaagtctttaaaatgttaaatat

SEQ ID NO: 222021 - DNA, 506 bp, Homo sapiens
cgtccttcatcatacctacctccctgatctatttttgtcattaggttgatctaggttagcactgtatactatcttcataaaatcaattagtgtggtatgaaccttctgattggtattagatgagttcctctataaaccagtaatatttaaataagaaagaatgcagttaggaggcaattgtaatagccctggcaaaggacgatggagccttgaaccaaaatactggttgtagagatggaggaaaaatcaggcagtatttaaatgatagaattcgagacctgttgacagatttcagactgaaagagttaaaagtggctcttgggcttttgctagtacctttagggttgcctgggagtatagaattcattttcatatgttttgcttgtcatcagccaggggagctatatcctgtagacagccagaaataaagacatttattgagcgagatgggtagactaaagatatcttcgttgtaagtgggtatagatgaagtggccaaggagtgg

SEQ ID NO: 222022 - DNA, 437 bp, Homo sapiens
tcagggtctctctctgtcacccaggctggagtgcagtggcacaatcatggctcactgcagcctcgactttccgggctccagcaatcctccaacctcagcctcctgagtagctgggactacaggtgcctgctaccatgcccggctaagttttgtatttttggtagagatggggttttaccatgttgcccagagtggtctcaaactcttaagctcaagtgatccacccaccttggcctcccaaagtgctgggattacaggcatgagccaccgaacctggctattattatcttaaaaaaaaacaacagtttattataaatgttttaagcaatcaatacatcactaggtttaacaattactagcattcttctttgccaaagatcttaaaggacatcctagacttcgtggtcgacgcggccgcgaatttagtagtagtaggc

SEQ ID NO: 222023 - DNA, 401 bp, Homo sapiens
cctggtccaatagatgtttattattattattactactatcatgactggcacttgacaggggctcaaccattggttggggtagtttgctctctttattcttcatcccaggtaacccaggctatatattagactccagtgggtactcttaaaaaatatgcatgcgccaggtatggtggctcaatcaatacatcactaggtttaacaattactagcattcttctttgccaaagatcttaaaggacatcctagacttcgtggcaaactatataaggcaagtaacttcactgttaaatgctttagtggccatctgtgaaaacaagagggtttcttgcataaccatgatgccgtcatcacacagcaggctgatgtgaagattgagggagttaatagagggaaagccc

SEQ ID NO: 222024 - DNA, 453 bp, Homo sapiens
cctggtccaatagatgtttattattattattactactatcatgactggcacttgacaggggctcaaccattggttggggtagtttgctctctttattcttcatcccaggtaacccaggctatatattagactccagtgggtactcttaaaaaatatgcatgcgccaggtatggtggctctggctattattatcttaaaaaaaaacaacagtttattataaatgttttaagcaatcaatacatcactaggtttaacaattactagcattcttctttgccaaagatcttaaaggacatcctagacttcgtggcaaactatataaggcaagtaacttcactgttaaatgctttagtggccatctgtgaaaacaagagggtttcttgcataaccatgatgccgtcatcacacagcaggctgatgtgaagattgagggagttaatagagggaaagccc

SEQ ID NO: 222025 - DNA, 224 bp, Homo sapiens
ccctcttttcagagcaggataatccagcttcattttcgccttacattcttacgaggttagtataaataatttttttaaaacttggtatttattagataattttgagtaatcttaaattacaggctgactttgcatattgaggattggggtctatcctccatgtggggagaaaagaaactatacatttgaaattgtttccaataaataaagctgttttggcagta

SEQ ID NO: 222026 - DNA, 915 bp, Homo sapiens
ccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaataataataaagcttgggattatctatgctggagattcagaaaaacactgacagatctgccatagacctccagagctctccgactgttcggttaccctggagaaggtttctaacattctaccttgtgtgatgggagtagaaagtccagagaccacccaacaagtcagcccttcctacacaaaaactcccaagaaatgcctcagctaataagccccgaaagagaaatagtgattctccctgaataaagtcaagatattgatgtgtaaa

SEQ ID NO: 222027 - DNA, 635 bp, Homo sapiens
ttacattgacaacaatatttttgctacattggctttataagaatttctctttagcatcctctggcaatggttaggctaaccattagtctgacttagtaataactaagcaatggttagtcagactccagagaaagttactaggatatattggacatcccagcagaaaacatttccttcagaaatgactttagggacatgtgtccttgcatcattgatctgattggaggagaccagggttcactgtgacaatggaaggaacaaggaattaatagctcaagagcatgactgctttcaagaaagtgggaccagtggcattgtagccaccataatcactatatttaagtaacttttcatgtgtatgcttgtttccccaagaaaatgagaaataaacattcaactagaccagtttacatattttaatacactaaatgccaatctttctaaaagtttagatctattaataaaatatgtatttcttgttaattttttcaaactggttatcaccacatttctgggtcataatcttctgtatgtgatcatcacacccattcttactgattatgacaccatgaccaaagaattatgatcatgtttcatttcattttgtttcaagaaagagacaggaaatgcagggg

SEQ ID NO: 222028 - DNA, 423 bp, Homo sapiens
  misc_feature (58)..(58): n is a, c, g, or t
  misc_feature (60)..(60): n is a, c, g, or t
  misc_feature (89)..(89): n is a, c, g, or t
ggggttggggggcccccggttaaaaaaacccccaaaaaacttttaaaaaccaaccctncncaatggttaggagggttacttcaacttgnccaattgtaaaggggggggttttccccaaattttagattgctacaaggagggagaaagaagaagatcaaatgttgtttaaaagtctttttttttctttttaaatattcttattccactgagttgtagctgtagattttggccgggagccagacaatcaagatttagtattttgaccagctgtgatctagtaatgtccctcagaggaaacattttgtagggagggaaagacacatatttgagactgtgaattgtactctgtcctcatactttacagtgtgggacctggttgtagacagataaaacaagtacaagtgaatctgaaagagaattagg

SEQ ID NO: 222029 - DNA, 498 bp, Homo sapiens
aagcaatcctccacggggaaggctggccgtgggaagctgtccctacccagtgcagactcgagtctggcttgagagccctggcccacctctggacagggtcctgatccaaggctggcgcttcatctcagggcaggggcaaggtggggggaccctgcctgtctgcctggaagacacccacatggcttccttcgattcgtcctgcagatctccctggcatcactttctgagacaccgtactcaaccccctccaacagggaaagcccccgcgctatgtcctgactcccccagctgcgcctggctcccccacctgtgcctggctcctccagagacacctgttccagcccagtgtgcggtgtgctcattgtgccatctccttgggtggagtgatggctccatgagggcaggcaggttgtctactctgttcactgtttaaagcagggccctgcccgaaggaggtgcgcaataccttccgggcaaataaatgaatgaatggatgaa

SEQ ID NO: 222030 - DNA, 303 bp, Homo sapiens
acaagagtgaaattccatcacacacacaaaaaaaactatgactacatgcaaaaacatgaatcttacaaaatgttaaaaagaaagaaaccaggctgggcgcggtggctcacgcctgtaatcccagcactttgggaggccgaggcgggcagatcacaaggtcaggagatcgagaccatcctggctaacatggtgaaaccccgcctctactaaaaatacaaaaaattagccaggcatggtggcgggcgcctgtagtcccagcaactcgggaggctgaggcaggagaatggagtgaacccgggaggt

SEQ ID NO: 222031 - DNA, 220 bp, Homo sapiens
ttacctgatgttttcctgccagaacaccatggactgttacttgccttgagttggaagcagtttgcacttacacctgtaaatttattcatcctttaaatttatgtgagggttttttgtacacaattctcgattctttaagacatgataacagactttggttttctactgttatgtgagaacatgaggccccagcaacacatcattgtgtaagaaaaaatga

SEQ ID NO: 222032 - DNA, 432 bp, Homo sapiens
ggtgtcaggattcagcctattttaatgcaggaagaaatgaaggtcctgaaaggttaaatgtctcattcatcttgtccccctagtgagcagcatggctgggactttaacatcgggttttccaaccccaaatcccaactcttttagttgtaccatgttgtttcttctcatacaaagtactgtggatgggcagaagcttctgtgagtcaatacaaagaactgctaggtctgagtactaataaaaagatgtaggttaagtcagtagacttgcgcccatctgaaggtggtctctagttttctgcctcagggctctatcatgatgctgttctgttcaacagaactaaggagaacaataggttcacgttcaaaaactctttctcacctaaacacacagatgggcagcttctaataaagttggagctttgtaggaatata

SEQ ID NO: 222033 - DNA, 605 bp, Homo sapiens
cttattaaatatatgatttgcaaatattttctcccattccataggttgccttttcactcagttcattgcttcctttcgtgcacataagttttaaagctggatgtagtctcatttgtctattttgcttttgttagctgtgcttttggtgtcatattcaagaaattattgtcaaatccaatgtcatgaagctttttccctatgttttctgctagttttgtagttcggggtcttatattttggtctttaattcatttaagttttatatacggtgtaagataagggtccagcttctttcttttgcatgtgaatattcagttttcccagtatcatttattaaagagactgtctttttcccatttagtggtgttggtatccttgttgaagtttgcttgaccatatgcaagggtttaaatctgggctgaccattctgtttcattgataccacactgttttgatgactgtagctttgtagttacttttgaaaccaggcagtgtgaattgcccaaattggttctttttcgaacttgttttggctattcaaggtcccccgagattccgtatcaacttaaaatggccagcctgggtgacagagtgagactccatca

SEQ ID NO: 222034 - DNA, 533 bp, Homo sapiens
  misc_feature (405)..(405): n is a, c, g, or t
tgaacactctattttacctattgatttatgtctgtctttacacaaatatcacattgtattgaatattatagtaatattttttgaaatcagggagtgtaagtcttccaattttgttctttttgaaaactattttaggctgggcatggtggctcacatctgtaatcccagcaccttgggaggccaaggcaggtggatcacctgaggtcaggagtacgagaccagcccaataaacatggtaaaaccccatttctactaaaaaaaaaaaaaaaaaaaaaaattttttcagtttcagccaatcctgccaggggggaatgcgggctccatgccagcagatttctagatggttcttgagaagctgcagacatcagtggttggtatgaacatctcctgatttaaaatctgtgnccacataataataatacaaagtcctgccaggagtttgctgcatgttgcaggtgatatgggaatgccttcttacagagagctccgagagggtaggttaccttaccaaagggccacaggtcagagatgcc

SEQ ID NO: 222035 - DNA, 541 bp, Homo sapiens
  misc_feature (233)..(233): n is a, c, g, or t
agaaagggaagaggaatacacacatttttagctgacggacttggccccagctttgcaggctaactgaaactcccaaggccttgagatttttgaaaactgccatatttcctctagttgaagactcattttatattttttcacatgttaacatttatgaaattgggatgtgtaatgtacgccctgtcaaaaaattttccagcagccatttagaggagtgacacgtccacgtggcntacctggcctgtggccacacctccttagccagcttcgtggaagtatctgttcatccattttgtcactttgttttgttattttcattggtggcacagcacactgttaacttagattcatgtccctaattgccactgaaagtgtctttcacaaagataactctgctttacagcattggagcaaaagtcaccatgcgtgcaaaagattgcctggcacatgccaggcattaggcatcgcccccactgcacagagtaaatgacacacttttcaaagcaaggggaaattggtatgactacttcatgcaccatta

SEQ ID NO: 222036 - DNA, 467 bp, Homo sapiens
aaaaagcagcccccacatcatttcttttctaacaaaaatcaacctgaaaaatcaagctgcaagcattgatacacaagctggaagcttgcataggtgaatactggcagccgtgccgataccaaagagatacctggaagccaggtacatccaacatggaggttttctcctcccttctctttgttgccaaatgtgcagatgtcatggtgctggccaggtggagatcccacctgtataataaaagattagggtgggatggccagcctaatcacgggctatgtaaatggcacacctggtccaaccaatcccatgggccctatgaaaatcagacactgcctttctaagcccctctataaagtcaactgcatctcaccccaaacctggaaacccactttggttcccttcctctgcatgaggaagctctgtcttctttctttcactttaattaaagttctgctcttaaacccact

SEQ ID NO: 222037 - DNA, 496 bp, Homo sapiens
tggttcgcattattcttaacagtttacttatttggtaaatctccccatatgtaaccaatcttctgcagctgccaccacctttcctcctggggctgccctcctcagctgttagtgctctagcatcctgtgccaccacccccatccccatatggatacctttctccctgagataccctgctctgggcttccacagcatccctcttcctacgtttttgtaaacgtaggaagcctaccagattggacctacctaatggctttgaattttcaggaaggagaaggcgaagagcctcggctactcttgaatgatgtaaaataagacttatcttccttccccatggtccttcattatttaaaaatagccattatgtcattcctaaacattctgttttccacctttaaaagctcctagttcctccatgtgtttacactaatgatgtttttcttgtaagcatctcaaagagtcttccaaacatattatatctttgtgacagatgaa

SEQ ID NO: 222038 - DNA, 443 bp, Homo sapiens
aagaggtctttatgtgctaggcttgagtatgtgaggtattaatgatttgctgtgtaacaaactacctcaaaatatagctgcttaaaacaacaaatatgtattatctcatacagtttctgaggctcaagagctctagctgggtggttctggctcagcatctttcatgaggttactgttagtggtggcaaatccacacaggtctgcagcaacctcaattcttgcctcctcagaagaaagaatttgactgaggggcataaggcaaaggtagagactgaggcaagttttagagcaggagtgaaagtttattaaaaatcaggctgggcgcagtgtttcatgcctgtaattccagcactttgggaggccaaggcgggcgtatcacctaaggtggggagttcaagaccagcctgaccaacatggagaaaccccgtctctactaaaaaaaa

SEQ ID NO: 222039 - DNA, 461 bp, Homo sapiens
  misc_feature (115)..(115): n is a, c, g, or t
ttttagggctgaataatactccactgtgtgtatctaccagattttctttaatacattaagttattgatggacacttaggtgggggcccctttttccccccccacaaaattctctntaaggcccttaaatttttttggggttttttacacaagtggtgcaaccaacatgggagtgcagataattacttcgatatactcatttcctatttttggggtatatacccaacagtgggattgctggatcatgtgatacctctattttcagtgtttagaggaacctccaaactgttctcaaccatggctgtaccagtagtacattaaaatgcaaatgcaattggtaaaagaacaaggcagcatgtagtacttgcacttaaaaatactaccagtttcgtaacaatttgcatttttttttgtccttggaagagtaaccacttaataaaacagatacataaaagtgcaata

SEQ ID NO: 222040 - DNA, 431 bp, Homo sapiens
tggccagccatataggcgcagaagtgtgctaccttcaacccacatatctgattgaagttgactggtccttgttttggccattctcactaatcaacaatgttgagggggtttctaaatgtgatacagtacaaagcataataataaattagaaagagtggtctggtcctaagaaccttgtcaagtaatgggcaaagcaaaacatgtggccacctaatggaaaaaccatctgtagaataaatttttgaaaattggctcaatgttcaacgtgtagttagtttagaggcaataaagaaaagtcaaggtcaatagccttttccatgacacacatcatctcttgggatatcactttgtcaagtatacaattcagtatttagtatattcacaaagttgtgtaactatcaccactacttaattgtcgacgcatgtgttta

SEQ ID NO: 222041 - DNA, 829 bp, Homo sapiens
tagcagcatagaattaccgtagtaaaatgctgccaattttttgttatttactgtatttcaaaatgaagaaaaaatgttttgaagcccaggcctaaatctttgcggttgctgatcaaataatctctgaccaaacaatagtattctgtcctattagtcactcactaattcattaccattttcaaacaagttctctaagtcttacttaaacttagtacttcttgaagaaaagataataaaaataggggtcaaaatatctccaaatatatttttttcctaaaatgcataagctggtaatagcaatcataacaacagattccatcactgtagctgcttagaaaagatgctcatatctcaatggattcttccaataatcctgtgaaagtaggcaaaattagaattactgccaacatttaatagccaagggtcagatatatgaaattatacacttaagatcatagttagtcagggaacatccagaaacagaacccagatatttagactcccagtttagtgctctttccaacaaaccagtcttttccttaatctttttacaatgatatacaattacttggatgaagattcttagattgagcaaaaacactagcatattattttacttaagatttaaaaaaacaacctcactattggcatcatgcaagttgtaaaaacttaaatgtgcaaattaaccattatttatttttaaatatattctgataacctcacttctagaaatatatgacataagctacctttccttagaaggaatcacttaactcatttacctgatttttcaacagattatcggatatttacaattgtacatgcaatt

SEQ ID NO: 222042 - DNA, 1914 bp, Homo sapiens
gttttgtgtggacataagttttcagttcatttgagtaaatacccaggagtgtgattactggatcttatggtaagatatgtttatgtttgtaacaagattgccaaactgtcttccaaagtggacatccagatgcataaaaatgaatctagatattttgcatttcctgtaccattttgtattctccactagcaatggatgagagttcctgttactccacattttcttcagcatttgttgttggtgttttggatttgggccattctaataggtgtgtagtggcatgcctttcttgttttaacttgaaattccctaatgacatgagtttgaacagtttttcatacgcttacttgccatctgtttatctttggtgtgaggtatctgttcaggtatttcacccattttataatcaggttgttcattttctttagttttaatggttcatcgtatatttttgataacagttctttatcaggtacatcttttgcaaatattttctccaaggctgttgcctgccttgttctcttgacattgtcttgcagagcaaaaaaaatctaggctgcagttacagatttggaagttaagagcatattggtgctattgggagccgtaaaactgcataagataaccaaaacagtatatgtaggtagaaaagagaagagtgtaaggtcttagctctggaggactggtgatatttaaagcttagggtgataaggaataggaatagagagtgagaacgaggggccaggaaatgtaggaaagctaacaaagtatgttattctaggaatgaaagagaaagtgtatcaaggaggatgtgattggctgtgtcaaatgttgctggaccagtcaaataatatgaagattgagaaatgatcattgggtgtagtgatgaggtcattggtgactttggataagagctgtttcagtggagtaatgggaggaaatgcctgttgggaatgagttcaagtaacaacagaggagagaaactgaagatagcagatgtagataagatttccaaggagttttgctgtcaaggaaagatgattgagatggaaactcgaagggagagagaaatagagattttaaaaaataataataaagttgggagaaagggcattgttggattcttattggcatcactcaccagagaaggaaaaatggatgatgattcaagacagtggaagagacagagagtgtcggtcagttgctagcctctaatatgatttgtttaaattagagtggactcagccctgcaactgctcatgtcccttcctgaccccttcccatcttgccgtatgttttgactaacagatggtacatttatgagaatgaaaagaggcccctaatccagacaggtagccaacactacctggattttaggactggattttagccttcacttgtcctaaactaggtgtctttgggtacagcaaagtaatcatactaccatagcttctctgcttagtctactccaagacaataggaaaagttatttactatcctgcaatagttaaatgtacactttgtcctatagttaaatgtacactttgtccgatggcaaatagcatgataagtgggaagagagcacatttaagaactaagaatttggtgtgggaatccaagctcttctatcaactggcagtaaaatatatttgaggagagtttaaggcgtatgagtcgtcttaccaacaagtaattatgagtttagattttatttgaactatctctcttgtttgtattttataaagtaatggtgtgttaagcgcagtgcaccaaaatgtaactaagacttagtagcacctaggactcagatcttggtttttcttacaacattcgcactgaaaggaaccctggctctttggaaaaatggctgattccaaggatgggattccttatgccaaaggaaggaaatgctta

SEQ ID NO: 222043 - DNA, 573 bp, Homo sapiens
gaaactgtataagcagctggagaagctgtggaccctccctgccctgctgttgtgcaggagtttggcatgctgtgtgtgcatggaaaaagccagccaggaaagctcctcctgaagtctgtgtgacgaagatgagagctaactaacttcttgtacattttccaggctgacgtaaaaagcgagatatgtgtcctgggtaagcctcctcgtagcccagtgatgtctaggagattctgcggctcacctgtcagagggctcagcggttcccacagggtagggtcagcatgcccccactttgtggcaggcatcctggccacctcccccgcccccagggctggctcttccttagttgtctttgctgtgaactggccttaaagtgaggctggagacaccctgaagatgaagcgaccacctggtgatgtgcttcccttttaggtgtgtgtgaggtttccaaactccacaaagacatggtcagattctctactctacaaataagagtgtcgtgtgttttgtggtctacatctgtctcatggttctacactaaatcactgctttctagtcaccgtttctcctgca

SEQ ID NO: 222044 - DNA, 289 bp, Homo sapiens
tttcgagcggccgcccgggcaggtacatgtgcacaacgtgcaggtttgttacatatgtatatgtgtgccatcacttcctaaatatcaccataatctgcctctttcctctttatctccgttactcttgccttagttcaatctgcattccccgaccagtaaactgctgaggtagagggcagggatgcttcaagttatcctataacgcacagaacagactttcacaacaaaacattatctggccaaaaataacgctgagattgatgaactccacactcaaatataaacacca

SEQ ID NO: 222045 - DNA, 450 bp, Homo sapiens
agggaggccaaggcgggtggatcacctgaggtcaggagttcgagaccagcctggtcaacatggtgaaaccctgtctctactaaaaatataaaaattagccgggtgtggtggcatatgcctgtagttccaggtttttgggaggctgaggcaggaaaattgcttgaacccaggaggcagaggttgcagtgagccgagagagatcatgccactgcactccagcctgggcaacagagcaagatgccatccatctcaaaaacaaaacaaaaccaaaaacattcctaccttttaccccttggagcttacattccagagataaataagaaataggagctgggcgcagtggctttccactatgatcccagcactttgggatgctgagctgggcggattgcttgagaccaggatttcaataccagccctggggaacatggtgaaacctcatctctacaa

SEQ ID NO: 222046 - DNA, 607 bp, Homo sapiens
gctcaggctttcccagccgctgttttcccctttgtacatcgggatccgcttcgcacacttagtttctgcctagcacatgctgggtgttgtgtccagatacactaattctttttccccttcttccccgccagtcactagagccggtctggaagggcactaacgcctgggtagtccttcaaacaaaaagcgttgtgtgtcttgcttactggccgttaatagaagtttccccttgagagtggctttggttaggaaaaaggtggcaaagggcccatccctgaactgattagttgagcctgggacctgatcagaattgaggggaggagtgttaccagaattttctctgtgccccgcacttgcataagtgcttatggctaggagccctgtgtagggcacacattaccttggggcgcccttcgcttctttctcctcttgctgccccttcccggaatctctcacctcatgacgtgactatggtcaagtcatcgtttctgggatggcctgacccctggggacacgccagcctccaggagcttatatgaggctggtttaccagagtagacagtgtaaggccctgtcctggaaggaggaacatgaatatgtcctgaag

SEQ ID NO: 222047 - DNA, 532 bp, Homo sapiens
tgcgatttctttccatgtatttatcttcgcacataacactttggatgtggaagttattaaaaaggaattttacatgagaaagcatgcttgatgaagaacatctatgaattctagcacttccataggaaagtaaactgttactcaagtactgttcgcatgtgaagtaccattggcagagagaacatgggagagaagaggcaaatccttactcccttaggctggagaagtggtggtgtgaacagccagaaatacccaatcaggcagacatttatccctgcgggctatttgttgggtgcacatgggttgaagactcaggttcagacaggatagaatccttgtttcccttaggtctttgatgcctgatatgctcaagatgctctgtgtttcacttcttcccatatgtgaacttcaagatctaggcttgaaattataaaaggtggtaagaggtctctgtgttcgctaccaatcccaagatataccctacaattcaactttgcaaaggaataaaatgggtaacaaattttaactcaca

SEQ ID NO: 222048 - DNA, 451 bp, Homo sapiens
atatttagaaacagaaacctgggtgctgggtgtgctcagtgggacgagggtgtcactgcctccagccctgtcagtgaagagagctgcgtaatgtgcgtgcagataataccctatgtgtgaacacatacttcagattatctctggatctgtccatccttatatcgatgcaaagctaaacatgagttcacactgatgtctctgattctcatctagtaccacagggttcagtctaaacttcctcttatttacaaataaccttcccctccaacacaagaagcctgcctcccatggtttgccatccgttgacttatctgttcaatcccagtgtatgtgaattgttaacttgtacccctgtgggaaatttaccaacaaaggaatgatattaatgtccttttgtctttagctttacaatttccactcaaaacatcatattctgaagttactcaggtca

SEQ ID NO: 222049 - DNA, 275 bp, Homo sapiens
atcccccccacccacacaccctgtgaactgcctgccagggaagccccttgccaagaaggaaggggccttgccgtgcttccactcatgctgacatttccccgcagggctggtcctgccattgggtgggggtgctcatcttgccctcggactgtggggagagagtggaggcagggcagccccccagtgcaaggtaaccacagaaacttccagctacccctccaaccttgtgaattgtaccttttaaaataaattatttgtatccatctttggcaaga

SEQ ID NO: 222050 - DNA, 218 bp, Homo sapiens
atcccccccacccacacaccctgtgaactgcctgccagggaagccccttgccaagaaggaaggggccttgccgtgcttccactcatgcggactgtggggagagagtggaggcagggcagccccccagtgcaaggtaaccacagaaacttccagctacccctccaaccttgtgaattgtaccttttaaaataaattatttgtatccatctttggcaaga

SEQ ID NO: 222051 - DNA, 675 bp, Homo sapiens
  misc_feature (138)..(138): n is a, c, g, or t
ttgcgatatagtaacaataatgtactaagcaactatgtgccaagcacttccaagttgttttcatctaatctttacaaaaactgtaagaaatatttatttccagattacccatgagaaaaatgaagctcagaggagggnaggaacctgtcgaatgtcaccgcttgcccaattgtcacttattaggtggaatctgaaccacactacctggctccaaatctagcctttcctcttaccacagatgatgcattcatttattcaacatattcataccaaagacgcatttgccaggtactttttgtttgttactcaaccgagttgtcttccaccagaaaaccgtgtattctaagactgtaacataaatgtctgacaggatgagagagaaggtagaaaataatagctaaaggaatattttagatggtgtgtacattcacaaatcttctcctaaataagcacagataattagttatcatctcttctgagcagtttctgataggggcatgcctgtattcctgcaactgtgggtgataaagcatgagtctgatttatttttctttttggtctaatgagactcatgcttgaatgtacttttaaaacaattctgaaaataactgatctcatattgtatactctatgatactttgagtctaaggtaaaacacttaattcaactgggaaa

SEQ ID NO: 222052 - DNA, 466 bp, Homo sapiens
gaccctagattcccttgttggctagaagactctggcttctcctgttggctaggagatcctatattcccttgctggctagataatcatagatttccttgacggctggatgaacctggcttcctctgtttgctagaaggtccttgattcccttgctggctagataaatgtagatttccttgttggctagatgaccctggcttcccttgatggctagacaaccctggcttcccctgttggctagaagatcctggcttctcctgttggccagaagttcctagatttccttgttggctagatgaccctggcttcccctgttggccagatgactctggcttcccttgatggctagataaacccagatgcccttgtaggctagaagatcctaaattccctttctgggttgatgaccctagattcccgtgttggctagatgatcctggcttcccctgttggctagatgacccca

SEQ ID NO: 222053 - DNA, 127 bp, Homo sapiens
ctttgtgcctattaatgcttttgccttaggttctattttatctgattaagattgctattcaattttctttgggtcaatatgtatttgcctcatttatttctttccaatcttttattttcaacttttc

SEQ ID NO: 222054 - DNA, 646 bp, Homo sapiens
cgaccccgctgaaatacagaatggcctgctgccttctcacagaaggtctactgttccaagcttatttttttttgagtgagaagaaaaggtcttttgccactgttttcagactgaaatttaaatttcagctgccttggatcctatataataaaagattgagacacagaaattgttctattagacttgaaatttcaattgcttttacttcccagtttgtagtagtgtttgaacctaaaatcctatgtgtgtttttagttaccttttcaagttaaactttcagaaactatctgcttaacttaaaaatttactcttgttaattgcccaaccacatcttacttcatgtgtcaaaatctgcctgatatttttaatttggaagtccacagtagtgggaagtcataggaactcccagtcagggtattcacagtaactactcacagtaataggaactcacagtcaagtctaatttttcattttaatttttccaatcccttctttacttctagtatactaattgaaaaaaaaaaacttgggttgcctttagtttcaatttataatttttattaggattttactgatactgtatctttttggtactggaggtctcagaaggactgacctggttctacttgtttgctcttgggattta

SEQ ID NO: 222055 - DNA, 808 bp, Homo sapiens
atggattgaacatcccaaaatctaaaatgctcctaaatccaaaatttttgagtactgactgaaaggaaatgctcattggagcgtttcagatttcagattttcagatgctcacctgggtgagtataatgcaaatattccaaaatttaaaaaaaaaaaaaaaaacagaaatctgaaacacttctgatcccaagcatttctagtaagtgatcactagaaatactcaaacctacctgtattgcagcatcctcatatttcagttttaggccgtatctgttgaccttccactaaagaagacaagaattgaactctcttttctcactctgtattcccagaacgaacatacacacacacacctgttcacccttttccaccaagtatagttacagttttggttaaatcaacactctaggttctctggtatttaaccagatttcttcatgatattcagaatataatgtattctgtcagtttcatcatattgaaaacattttgcccagagtcttctaatatatctcagtctggtctttttgtcctctacacctggaatacaaattttgttctgagattttcctttcttcattctgaggttatcctttgttgtactgtaaaattgtaagctttctctaagttgatttgtaacttaatgacctgactttttttggaagtaggcttaattctaaagttcatttcggataaataagatatgacaacaaaggtattatcataaattggggaaaaggattattcattgcggcactgtttatcataggaagagattggaaacagatcaaatttccatcagtaggag

SEQ ID NO: 222056 - DNA, 556 bp, Homo sapiens
tatgccatggggctatgtggactgaaaagtgatgaaccagagagagagctggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggactgaactcaagactggcaagaaatgtaaaagaagcaccaacagaatatgcatccatatgtgtgaggagttaagtctgtttctgactccaacagggaccactgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaactta

SEQ ID NO: 222057 - DNA, 340 bp, Homo sapiens
aagatgtgaaaattgaggaatgcttctatgctttttcatactatacatgtcatttcagaaactctgaaagtacatgcctctctctagccctttcactgccataaagatctcaacataaaatgagggtcaaggaaagtattctgttacagtgtcaatctgaaaactatcaaactcagtatttttggtctggttttgatatacataaatcaaatacatatttatacagatttaatataaccatatttacatatctcacattttttctttgaaagtaatgtttaaaattgtacacagaatgtgttaactagagaaatgttggaaaccactaaagtattgtcat

SEQ ID NO: 222058 - DNA, 316 bp, Homo sapiens
tgaattattcatggaataatgttggggcactgggggcttggtttggcaaaaacaaaaaagtaagggtatctactgaaatcttgggaaattacattttaaagatttgtaattaatttccagtataatgcttattctaaaattcatactggggctgggtgcagtggctcacgcctataatccgagcactttggggggccaagacatgtggattgcttgagctcaggagtttgcccaagctcagcctgggcaacatggcaaaaccccgtctctactaaaagtacaaaaattaggcatggtgacacgtgcctgtaatccc

SEQ ID NO: 222059 - DNA, 2023 bp, Homo sapiens
tgtgattgctgtttgactgggttgttcctgcaagaccctcctccaaggttctttctgtactattttgttttctttcctgtggtccatgatgagataagtcattctggctcagtgctgccactcacctgtcgttttccttaggacttgcatcttccaagacccatgaaataacccagctggagtcatgggaggagcccttcatgcctgcttgggaagttgtgacttcagccatactgagaggtagttggcaaggagccaaggctgaggcagctgctgagcagagtgcttctgtagaagtgcccagttcaaacgttcagcaacaccagaagcagcactgtggagagaaacccttaaaaagacaagagggcagggtcccagttttgaggagttgcagagtccacctatcagagaagtccttgcaaagcagggaagttgggaaggatcttctgaccagctcaggtgttctcaagcaccaggtgactcacacgggagagaagtcacataggagctccaaaagtagggaggcctttcatgctggaaaaaggcattacaaatgcagtgaatgtgggaaagcctttggtcagaaatatttacttgttcagcaccagagactgcacactggggaaaagccttatgaatgcagtgaatgtgggaagttatttagccataagtccaacctttttatacaccaaatagttcacactggagaaaggccttatgggtgtagtgactgtggaaaatcctttagccgtaatgctgacctcattcaacaccagagagttcacactggagaaaagccttttacatgcagtgaatgtggaaaagctttcaggcataattccacacttgttcagcatcacagaatccacactggagtaaggccttatgagtgcagtgaatgtggaaaattgtttagtttcaactccagcctcatgaaacatcagagagttcacactggagaaagaccttataagtgcagtgaatgtggaaaattctatagccacaagtccagccttatcaatcattggcgtgttcacactggagaaaggccttatgagtgcagtgaatgtgggaaattttttagccaaagctcaagcctcatgcaacatcgaaaagttcacactggagaaaaaccttttaagtgcaatgaatgtgggagattctttagtgagaattccagccttgttaaacatcagagggttcacactggagcaaagccttatgagtgcagggaatgtgggaaattttttcgccacagctccagtcttgttaaacatcgaaggattcacactggagaaatacaatgattgtgagaaatcctttagctggtgtttcaacctcattcaacaccagaaagttcacggtgtaaaaaagtcttgaaggttactaatggaaatccattagctatacctccaaactcattcaacactggacagttcacagagtggacaatgtagtgaatatggtaaaaggcctcagccaaaggcctaaccgtattcaacaccagaaagtttagactggagaaaggccttagactgtcgctgaatcaatatgacctgacttaaagcagaaacagccaggcgtggtggctgacacctgttattctcaccactttgggaggctgaagcgggcggatcacaaggtcaggacatcgaaaccatcctggttaacacaatgaaaccacatctctactaaaaatacaaaaatttactgggcatggtggtgggcgcctgtagtcccagctactcaggaggctgaggcagaagaatggcatgaacctaggaggcagagtttgcggtgagctgagatcacgccactgcactccagactgggtgacagagtgagactctgtctaaaaaaaaaaaaaaaaaaaattagcccggcgtggtggcaggcaactgtagtcccagctacttggggggctgaggcaggagatttgcttgaacccgggaggcggaggttgcattgagccgagatcacgccactgcactccagcttgggtgacagagtgagacttcgtctc

SEQ ID NO: 222060 - DNA, 2216 bp, Homo sapiens
agagaactcagcttgccggaagctggttgttcgctgcggcgaccagctccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcagcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccatactgagaggtagttggcaaggagccaaggctgaggcagctgctgagcagagtgcttctgtagaagtgcccagttcaaacgttcagcaacaccagaagcagcactgtggagagaaacccttaaaaagacaagagggcagggtcccagttttgaggagttgcagagtccacctatcagagaagtccttgcaaagcagggaagttgggaaggatcttctgaccagctcaggtgttctcaagcaccaggtgactcacacgggagagaagtcacataggagctccaaaagtagggaggcctttcatgctggaaaaaggcattacaaatgcagtgaatgtgggaaagcctttggtcagaaatatttacttgttcagcaccagagactgcacactggggaaaagccttatgaatgcagtgaatgtgggaagttatttagccataagtccaacctttttatacaccaaatagttcacactggagaaaggccttatgggtgtagtgactgtggaaaatcctttagccgtaatgctgacctcattcaacaccagagagttcacactggagaaaagccttttacatgcagtgaatgtggaaaagctttcaggcataattccacacttgttcagcatcacagaatccacactggagtaaggccttatgagtgcagtgaatgtggaaaattgtttagtttcaactccagcctcatgaaacatcagagagttcacactggagaaagaccttataagtgcagtgaatgtggaaaattctatagccacaagtccagccttatcaatcattggcgtgttcacactggagaaaggccttatgagtgcagtgaatgtgggaaattttttagccaaagctcaagcctcatgcaacatcgaaaagttcacactggagaaaaaccttttaagtgcaatgaatgtgggagattctttagtgagaattccagccttgttaaacatcagagggttcacactggagcaaagccttatgagtgcagggaatgtgggaaattttttcgccacagctccagtcttgttaaacatcgaaggattcacactggagaaatacaatgattgtgagaaatcctttagctggtgtttcaacctcattcaacaccagaaagttcacggtgtaaaaaagtcttgaaggttactaatggaaatccattagctatacctccaaactcattcaacactggacagttcacagagtggacaatgtagtgaatatggtaaaaggcctcagccaaaggcctaaccgtattcaacaccagaaagtttagactggagaaaggccttagactgtcgctgaatcaatatgacctgacttaaagcagaaacagccaggcgtggtggctgacacctgttattctcaccactttgggaggctgaagcgggcggatcacaaggtcaggacatcgaaaccatcctggttaacacaatgaaaccacatctctactaaaaatacaaaaatttactgggcatggtggtgggcgcctgtagtcccagctactcaggaggctgaggcagaagaatggcatgaacctaggaggcagagtttgcggtgagctgagatcacgccactgcactccagactgggtgacagagtgagactctgtctaaaaaaaaaaaaaaaaaaaattagcccggcgtggtggcaggcaactgtagtcccagctacttggggggctgaggcaggagatttgcttgaacccgggaggcggaggttgcattgagccgagatcacgccactgcactccagcttgggtgacagagtgagacttcgtctc

SEQ ID NO: 222061 - DNA, 377 bp, Homo sapiens
taaatacaaaatacagaaaacaacaaaatggaatttctagagttgaaagatctgaaatgaagtgaaattaaatgaagaatcactgaatgggtttaacagcaaattagacactacagaaaacaagatcagtgaaattgaagatatacaaaatccaaaatgttcaaatgaacatttcctttgagtatcctgtcagcaacccaaatatttcagattttggatttcggattttctgattagggatacacaactggtatgatgcatggtatgatgcaaacattccaaaatctaaagcctgaaagacatttggtcccaagcatgttggataagagatattcaacctgtaatacaaattatccaaactgtagtacagacagaaa

SEQ ID NO: 222062 - DNA, 684 bp, Homo sapiens
gatatttaaagcaattcagaagccaaaacaaacctagcgaaaacaaggaaattgtcataaagagacaatgaagggagaagaaaacttaaaaatattatcatggatattctcagaaagatcagagaatatactgtaatcagaaaataagtatagacactaaaagaaaaggaagctttaggttctaaaaatgtactcctgaaaaatggaactgatagaagaaataagaaactcaaaatgttttttgaatataaagaagaggaagctacccagaaagtagaaaaaaaaattacaaaatgaaaaacaaaagagaaaatacaaaagtagagacttagaccaggaggtcctactctgagcaactgaattttttagaaaaaggaaaagtatatatagcaaggaaactatcaaagaaatagcaaaagaaaatttcccggactttaggaaaatgattttcaagtttgaaaaggcctattgtgtttccaatatgctgaatttttcaaaaaacacccatactaatgtatagcaccataacatttcagaacatcaggggtaaaaatgaagatcctagactccagacagaagaaaacagataggctctatacaaaaaattgggagtcagagtggcccctaacattcagcaggggtcattgaagacagaaccacaagggcttcaaaattatggggcaa

SEQ ID NO: 222063 - DNA, 479 bp, Homo sapiens
gaaattcataatatacgtccaaggctcctcagcactaaacttactaaaaaacaactattgaaggaagagatggtaagcagtatgccaatttactctctataataggcaagctataaaagaaagatactggtttctccctgtcagtattttaaattctaactttcattttaaaatatatatttcctgtttgaaaacacccttttttggttcttttttttttttgttattatacttttaagttctggggtacatgtgcagaacatgcaggtttgttacataggtatacacatgccacggtggtttgctgcacccatcaacctgtcatctacattaggtatttctcctaatgctatccctcccctagcccccaactccccgacaggccccagtgtgtgatgttcccctccctgtgtccatgtgttctcattgttcaacttctacttacgagtgagaacatgtggtatttggttttctgttcc

SEQ ID NO: 222064 - DNA, 682 bp, Homo sapiens
gcagtggaatcttctattctgatgctgtagagaccagtgctattcaataaaacttttatgatgatggaaatgtttatgtcctggttattcctggaaaagccactagtcacacatggctattgagcacttgaaatgtggtttttgtaactaaggaactaaatcttaaattttatttgttttaattaatttaaacttaagtagttacatgtggcttgtagctctgattctgagagtttggcacatactcaacatactcaacttgtccacagtttttcttcatttgagctacattttaagcaaagaaactgaatgctgtaaatgatcaatgggttggtgaagccagttacagctaatgaaagctgcctcttagatggagtgagaattgaaggaaggctaaaacagtttccgttttctcccacaagaagaatatgccaattacattgaccttaaatgtttcacaatggaatattttaggatcttaaaacatggaaagctcaaatacagatgtgttcctctggtagcagccttcagaagccataggtgatgcgtggtagattttgtttctcctccatccctgacaaaattgactcttgattttgtgctattgcgttaggggtcacactgattcccaggcttatctccttgcttctgctaaattacaagacttctttcatgtatttca

SEQ ID NO: 222065 - DNA, 214 bp, Homo sapiens
gcccgcgccccagagccccccccccgccctcacttcgggacccgtggcggggaaggggtcatttctcctggcccctcttgaaaaacaaaaccaaaccaaacaacaacagcaacaaaaacttccaaatctgtagtattcttcagtaacccccacccttgagttcccttttagagatccaggaaaaaacgaaacgttaaatgtatcgtaacaggtt

SEQ ID NO: 222066 - DNA, 524 bp, Homo sapiens
aattttatagacagtgctgttggtgatatatctatgaggccatacaatgcagaaggtctaaatattttagtttaggggttaaaattcaatttgggaactgataaggttttactttgatgagagaacataatttattttaattaaagtctgctcattaagcaaatatattaaacatcagctgtgaatgaagcattgtactaggcactgctgacagaaaggtgaccaaaataaatcttacctttaaagatatagtttactattgataatgatttatacttctgttaatcatatagacaatcagagaatttcataaaacttattattgttctaattattgcacattaaatttagttggagttttaagtagaacgcctaaaagaaacaattttattggtgtattttaggacatctgttttctattgataaggcataagatcttgatgaatttgaagttgtctgtgttaaagtaatggaaatattagttcatggatggtggtcatttattaagacgtaaacacagcagt

SEQ ID NO: 222067 - DNA, 402 bp, Homo sapiens
aattcatgtgctgacgggggcagagggagggcatctcacggcgagatcagccttgatctgccaccggattacaggggcctcagaagcggctgattaataattctgcaggagcccttgagctggaaagctggcgctctgagtctaataatccccagtcgttgtaatacaaaggaaggacaggaattgaattcacagttctggattgtgaaattcaaaattcgaaagaaacagggatccacttcttcctgagtgtgtttgtcaacctagctgcctgcttgtttgtgttaaatggctactgtgctttttgaatctaaaatctgattatatttaattagtacaggcatctgggatttctaatacacaaagagttattaaagtaacaaatctttctaaaatatgttt

SEQ ID NO: 222068 - DNA, 506 bp, Homo sapiens
gaaccctgtgacatctagtatgatgaggaaactgtgaccaccaccactggcatcaggccataatcatacagtctgtggcactgccacatccatgccaggaattctaactcacagccttaaaattttttaatttaaaaaaattattaaaaattaaagggaaaaactacagttgatgtccttcaataggtgaatggataaataataactgtagtccatctgtacaatgaaatattattcagcataaaaaaatagttatcaagccacaaaaaggtacaaatgaggccaggcaccatggctcacacccacaatcccagcactgtgggaggtccaggtaggtgaatcacctgagctcaggagttcgagaccagcctggccaacatggcgaaaccccacctctactaaaaatacaaaaattagctgggcatagtgttggggacctgtaatcccagctattcgggaggttgaggcaggagaatcacttgaacccgggaggtggaggttgcagt

SEQ ID NO: 222069 - DNA, 466 bp, Homo sapiens
ctccatggcagcagcaattatgcaaattatcctggatctttacatttcagtaaaacctttcttccccctttacatacacaaaatagacagctaaggggctgtgatctgtcctaaagccttggagataaaacaggatgtcactcttttctcaaaatgacttctattacggaagcatgagctcccttaaatggaagggcaaagcaaatccctgccattgggctctgcagcctctgctataaatgtgccaggaagattaaaactaccgtaattagtttaatcaggttcatcctcaattcttgctttcattatgtagtaggaacttccctaatcagtactgcatttggctgattgaagagttcactttcatagctaggatatctgctggagtctgtattgtggtttgttttaatggtgtatatatggtgaatgtgaatgtttctcatttcattgttgatcttgctaatgg

SEQ ID NO: 222070 - DNA, 603 bp, Homo sapiens
gccgtgggtgaggaggctgggccaggctctgtagaggcatgtatggggcaagcggggtgggggcggggcggccctcccatcaggacagagcccctgtccttgtccttgtcacccctgctgtgcatttgctcttctgtgttggtgtgtgtgtcagctcactggctttgatgccctgactatgatgctccatggtggcagcaaccatctttctgctcactgtggggtccgggagcctcgaggggtgcctgatgtttagaggggccagaaaaagaacagtgcactaggaggctgacgctgtcacccacagcgatgaggaggaaggtggcatggcactgacctggccagtgcaggggatcttggcgtccttggcagggagccaccccccactgtcaggaacaccccgacaggaggccagacccatcccaaccgagtcctgggcagtgtgctctgttagggagtagtagatggcagggacattggagcccaggagtagctgatgcaggaaaggaatgttgggaaggcccggggtacactttggaaagttgggagactctgggaagtgggcccttgtgggaggcggtgggtgttcctgctgcggaggac

SEQ ID NO: 222071 - DNA, 370 bp, Homo sapiens
  misc_feature (315)..(315): n is a, c, g, or t
  misc_feature (323)..(323): n is a, c, g, or t
  misc_feature (328)..(328): n is a, c, g, or t
  misc_feature (333)..(333): n is a, c, g, or t
gctgatgacatgtttgctacatttgtccttagtttaacatacatatttcttatatctgataagtgcaaaggcagtgcgtattgacagattatgttggaaagataaaaaatttcaattgaagtgaaaatattgaatgttgcacatgaatctgaaaccaatggctcagttacagaaatgtatctgaagaacaatgagcaagatttaccacatgtgaaaagtgctgagtgaatgtaaccaacaacaataaaaatgaagaaaagcggccaggcacggtggctcacgataaaaacaactatttgtaccccttctgatttntatttatnaaggnaaggnaatttttctttaaaaagaatgagccccgacatgttcg

SEQ ID NO: 222072 - DNA, 514 bp, Homo sapiens
ctctactgttcttagtatatagtgtgggatggaattttaacatttcatctttttagaaccaaaatatttctattttgatactcagcccacattcagtttttcctcctttcccttcatttggttctttgtattagctctcccactagactactctgccaccccatcccaagtgcagggatttgcaaataacacatgctacttaaataaatgcttctatgtgatcagattagattattagattaacacatacagtgacataattaatacatccaaaggctaatctagtattggctaattttgtcaattgtggaacaccaaaagaattttaataaaactatatactttcttcccttttcatgaatttttccattttcatgtatatgtctgaaaaaacagatttctgttttcttgctttaccaagggctaaattggaaaatatatttgggattgtgaaatatttgtgtaataaatttcttgtgcttatacaaaagacaagattgttattactggtact

SEQ ID NO: 222073 - DNA, 567 bp, Homo sapiens
ctctactgttcttagtatatagtgtgggatggaattttaacatttcatctttttagaaccaaaatatttctattttgatactcagcccacattcagtttttcctcctttcccttcatttggttctttgtattagctctcccactagactaaaggtttctttgtgggtaaggaaaaactcttagtcatctttgtgtacatgaagctctgccaccccatcccaagtgcagggatttgcaaataacacatgctacttaaataaatgcttctatgtgatcagattagattattagattaacacatacagtgacataattaatacatccaaaggctaatctagtattggctaattttgtcaattgtggaacaccaaaagaattttaataaaactatatactttcttcccttttcatgaatttttccattttcatgtatatgtctgaaaaaacagatttctgttttcttgctttaccaagggctaaattggaaaatatatttgggattgtgaaatatttgtgtaataaatttcttgtgcttatacaaaagacaagattgttattactggtact

SEQ ID NO: 222074 - DNA, 382 bp, Homo sapiens
ttaaaaaattgattcttcttgctcctgacccacccatagtaacttgtttggtaaacaatgcattaaattattatataaaaagttaaggaagtataatatagagaaacttgcatttctgtaaaattattgaagtataccaagccataataatcaatcccttagaaaagcagattataaaactgtatatgcttgttatgaaaacacatgcatacacacacacacgttcgctttaatggaaaaagctttgggattatgcaataagaggttatcaacggttccctgtatggttggtgagatttcatctttttgcacaaatggattttctaattttcttcaatgaatatgcattacttatgaaattaaaaatccatttctaaaacca

SEQ ID NO: 222075 - DNA, 375 bp, Homo sapiens
tactcttgcttccagcaacctgacttcactattcccttttccattccatttttactgtagctttagacctaatgcttcctagttcttcctttggatttcccttaactctgattctgatttttctagctagcattgcatcctttcaagtttgaccccaccacagtaccctcctacctcaggcaccatcctggtaatgagaaaggtatgaggatatcctcgaagttggctgaaagtaataattaatttactttacatatttatttagtgcctgctgtgttctaagtgctgagtgttgagaatacaatgttaaacaagacacaaaccttgttcttcacaagtttatcacagggttagcaaatgttttctgtaaaaaaa

SEQ ID NO: 222076 - DNA, 198 bp, Homo sapiens
gtgagccactgcacccagccagtgggggagtattttccgatcctctgttggtggaatccatggatatggaacctgaggatatggaagggtgaccgtacaaaaggcctgatatcttcagggaacagtgagtctgtctgtacaactggaacactggatgtgtgcggtgggggcagtattggtacatgtggatgaatacat

SEQ ID NO: 222077 - DNA, 523 bp, Homo sapiens
caacacacaggaagtgtggtccactcgggaagctcattaggaactcagtccccaagagttaatgaaggctagtcctgtaagcaccttctggacagcatgtaccaaaatgccatactcccagaagaaactcgggcgttcagcataaaccacattgtataaaacaattcaggcccagtgtgagccacctaatcagttagggaattttgggaacactccccacatccaggcacccatagaatgtttcaggccaacaggcagtcttgcaagcaggcctctcagtggttagcagtctcaggcctgctgtagtaactctgttctgtacatggagacatcacagtttttgcagccacttcttattgattggcagtttcatccttttgaaagcatgaggtgtcctggctgagcgcagtggctcacatctataattccagcactgtgagaggctgaggtgggaggattttttgagcccaggagtttgagtcctgcctgggcaacagagtgagaccctgtctctacaggaaaa

SEQ ID NO: 222078 - DNA, 348 bp, Homo sapiens
accctgcatgaccctgttccccgggaggggcagcctggggagtgacaggcatgacctcgatggtgggccaggggcctcctcagaggagcaaagagaagcttggtggaagagaaagccgctagtattcagcgagaagatcactcaaatccttcaccagcatgctcagtgaagaatgcattaaaaaaattagactttttttcttcctggcaacaaaatcttgccaaaataagtaccaaaataagtgttccaatggttttatttggggaaagccaacgctttccccaaaaagactttttcttgtttctcatttggctgctacaaataaagctgcaatgaacatacatgtac

SEQ ID NO: 222079 - DNA, 403 bp, Homo sapiens
atcagccacacaggtggatctcctgcgctacgccaggtgggcgggaggaacggcagatccctggccggaggcctgaagcccaaaggtccccgccgccgggtgccggcctcattccagccccggcctcccgggcggaaccccctccccaccgggccctgggccccacccgccagacggtgcccgggtgccccgagacatatgctgcccgcaggccgcgcggcccgacggagtgctcactgccgaggcggttctcagcccatcaaaagcccaggctttcttcagccgtatgggccgcgaggtgaacaacaatgcccgggccccttcacttcaaaagcagcgatcaggggaaaggctcccccagagaatttttttttcccctcagcctttcattcctggtttgaaa

SEQ ID NO: 222080 - DNA, 375 bp, Homo sapiens
aatatattcacggtctgactacttctcattatttttaccaccatattagtcctagccaccctcactttccaccagggttataataatctcatgattagtctaactgctttcagacttaccctcttagtctgttctcatgtgagcagcccaaatgttccttttatgatggaagtcagatcgttacactctcctgcttgaaacttttcagtgtcttttcatcccactcagtaaaagccagggtcggccgggcccggtggctcctgcctgtaatcccagcactttgggaggtgggccttgtgaccttgatctcacgatgtcaagagattgagaccatcatggccaacatggtgaaacaccttctctactaaaaataca

SEQ ID NO: 222081 - DNA, 369 bp, Homo sapiens
ccagcactgatcttcccttagtggactaacctatgatcttgccctgcacctgctgtgtgctgggccctgttctgggtggtgcatgtacgtggtgatgaaccatgcactctccttccccagattctgtcccagggttttttcccaccagctgtcagtctgcctatcttcatttatatccttcctggaatccaatgtcacgatccccccacaaagcaatggacaccgctcaggtacttacatgtacccctgaagccacctgccaccaccaccccattccctcaaaataaagacaaaaacaaaaccagaatcctgaaccttacattttcttcgggaggccacagccttgggccttgtgaacagcacgccccc

SEQ ID NO: 222082 - DNA, 186 bp, Homo sapiens
caaaaaaggtctatagtagagtaatattgcaaacatagagaagtcaatgaattcaagaacttttgtcaggcacagtggctcatgcctgtaataatcctagcgctttgggagaccgaggtgggcggatcacctgaggtcaggagtttgagaccagcctggccatcatggtgaaaccccatctctact

SEQ ID NO: 222083 - DNA, 229 bp, Homo sapiens
gcacacacacacacaccccacacacaccaccaaaccccatcttgggtaggatcttcaagggaaaagccacagattacaccccctaccctccatacctaaaggcatagtattttcaaataaccctttgagttcaggatttgactccaggtaggagagaaacatgtggaaccgccacagaatgcaatagaggttgagtcacttgtatcctaataaaatgtgacttgttcag

SEQ ID NO: 222084 - DNA, 683 bp, Homo sapiens
gcatactattaaaattctggtgttaaattagaaacagcaagcaacataatctactgcttcatttttaatttttatgtctaaacttagtccagatacaaagttaaagagttgagataataatgcaagcatagaaattaaaaaaaaaaaaacaacctgaaattgactagcaaaagtctattttataacatttataacattaagcttcctaggagcattaattctttttaaacctggaatcattactttttagcgtacatttcaaatgctgaatttccctatcaaacagtattgtagaatggcggtactttaaattttctccttaggaggatgtatgcttttaaagaaatgatttaaaacatctatatttttaaaaagatggtataatatatacatacacactagctatcaaaatatagctaagatttgttcaacatctcattgagttaggccctgtggtaatcaccccacaaactttctaccacaaatttctctccatgccctttggctcttgtgatactggtattaagattccatgttacagataacagtcacaatatgatagccattaattattagctattaggttggtgcaaaagtgaatctgagcgagagattgcagggtggttgaaggattgactgggagattagagaaatggagggaagtgtttacgcctaatgtgtag

SEQ ID NO: 222085 - DNA, 557 bp, Homo sapiens
ctcaaagggtggggcagaaagtggggttaaatatggactcaatgtgataggcgtaaactcctccgcagttctctctaaccccagccacccagcccgcccccaggctccaggctgtccccaaacgcgcggggtgtggccgtgaaccctcctccccggccgcgccctgccccgcccttcacgacagctgccggggacagcccggagtgcccagagggtggctgcggcccttcccctcttgggtggggaccagagggcgctgagcggcagcggacacccccaaacactcgcgggagaggggtgctggctccctttgagcagcccgcccaaccctgcctccaccctcccaggctggacagggaaggtgctccctggggcttcagaccccccttctgactccccctgcaacgggacctcacgaaaggaagggtggagagaaggttcgggaagacgagggggctgggaggtttggaaagacagctccaggcccccgttcccacccccgccccaggctggtccgggaggggcagcctctccccgcccccaggtccgcgcggccg

SEQ ID NO: 222086 - DNA, 633 bp, Homo sapiens
ccctatcactcccaaatactgtcatgtgtattttctacacttgaagatattctcctacataacccaccatcaaagtcagggaattaatacattgatacatcactgccatctaatcctcctccattcacgttcctctagttgtcctgataatgtcctttaaaacaggtccctaacccccaggttggagacaggtacctatctgtctcctgttaggaaccaggacgcacagtgggaggttagtggtgggcgagcgagcattactgccttagctccacctcctgttagatcagtggcagcattagactttcatagaagcgtgaaccctgttgtgaactgtgcacttgagggacctaggttgtaccctccttatgagaatctgatgcctgatgatctgaggtggaacagtttcttcctgaaaccacctcccctgaccctgtctgtggaaaaattatcttccacgaaaccagtgcctgagcctaaaaggttggggaccactgctttaaaaggaggccactgcagttagttgctacattctttaatctcttttaagcgtggaacatttcttcaggtttgacttttgacacttgtgaaggtttcaggccagttactttgtaaaattccttgagtgtggat

SEQ ID NO: 222087 - DNA, 426 bp, Homo sapiens
agtagagtatgataaaaatttaaaaactggctctccaggaaaaaagagacatcctaatatgatgtatttgccaatataccatgggttttcttgggctgggatgaactttcagaagttttacagtgagcatttttttttttatgaatttaaattggttctagctaagcaattttggagtatctttgatgtacctgggtctctcattttaataaacataacagtggtatgttagtcagggttctccagagaaacagaaccaacagtacaacagtatatatacatacatacatatatatgtgtgtgcatgtgtgtgtgtgtatgcgtgtatatatatatatgctacatatatgaaaggggatttcttgtgggaatatatattatatataacaaaacatgacaaatatataacaaaatatatgtgctata

SEQ ID NO: 222088 - DNA, 343 bp, Homo sapiens
agcataggtaagtgccacttaccagctatggcattttagacaagtcacttagtggttttgcacctccacttgtacctgttaaatgggatagcaaccgtccctccattgtagaattgctaagggtaagatggactgagctactgcatatgaatggcctagggtgatagctgcatgttgtgggtacagtataagcattcatcatctgttactgtccccgaaaaatgtccctgcccccatcatcaggggaccttataaccgagcagctcgtgggttgattagcactgttgctcctttctagggtgagggatagaacagcacattgagattggaaaattctgtgtca

SEQ ID NO: 222089 - DNA, 358 bp, Homo sapiens
aatcataaatacaaagtggaaaggtaatttttccacctgtcccacatcttaagggatgaataaatataacttaaaaagttagtatacagaagaggggtgctaaaccttctattagcctgttacagcaactatcattcacttccccattttataagacttaactccacatttttaaaagaaaatggatgaaattttgactatgtaatttttaacgcaagataggaaacataattgacagagtgaagcttttatgtttatgacagaaataacctgtaataagtttgtcatttaacagagtattgaaagagcagtgtgctgtggtctctactgtggtccaaagaaaaactgagcagaatga

SEQ ID NO: 222090 - DNA, 479 bp, Homo sapiens
gctgctgtgcttaggtgtgtagtgatttttccatctgagaagactctcaggacattttccactctaaaattaatgagaatatggccaagggatatgtcactttttctgagtacatggtaatgggcttattagtgtccctgtttagactcaccttagagcagtttccataagctaagaaaaagaccttggggcaatgattaaataaactatcatatattcatatgatggaaaatcatacagcacctaaaagcattcaaagaattattaatgttgtgagaaaatgtttatgataaaatgctaagtgaaattagcaaaatgaacctttgctgtgtgtttcatattaatattcactgagaaatatgaatgattcttgtattttttctgtttttttctcttttacattttctaaaatttatatgtattgttttgccaattggagtaacattttctaaaaaataataaaaatttatgtatttatt

SEQ ID NO: 222091 - DNA, 592 bp, Homo sapiens
cacagtggttccttctgtgatccagtccaccatcatttgggcgttggttttccaccttcacatgtggtacctcatggtggcaaagtggctgccacacctccaagcactttgcctacattccaggcaggaaataggaaatgcactagatctcacccctggggtctgttgcgtgtttcactgtgattgtaaaatcttccccagaatgcttctcagaagacttcttacacctcattgtctagaatgggtccctggcagccaccatagtggctgggaagattaatggtttaacagcctctgtggttgaagaaggcaagggtgaaggggctggggacggttgttgaatgagccacactgaggtaagtccataatatgctttgcctcatctaagcctcccagctgtcctgggaggtggggccggtattctccccatcccattttattggaagacaattgagttaaatggcaaatctgtgacagagccagcaagcagcggaccttagattgacagtctttctccagagctcttcctcaccctgccactagagggcaggagatgcttagtgcacggcagagagaacagcatgcgcatttg

SEQ ID NO: 222092 - DNA, 256 bp, Homo sapiens
gtttcatactgaatctgatggttaggggcattttggtttgacttttaaggtttttttccctgcgttgttaatttatctgagtgtaaatgataacacttcttaatctgataatttacacaaagtttttcttttgccatgctagctaagaaaacaaaaaatggctcagtcttttttttttttttttttttttgagatggagtttctctctggttgcccaggctggagtgcaatggcacaatcttggctcactgcaacc

SEQ ID NO: 222093 - DNA, 539 bp, Homo sapiens
tgcaatgtttctagcccctgcaagtttgttcttttgtgacaacataaaactgcacttaaatgtattcataggagaatagtttatgatttatttttaataatattgtcactaatgggtaactcattctcatataatatgctctgctagataatgtataatagaaatcattgatttcttccattacttttgcattctcatgtgttcactgtgtacacccagttttgtctataatcatattatttaggttagcatatttcatttattatatacatgtgatcactccatgtacaaactctttagacaacaacattgcaaaaggttcaaatgtcccaaactctcatgccattcacttgcagtgatgcttgacaagccaacctaatcaatcattttgtttaataacttttctataggtttcttcctaaatataagggaagagcaatatacagggaaaaagtgaaggcacattaatttgcttaactattttgcttagggctggcactacatataatagtgtatatatttcattaagtagaataata

SEQ ID NO: 222094 - DNA, 368 bp, Homo sapiens
ggatgcagggcaccaggttcctaggctgcacacagcagggggttctggactcacaagagcatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagatctctagggaactc

SEQ ID NO: 222095 - DNA, 418 bp, Homo sapiens
gagtgcaaaaataaaatccactcaagagtcacaaggcccgctgtgcataatcggggggggagaagggcctgggcgacagagcaagactccgtctcaaaaaataaattaattaattaaattaaataagtgggtgttttaagtgctcagcttccttggttctaccaccttctctccctgaccctccttccctttccccctgaccttggcctttattctagaacggatctgaagcaataggatataaaaaattcacaactgctaaaacagtgttccttctagtgtaattttcacccttagagacctgtctgtaataaacattatttgaaatgcctactatatgctaggcactatgcctcggccacgggttcagacgtgatcgagacagcctgccttctctgagtgtatggcctgggaaagg

SEQ ID NO: 222096 - DNA, 414 bp, Homo sapiens
aggtcttccctgggtcctgttctcatccttgggcttccagcaggcccatgtctccatttcctggggcccttcttacctatgtccgggtcccaactggtggctaattccatggccccctggccctgaggtgccccccctgcccctgttcctttttctttctttctttccttttttttttttttgagacggagtctcacgtctcactctttcacccaggccagagtgcagtggtgcgatcttggcttggctcactgcaacctccgcctcccaggctgaggcgggagcattgcttgagccctggaggttgaggctgcagtgagccgtgatcatgccactccactccaacttgcatgacaagagtgaggctctatctcaaaactaaacaaaacaacaacaacacatcaaaaactaaaa

SEQ ID NO: 222097 - DNA, 446 bp, Homo sapiens
cctgtgtataaaagagtttttatgaaagcagctagaagtagctggagaagtttattgttgagcctgatgcagaaatttggcctttaaaattattaaagcactgaaagtggtattgcaagataaatggaaagaaatggtaaaaataaaaacagtcattctctatttgaaaaggaaaatgaattgttttcttacacttattagtgattgtcactaaaccttattgtgttaggaggataagatttggaaaaaataggtcaggcacagtggaaaccccgcctctactaaaaatacaaaaattagccaggcacggtggtgcacgcctatggtcccagttacttgggaggctgaagcacgagaatcgcttgaaccctggaggtggaggttgcagtgagccgagattgcaccagcgcactccagcctgggtgataaagcaagactccgcctca

SEQ ID NO: 222098 - DNA, 614 bp, Homo sapiens
tatgtttgatatgtttagatacacaaagaccattgtgtttcaattgcctacagtattcagtatagtaacgtgctatacaggtttgtagcctagatgcaataggctacaccatacagcctaggtatgtagtaggctacactatttgggtgtgtgtaagtacactctgtggtaatcacacaatggtaaaatcgcctaatgatgcatttctcagaatgtgtccctgttgttaagtaacacattactgtagatgcataagtgaaatcttaagaacatactaagtcttaagtataagaaagttccagagtgatacatatactgtggtatgatttacataaagaatatgaacacttaaaaatggtgcatattgtatatggaatttatgtagatatcccatgacataaacatgtatatgatatatatgtgtatatgagatatgttcgttatatatatttctgtgaatatacatatatattatttttaaacttgccaggaaaaaaaatgtccctgaatagtcatcactctttggaagggaaaacaggcagtggtacaaaggcatcattcacctacatctataatagttcaaattttaaaataaaatatttaaagcaaatgtg

SEQ ID NO: 222099 - DNA, 660 bp, Homo sapiens
agctgagcacttcataggctgtttacaggtccttctccacaggaaaatacttcctccaggacaagaaccctgtcttggttccaaactttcccaattataagagtcacctttgcgcttgttaaacctgcttccaggtgcttctcttgaggtttcctgattcagcgagactggaggtgggacctgacgaggtggttggtttttagtgttctcaggagtgtggatgttttaataggtgttgggtcctcatgttaatcgacctgtgggtgtgtcacagtctttgtgtcacagatgttctgagaaaggaaacaatttgaggatgagtggaggggaatttgtggtgtagagaaggccacagttaatatgtggggtgaatttctgaagacctctcagttcaaaacttgaataactcaagactcatcctgacaaaagccagtggatgtttcttttgccaaataaaatatacccttggtgcaactggaaaatcttagcttataattaacttgacagcctttgaaattaagccattcttgataaatcttgggggaattaacaactttgtgcttaaaatgaattttactaatttttatgatgttgaagttcaaatttacacccaattaaaagatataaaatgtggtaaaaccacaacaaaaaaacaccaaa

SEQ ID NO: 222100 - DNA, 447 bp, Homo sapiens
gacagagcaagactctgtctcaaaaaaaaagggacttatttgctggtaaccaaatggaaactcaaacgataaagtaaaacacagtatataaattatttttaattgcttgactctggatttatgtttgtataaaagtctacctccagcttttcattcttcatttaaaaaatgtagattacttactatataactatctaattaaagtatggacattactgaaatctgaaaattttggttcaataattaggaatacttaggtgatatgctgtagaaagatggcgaggcgtggtggctcacacctataatcccagcactttggaaggccgaggcgggcagatcacttgaggtcaggagttcaagaccagcctggccaacatggtgaaacctcgtctctactaaaaatacaaaaattagccgggcatggtggtgggtacctgtaatcccagc

SEQ ID NO: 222101 - DNA, 356 bp, Homo sapiens
ggatgctatgggcatagataacataaacatgtagagaaagtaaaggtgacctagggcagaagccttaggaacaccaaagtttaagagtagctgaggcaggagaatcgcttgaacccgggaggcagaggttgcagtgagctgagatcgtgccactgcactccagcctgggcaacaagagtgagactccatctcaaaaaaaaaaaaaaaaaaaaaaaaagaaaggtaatataaaaccaatgttagaaaagcttcatcatctaaggtgagctgttcacaaacgctaaagcaagcaaaaggattttataaagatatcaagatcaaagactcattgtgtgggatcagtgatgtaacaaagt

SEQ ID NO: 222102 - DNA, 420 bp, Homo sapiens
ccagtagagggcactctgttccttagatataacttacattcagttccgttaaatcaccccttgaatgtttcttgaaattgattctccttggaagatgcatttaatgtcttcatcaacatctgttcacttatgtttaataacttttgtcaaggattattttaaaatcttggggtttttttgcttttatctttttgtggcgatgagtggcgagaattgggaaaatatattaattttacaaatactgataatacagactcatatttaaatgattgtcattgtagttaaaagtctaccaaattaaattttgctttttagtatttgtacagagtccattagtagacttctctctatgtaggtatattattcccatctaaagtagtccctttttaaaaagaatacaaaattaggacttttcagcct

SEQ ID NO: 222103 - DNA, 456 bp, Homo sapiens
ttcaccctcattcatgtgcctgacctgcctgtttcaccctcatcatcacgccagcaggattaagggaacctgattgctccgcagagccttgctggagacccagctgatcttcaggcctctctagggctcagtctccctgctgtaaaaaggacaagtaattcctgagtttttggaaggattagaaaccagagatgcaacgagtccagtgccatacctcatcgaatgtgcctattaaatagaagctggggccaaaggaatcagccaggaagtctatgtgccctcaccatgtccttccccacctaccatgctcagagagctgttctggacacccaggggagttataataacagctcatattcactgagtactcaccggcactgtcttaagcacttggatgtattaactcaatcctctcagcaacccagtgaagcctgcagtattattattcccatttca

SEQ ID NO: 222104 - DNA, 503 bp, Homo sapiens
cgactgctttaccagcagctctggggttatagcagactaatttatttggattgtagaacggaaaattaaattctcccatgagctcatcagacagagccatctgcagatattgggaactcaatgaaagaggcagctgcaagcaggagacagcaatagtttatgatgacagagaaaagaactagacgtgtgtgtgccagctttaaggtatggatattcaccagggagatttgtgaaagactcacattgaatgaatttttaaaaagtcagaagttttaaccagcaactgaggggtgatggggactaatgagagtcaggctatttatttattcaacaaacatttagtcaatgcccatcatgtacccagcattgtgctctacccaagagacataacggagtcccacccttcaagaagttcacaaacaaatgagcaagacaaatgcatacagtataacatgctaaaatactacgacactagacagatattcggggcactatggaagcac

SEQ ID NO: 222105 - DNA, 720 bp, Homo sapiens
ggggaggcattggaaagaactggcagaatattttattccatttgggttggggcagagttcattggtgggtgtttgatggttgggatgtgagaatagaatgagaatggtatcctttaaagttatttagtgtaaaacctgcataattgtacaaccatggggacaagggcaggggttaccgtagggcccacatgggcccagtgtaaatggtgtgattgcggcttgggagcagaggacggggctcaaagaaaaggcattcacttgcttatttagcaagcacttaccaactgcctactatgccagatacggaggcaaatctgagtaagacagttgccatcttcatgtgactttaagtctaatacagagagaccaacaagtctcctgttgatcatagcccacagaggtgctctgagagaaaaacgtgcaggatattacaagagcacagaggaccagccaacccagactaaaaatggaggaggtgatggctgagatgagtcttgaaagataagcagaggctgggcgtggtggctcacgcctatagtcccagcacttcgggaagccgaggcgggtggatcacctgagattaggagttcgagatcagcctggccaacatggtgaaacctcgtctctattaaaaatacaaaaattacactttgggaggccgaggcgggtggatcatgaggtcaggagatcaacactatcctggctaacacggtgaaaccc

SEQ ID NO: 222106 - DNA, 466 bp, Homo sapiens
ctcgtgaatatctcggctttctcactgtactgggttgaataatgtcctcctcagatacaggtccttctcagaatgtgagcttatttggaaagagggtctttgcagatgtaattagttaagatgaggttatactggagtagggtggatccaaaatgtccccagatcccaacacaaatggtgtccctgcaagaggagaagagacacaaaaagacacacaggagagaataccacgtgaaggcagaggagagattggagtgcagtgtctacaacccaaggaacaccaaggactgaacaagcaccagagactagaagagaggccattttctctcagagcctacagaaggaaagcagccccactgacacggtgattaggatctccagcctccagaactgggaccaagtaagttcctgttgttttcagccgcccagcttccagtaatttgttacagcagccctaggaagctaa

SEQ ID NO: 222107 - DNA, 362 bp, Homo sapiens
gttggccctgtgacacagtgctggccagggacatgtaagtacaagtccactggggagagctttctttccataatcaaaaatcaaaaccttatgggagatatttttaggccttcagccttcttcctgccaggaatatggaactgatgcctggaggttcatcatgagtatgaaaacaaattcgagggaatgcacagcagatggatagaaggactttgttttgtgatgtcattgatgacctgcagtcaaaccattcctggtctgcccagccccagactgctgattgcctaaaataaaatcctgtgtgtttaaattgttgttacctggtttttctgtgagtgtagccccacacatagtcttagcca

SEQ ID NO: 222108 - DNA, 424 bp, Homo sapiens
gaagtcaccagcttctgaaaggcaagcctctttctcactggacattaggccatctctagcaggaacctaaaacatatcaacatatgaagtataggttccttcatgtgtacccaggttcctaagagacctctaagactatctgacagtaattcaaagccagggacagcaacaggatttttttttttttttgagtcagggtctcaccctattgcccaggctggagtgcagtggcacaatcatggctcaccacagtctggacctccctggactcagctgatctgccaacctcagcatcccaaggaactggaaccacagacatacaccactacaccaggctaatttttctattttctgtagagacccgagtctcgccatgttgcccaggattgtctcacctgtgaaaagtaggtaccgagctcgatca

SEQ ID NO: 222109 - DNA, 493 bp, Homo sapiens
gaagtcaccagcttctgaaaggcaagcctctttctcactggacattaggccatctctagcaggaacctaaaacatatcaacatatgaagtataggttccttcatgtgtacccaggttcctaagagacctctaagactatctgacagtaattcaaagccagggacagcaacaggatttttttttttttttgagtcagggtctcaccctattgcccaggctggagtgcagtggcacaatcatggctcaccacagtctggacctccctggactcagctgatctgccaacctcagcatcccaaggaactggaaccacagacatacaccactacaccaggctaatttttctattttctgtagagacccgagtctcgccatgttgcccaggattgtctcaaactcctggcctaaagccatcctcccccactcggcccctcaaagtgctgggattacaggcatgagctaccatacctggccacaacaggaatttacaagc

SEQ ID NO: 222110 - DNA, 456 bp, Homo sapiens
ccatgctctcatgggcctttccagaaggagcagcctgagatcctgctcacttcataacagagcccaggagttgggctccctccaggcctcatcttcccagcacctcagaagtcagtagggccagccatgctggtgttctcccgctctcagccagggctcctcacatttgatgaaatctccagtcctgttaatgtgtctagaaagtcaacttgtgtattggaggcaggggtggagggagggatttgaaattacctggaattctttgtcttagtgcaatttgtctaaagttactgtattcttttctttccatccatcccctgcccccaagcccacaaatcctcaatttctaaaaactggaagcaaacacataataagccatccttctgtgtttgcaatctgcttgtcaaacttatggagccaaagaaatagtattaaaaataacgataataaacatgg

SEQ ID NO: 222111 - DNA, 237 bp, Homo sapiens
gtcctctatagccactccggccaggtcaagctgggggcaagtgaccttgagaccctaccctcaggcaagggaaggcccgtagtgtcccccagcagggcagatgttccggatgggaagatagcgaccccaggccacgctgcgcccctctgagccggacttaaggcagcatcaaggatccgctgctttccgtgctccggccctctggcgccccctgcaggcggctgggggaaggtcagg

SEQ ID NO: 222112 - DNA, 420 bp, Homo sapiens
ttgccctccccattgcccagggccacccccctctggcaggggcaggaccctccaccaccccttccttccaccccctgtggagcagagccccatcctcccagcagaggaaagtgcaccccagtgcctgctctctgctgcctctttctggggtccttgttcctgtgtgcagcccctggacaccctctcctgactccagcagatgccagccctgggtccagcctggtgcctgtccccgtctcccggtggggagggctgctatggcttccagggtccccaggactttgggcaacggtggcgggggctgctggaggggcctggcctgcgcctgccgagtggggtgggggaaagagggcaggccccagccagtgtgggggcctctgagagccgagtgtgtgggggcctctgagagccgagtgtgtg

SEQ ID NO: 222113 - DNA, 396 bp, Homo sapiens
gtttcagggatttaagaaaatgtcttttcagtcattagctgcccaataaactgagcatagattttggtggccacacatgataaagaattcagacttcataaacttaatttaagaaagtcatgaaacaaacaatagaagcagcaacaacagcaagaatgaatagaagaaacaacaataaaccctgaagagtcaggaattatcagatttctagagttaccagtgacatcattttaaatgtccacctttaacaagaaattataaggcatgcaaaaaaacccaagaaagtatggtccatacacaggggagaaaaagcagtcaatagaaagtgtccctgaagaaggccagatgttatattcactaaacaaaggccttaaatcagcaattttaactatatcc

SEQ ID NO: 222114 - DNA, 282 bp, Homo sapiens
ctccccccacttctatacttagagaggtggagaaaacaggagaagggataactacgacttttgtcctcaaataccaggaaaactagtaaaacacacagtatctcattttatgcattcatttgctgaaaatatttccaaagtttagaaaaatgatttttggatgtactatataataaataaaaatgcactcagaatgctagagtgtctaccaacttaaaagaacaatattatttgtttgactgtgattatccttaggaaaaaataagccctgatttaacttat

SEQ ID NO: 222115 - DNA, 253 bp, Homo sapiens
tttggggagtatagcaagaggctgagtgggaaggaggtttctggggcctctgttgtcctggaaggctgagatttgctctacatgtgatatacatgtgtgtgcatgtctgtgtctatgtgagtgcctgtgcatgcatgtacatgtgtctttgtgtctctacatgtatgcagtgtctctgtgtgtctgtgtatacgtgtgtgtttgtatatctgtacatgtacacactggcttatgtctatttgcatgccatgtg

SEQ ID NO: 222116 - DNA, 551 bp, Homo sapiens
atgggactcataatgccaggcttcactgaatttttgtaggaatctcacgagacaagacataaagagcccttggagtttggatcatagtaagcactaaatgtatgcttcctgctcctgttaccattgtaaccaggcaacatttttgttttcttaactattgcaacagtatttgacttggaacaatagccatcgggaatagaaggttagatcctgaggacatggacggacgtacatccacaataatcttagcataaaagaaaagagagatagttaagcttctctgcacttgaaaacaagaggatgggagtattgggagaaacagaaagcagaagagaaaaaggggaaggagagaggcaccgaggagctgttgtgaagctggggattttataggatgagggaagggtatctattcgctaaggatgggatagtggagaaacattttacaaataaagatgagtcaagttaaatttgaaattatttttgtttcaacatgaactgcacttctgtctcctcatgccaccaaaagttttaataaatacattatactcaca

SEQ ID NO: 222117 - DNA, 561 bp, Homo sapiens
atggaacttgggacctatttagtctgttttatatttagaagtttgagtttgccctattggtcagtggttttcaaactctgtttgaagcctgtcatataatcaataatttgtctggtctttgtcctgggttcctggcacaaataggagtctctttattattcatgagcctttgcgaacactcttcagtttgtgctaatgaggtgattcatggtggaacctagatagcttcaggatggatgctgatcattccagaaagatcaactatgtgattaaagagttgaggctttgaaccatatgatagcagcccagcctcctgaccgtcaggaagtggagggggattggaaatggatctcactcatgtggccaaaaccccaaaaaactctggatgccaaagctcagtggaacttcctggttgatgaacacctcaacacaccagaatgcagagtggcagagagtgtagaatctctacatttggaaccctccaagatgtcaccctatgcgtctctacatttggctgttcctgcctagtaccctttataataaagctgttattgtaaatat

SEQ ID NO: 222118 - DNA, 524 bp, Homo sapiens
agtcacaggcaagagacatgactcccttggagactctctagaaggtgctctttgcctcttttaacctctggtggctgccagtattctttgactattcttagatcagtttaatcttgaaggccagcatcttccaatctctttctgcttcatcttcacattgccttcttctctgcctgtgtctaatctccctatgggcttctcttagaaaaacacatgtgtttacatttaggagggtccacctgaatagtctaggataatctctgcatctcacgatcctcaatttaattgtatttgcagatttccccacccttttctatataaagtaaccttcagagattaggatgtagttatcttttgggaggccatttttaaaaatattttttaaaggaggcagcagatcaatattataattcaagaatctgatctaaatatgcattcaataatgaagaacatttgagtatggactagaaaagcttctccaaaaaactttcaaatatatcatctcaaattacctaaagaataaa

SEQ ID NO: 222119 - DNA, 313 bp, Homo sapiens
tagagggaatcaacaaacacccacactgagatgtcgcatatattggaattatctggcaagtattttaaagcagccatcataaaaatgttttcacaagcagttatgaatgtgcttggagcaaatgaaaaaatagaaattctcagcaaaaaaaaaatgtaaagaagaatcacgtgaaaattttagaattgaaaatacaataacaaaatttttaaaaaaacataatgaatggactcaatagcaggagaggccagaggcaagaatctatgaacttaaagatataacaatagaaattactcaatttgagcaacagaga

SEQ ID NO: 222120 - DNA, 1621 bp, Homo sapiens
actttttaaagcctctggaaatggtccaaaggacattgagcaaatgaagaagcatctattcaaaaatacctacaagaattggataagaaaagcaagagtctgtgatatttgaaccaagaccactgcctccctttcctctcccagttaatgagccagaaattttacttcagatcttgccttcaagagctccagctcctggggggagggaaggctttcctccttggaggaggaggacgtcatcatttctcatcctgacctactgccagttgcagcggctcagttccagctgagtgctctcaagaggtgggggctctcttgtaaagtactgttgggaacactggggccccaatgcccaggaggctgtggttccataccacacgaggcaagctgagaagaccacaggagagtgctaagctccttaagtgggggtgtcactcaaagaaaaacatgccattcttccactccctgttccagagcttgggcttagtgattttgccagtgtggcctaaggagttcataaaactgatagctcctaatttcttgctgaaggaattgacttcatttgcaacagaagatggagaagtccgtgtgccttaagggctctctcaaaaacagtggagaaaaaaggaatgaaaaaaatgaacagagcagagcctcagagaaatgtgggacaccattagtgcaccaaagtccatggaacaggagtaccaggagaacagagagaaagcaaaaatatattcagtgaaataatggctggaaacaccccatatttattgaaagacattaacctacatatccagggaactcaatgaactcaaagtaaatgcaaagaaatccacaaatagacatagcatgttaaaatactgaagtcaaagataaggagaagatcttgagaggagcaagacaaactcctcatcacttacaggaaatgctagtaaggttaacaactgacttctgagcagaaacagtagaggtcagaaagcagtgggataatatattcagagtgctcaaaaatctcaaccaataatcctatatccagcaaaactgtcctttaaaaatgaaaatgaaataattcccaggtaaacaaaaacagagaatttgttgctagcaaacccaccttataagaagtactaaaagaagttattcagcctgaaagcaggtgatctctggcagtaatttgaatccacattggtgagagtggggaaagaaacactggtaaagttaattattatggaattataaaagacagcataaagttctcatttttttcctgttaactaatttaaaaagcagttctgtaaatattgtgtatatattaggcctatgtaatatttaaatgtaatattctgtaatatgtatttgcttatagcacaaaggagcaaaactgtattgggctaaaaaaatgactgcagatagtaaagtaattattataacagttaattaattggtgtattacagtaatagatacaacagatagaatactactacagaaggaaggagaggggaatagagctataaagggataacatttctgtatctcactgaaattaagctaggaaaaatctgaagctgattcttataagttaagatgtatatggtaagccttagagcaaccactaaa

SEQ ID NO: 222121 - DNA, 821 bp, Homo sapiens
tggtgctcagtaaatctacttttattatgacaacaagacttgatctttcaaatcctttatctcattgaccacactgatgttgtccctgttttatcaatgaagtaacaggcttggagatagtgagacttgtctcaggtcacatggccagttcaggggcatagccaggcttatccatgctctgactcccactccagtgctgtctgcatctggaatgcagacccccaacagtggcccagccccgcagtggttccagggaccgtgggagaccttgtggctgagggtcgagcctgtggttctttcattccccctccccatacttgaccttcagcctccgcactgaggcgcctttttcacagggcaagcatgggcagctaagaggagtgggtggcagcacatggcacatcagatggtcagaaaacaatgccaggtgctgctgagctggaagagccagagtggccaataggcttttgtcaaaattttttaaaaagtgaaactcagaggaacattttcctccccagaagaaaaggtgtgcagcccacctggtaggtaggtccaggcatggacccagcaacagaggcaagtggaggacctgccctccctggtgactctgggtgagcctcagctggtgggttgcagagctgccctggccccagaagactcaaggctgccttaagactctgctccaaaacaccatggagtctgtgctccactggctcagggaatgctggggcccttccacctccctgagctttaccctggggatggtgatacaagtcttctctgttcccaggccctccagacctccttggatgaggagcaga

SEQ ID NO: 222122 - DNA, 602 bp, Homo sapiens
tgattcacttttgaagatgggagtgagtctgagttctcagttcttagagcttgaaaaaggttgagaacacaagcgcgaatggttataaatgatcacttctgaataaatgaagcttgtttgaaaagctaaagtaaaattatcttcaaataaatgagtttcatttttagctgtctgaaaatagttattaaagaagataaaataaatttgaaatttgtacatcttactgcttctttctatagtcgtaaaagtactaattttaagtagtattcccagacttgattaggaagtagtctgaaaatcactagcctagaggacttgtctatgatgaatttgttgtgccagaagtgtcttttattgtcggtttttttagtctcaaaaatggtaatgggtatttggatattttgcttttgtgtaaatggtgggataagatgtataaagagattttattgcctgaagccttaatatttgtagtttggggcttggggtaaaaagctaaccagggctgattgtgattagctgtttagaatgctcatacgttctgtttttatttatttatataagtcctgtgactaaacatggcatgtaaatatactgtttttaaa

SEQ ID NO: 222123 - DNA, 451 bp, Homo sapiens
aacttggtaagttataggcaccaatcagaacacatgatgtcaacactaaaggagacagaggatgactgtcctggcataagcagagggtcattaaacaatgggtccccatgtcaatctcacagcctcccaacaatctgagggcctttgaatcctctagcagacatggaagtgtgggaggaggacaaggctaattaagggtgagtaataagaacccaagcctttttgtagccacctttgaaaggcagatgcagaatgccccagcaatgaaaattcaaaacaaaaggtccagcccaccttcttcccttaagcccttgtcaaagattaaacagcataccccaaagccacagacaagtcataatatgcccatattttatctgggtcgtattgtgtgcagcataattaatgtttaaaaagcatttctgcaataaaatgtctccatgataaatggaaa

SEQ ID NO: 222124 - DNA, 503 bp, Homo sapiens
gtcaaccagaacatgactggacatacttttgcttatgcagcagctgctgtagtcattctgttactaaaatccctgactctgtgtctctaatatttttaacttcaatatctaggtatattttctacgttaatatggttacaacttacggaatcattgtgtcatttacctgctgatttaaataatttagttatcctaattgaccagttcattactacggtctttggaatgaagttttatagtgtagatttagtttagagcattcccattaatattaaataccgcctacactcctcttcctgtgtctttgagcatagcacagcaaaagagttgtgcaggcattttcgtgggcacagggagagtaggcatttacctcttatatgatcaagtgtaccattatggcctagttttctgataatgataattttctacctccctctgaacctgcttaatgattttaaacagcctcattcaactgatttaataaacatttatttctgtgtgta

SEQ ID NO: 222125 - DNA, 420 bp, Homo sapiens
cagcctggccaacatggtgaaacccagtctgtactaaaaatacaaaaattagctgggcatagtggcatgcgcctgtaatcccagctgctccagaggctgaggcaggagaatcacttgaacctgggaggtagagggtgcagtgagccgaaactccaacctgcgtaacaaagtgagactccgtctcaaaaataaataaataaataaaataaaaaataaagttggaggaaaaattatttgaaaactggcaaatgaaagccttatgaagctacaaaacctgcttctgtgtgtatgtttatatgtatcatgtgtatgtgattttgtaactgagtgccctatttttaatttttttttcctcctgcagccctctgtattaactttttagtaatgaaataaaaatcttgactttctttccaccaagca

SEQ ID NO: 222126 - DNA, 1014 bp, Homo sapiens
gtaagtgaaggaagaggaggtggttccacggtggcagcagagcaggaagggaaggccagagagggcacactcaaatggctttgctgtcacctgggcaaagacacacaggtgagacctccacctgttggcgggagccaagcttaacagctccgtctgggaactctcatacctgagaccaggaatctatgtgtaaaccctttccagtggcagaatctggcagaaatggagccgataagtgtctgtcttcctgctagactgctgttcttgaaggtagcactgcctcctggtctcctcagtgtccccagggctcagcacagggaaggcaatggaggtaaagttgtgttaaactgaaatggagagaaagacagtaattgggcttctgtgccacacagtggttatagaaagcaagcagaccctcaccagccttgtaggggtaagaagaaaaataggtcatatgggtagaatccgtgtgttgtgtgttctacataagcacatacttacttttgcctgcctagatgcagacacaggtttcttatacttcaaaatttgtggtacctttttgtagactattgcatatcgattcttaactattccaagtagcagcattaaatatgttcttgatgacattaaagagttaattttcatggtcgggtagttcattcttgtctctgtcagcctgggctgctatagtggaaaaccatagactaggggacttcaataacagaaatttatctctcacagttctggacggctgggaagtccaaggcaagggacagcatggttgggttctggtgagacccctctgcctggtttgcaatggctgtcttcttgctgtgttctcacatggtagagcacagagatcatctttctggtgttactacattctaaggataataatcccattcatgagggctcaaccctcatgatctaatacctcgcaaagtcctcacctccaaataccatcacactggggattaggcctcaacattttgagatttgtggggacacaaacat

SEQ ID NO: 222127 - DNA, 352 bp, Homo sapiens
atggagcaggttataggaagagtacacctgaggataaaaagtacagtcatgtgttgcttgatgacggggatgcattctgagaaatggtaatttcggcattgtgtgacatcataggatatacttacacaaacctagatggtttactcttttgctctgatctgtacagcatatcactgtactgaatactgtaggcagttgtaacataatggtaaatgtttgtatatttaaatgtagaaaaagtacagtcaaaatacaatacaaaggatttaaaaatggtacaccatggaggttgcagtgagccgagctgagatcgcaccactccactccagcctgggtgacagagtgagagtca

SEQ ID NO: 222128 - DNA, 459 bp, Homo sapiens
aaggtatcaaaataataccataattattaaaatgcattaatacaccaatatatttcactgtaatgtggaatgtttacatgcatcagttaggtgtgggttgtatttactaaccatgtatggttagctatgttgctaatatctattgcacagggttggcgtacccaagcggtttagtaaggttatccttctcttccccaatatgctgcccccagtaaaataaaaaacccacgctaagcttcatcaggttacttcacacgccactgaccaaccaactcactactcagaattcatacacttcccttttttccagaggaagattctacacagtctcagttagttggtaaattggtaatggataaggattgagaagtctgagtttgggggagaatgaaacctttcccctcctgagaacagaattgggatggtgggcggggggaagggagggacaaaaaaaaaaaa

SEQ ID NO: 222129 - DNA, 411 bp, Homo sapiens
ggctggcccacaaagtgagaccctgtctgtattaaaacttttaaaaaagtttattaaaaaaagaaacttcctagaaccatcaaggaatttcagtcctttttgaaagtaagtataattaaaaatatgaaaaggaggcaagaggtgtttctgatctgttctgatcaatgttgattcatccagtaatcagaaaaaaaagtacaaattctgatgcttctagtttcatatctagactaattaatgtattgtaaatttatttatttgagacggagtgttgctctgtcacccatgctggagtgcagtggcacgatcttggctcactgcaacctctgcctctcgggttcaagcaattctctgcctcagcctcccgagtagctgggattacaggcgcccgtcaccatgcctggctaattt

SEQ ID NO: 222130 - DNA, 434 bp, Homo sapiens
agcattgtaatgttttatttatgtggaatcattgaaagattacgatttaaatgccagatttttctaaaaatgcatactgccttcatttatttgctttttgttctctcagtcacttaatgaacctcaactatagatcttctttactagatctggctgatttttagttgctctttgtcattcttgtcaatcctatagatgaaacgactgatttttcccactttgttcttcatatgtctctctggcaggccccttccatccttaagtgactgctaatctgccaggtaacaagatgtgatgattgccttcaaatatgagtctccttttaggcattaaatcctgtcaacttcaaactctgggtttcagtaaatgttcccaagtcttttgccagggctgggatcagtgactgtccctgagtgcaaaatttaatggaatgc

SEQ ID NO: 222131 - DNA, 374 bp, Homo sapiens
atatttttgttggctgcttgtatgtcttctttttagaagtgtgcattcacgttctttgcccattttttaaagggttacctgtttgtgctcattgaattgtttaatttcctgatagattctggatattagacctttgttggatgcattgtttgcaaatatttactctcattctttaggatgtctgtttactctgttgatagtttcttttgctgtgcagaagctctttagtttaactaggtcccactggccaatttttgttattgttgcttttgagcataattctttcccaaggccaatgtccagaatggtgttttctagattttcttctaagattcttatagtttgaggttttacatttaagatctcaattgatc

SEQ ID NO: 222132 - DNA, 548 bp, Homo sapiens
agcctatcctttatttgcttcaaggaaaagatttcagctcagagtcccattaaagcagaaaaaacacacaataatcatttaactacatgacagacagcactgtaagtaaatggcaaagtaaatgggcctctgtcatcacatattcagccatctgcctcctgagaaacaagggtgcttaccttcttattatcttcttgtttcaaatggggtaccttgatataatataaactaaattccaaaacagggcaaaaataagaaaatatttgtcttaaagagacagctcagaactatatattttaaaataacggaatttagattttatacaaaatgtgtggaaaaatgacaaattatagtcactaaacataaatttcattaaagacattatcaaatatcatagatgcaaataaaaacaacaataaaaacttatggttagagtagtattaaaaatataaggctgaaaccagattacatgagttgagcgagtcgggagcagaggaccagcttgctggctggtactggaataccacagaggctccaccactcattag

SEQ ID NO: 222133 - DNA, 370 bp, Homo sapiens
agttcaagttttatttcttgcttctagaacggtagtgagcggtcttcagcctgagacccaaccctaggtaagtagctgaattggggttttgtcttggctaaagtttaacaaccagctggtcttaatttctccttaccattagagcactcagtaatcatataagttgtgtgatcattcattttgcttaactgtttgtttctgtttttattgctgtttcagtctttttcccattgggtttgacctactctatctgacttgatcaaatccaaaggaaatttccaaattatggggaatgaggcctctgaagtggctaaattcccaccctcccacacacacaaacgtggtatggtgggggaaaaaacggccagca

SEQ ID NO: 222134 - DNA, 367 bp, Homo sapiens
gcacgaggtgtgtcaggggttgagggagcaaatgatcctttctacaatcagggttgctgaagggaaaggcagtaaggcagatggataagagagcaactggaattttaggaatatatatttacatagttttgtacagttcagtaataatccagataaattgcttaggccagatggttggtttatcaagccatgcagtgtgcctttttgtatgcaaatgaaatgtctacatatcaagagagccttgggcagaatccaaaatggagcagccaatttgccctaaaaggtgataaatttaggacccagagaggagaatactggaggttgacaatattgtttcctaatatgtcctagtgatttaattttaata

SEQ ID NO: 222135 - DNA, 513 bp, Homo sapiens
caacaacttcagaaactgaaagaggaggaaagaaataaattccagccagccgaaaagatctcagaaatccactatggggacaccttattgaacacatcatccatatgcctcaagaggattacatcagctggctgcagagccggatcaacatacccattgggccctacagcgccctgaggtaggctgggcctgggttgaccagctgtctcagtggaggagtgtttgcctatatcatgttcctgtatcctgcctgtgttcctgcctcctgactaccctcatggatgctctttatggatgaccctttacagtagggtcatctggagactgacttccagcaacatttttagagggggatggccccggtggccctcccctcaattccacaccccagacccaacctaccagtctctgttcttcaatgatccagcctgactctacctacttcctcttcagattccttcaccctatttaccttcctcaaatactggagaataaaattgaactgaatgtttg

SEQ ID NO: 222136 - DNA, 623 bp, Homo sapiens
aagctggaaaggggtcctcttcaccaaaggaccaccccaatctgatgctccaagattatgaatgcccaaatggtattcctggggccaccagtctcagtcacaaatcttccaggatcttgaggggagggagagaaggtggagtctacttttcagagcaaattctgagattgccactgtgtctgcctcacagtttgtgcgagaacacatcatccatatgcctcaagaggattacatcagctggctgcagagccggatcaacatacccattgggccctacagcgccctgaggtaggctgggcctgggttgaccagctgtctcagtggaggagtgtttgcctatatcatgttcctgtatcctgcctgtgttcctgcctcctgactaccctcatggatgctctttatggatgaccctttacagtagggtcatctggagactgacttccagcaacatttttagagggggatggccccggtggccctcccctcaattccacaccccagacccaacctaccagtctctgttcttcaatgatccagcctgactctacctacttcctcttcagattccttcaccctatttaccttcctcaaatactggagaataaaattgaactgaatgtttg

SEQ ID NO: 222137 - DNA, 423 bp, Homo sapiens
aatagtaaaatagttgggaatgaggttgagcaagaaaagaataaaggaataaaagtatacaatgccaaggaaaggccaatagaaactattctttttgctttgcttctcttagtgtttttttccagtgtgactctgtagataatggcaaagagaaatgcagggtcattttttccattttcaagtaaaacttattttgcacaatagacccactgaggcttgcactcattcatgtctacgactcccatctctccagtctcaacaaaagtgaaggtggccattgtgtcctttcattgttctgtgactttgctgcccctttcttgctttttaaaataagttccttagaagtatggaatggcgggaacgcatgccctttgtttcagcaattcagtcaaaatttcccaacttgccttcaatgttagtaaa

SEQ ID NO: 222138 - DNA, 496 bp, Homo sapiens
atactataacccagttctctgatttctctttttcttacatttatcttatgtgtttttgtttacatttatcatatgacatataaaatacaaagcataacaaagattttaaagttaaaaaattggcacatacaaatataaaatgaccaaatgtcaatgattttattcaactcttaaataatgaaagaaaatcagtaaggtattaagactgatttagaggaacagggataaatataatcagtaaaaagaattctgagataaatatgtgaacagatataaacatgtttgaaatgctaaagggcaacaatattcaaggctgtcttttccgtcagagagaaatcaagcacatccaattgcatcaattgtatcttatcccttcacattgttacacatgggaattctttgactcaaaaaataatctttgcaatgatatcagttttctaataagttaacctctacctctacaaatttcaaaaatagcctattcagtgaaaaattg

SEQ ID NO: 222139 - DNA, 481 bp, Homo sapiens
tataaactctcactttagattattggtatcataagagtacaaccactgtattttgtctttaaatgcataaggaaacataatctcaggaagcaggagtaataaacattgaagaaacagtaacatggagtttcatagaaatataaatacattaggagccataagagcttgaattgttcaacttttctttgaataactacaaatgtgtgccaaactccagtatctttgccttagacacaaatttcatcctggctttaaaaattagtattagtaatacgttattttttccataaagaactttgagtttggagtaaagcaagaacaactgctattatttgcctgctaaaattatattgtgaataattttgtagacttatccaacaatgtgctgtcctgcattttgtgtaactctaggtactgcagcttgtaatccacctactgttacaaataatctcaggaagtgaattactgtgtttctttgctg

SEQ ID NO: 222140 - DNA, 510 bp, Homo sapiens
tgaggtacagctacgggaggtacagcttttaaaaagagtaatccggccaggcaccatggctcacgcctgtagtcccagctacttgggaggctgaggcaggagaatggtgtgaacctgggaggcggagcttacaatgagccaaaattgcatcactgcactccagcctgggcaacagagcaagactctgtctcaaaaaaacaaaacaaaacaaaaaaacaaaagtcatagaggtttgttgaagggccctacagaagggaaattggagacttcttacaaaagagtagtggaagatttgtcttggggcttatactgtatagggaagaaagaaacctggtggagattggagattcaaggtcatggtttagtatatttctaaccttttcgtctgtagccaccttagtaagaaacacattttacattgtgacccagtaataaatgtatgtataactgagatagaaggttcataacacctttcttgtttgcagtccatgctgggattcctatttctta

SEQ ID NO: 222141 - DNA, 292 bp, Homo sapiens
aggcaaggaagaagccactcagtattctaaagcaatgggacatggagggatagaccttagcttgctaagggtcaccagcccacatggttgtggaattttctgtagctgagctcaataggctcacaaaggcagttgattagattaagatcatagaggtttgtggctgggtgcggcggctcatacctgtaatcccagcactttgggaggctgaggcaggcagatcacaagaccagggatcgagaccatcctggctaacacagtgaaaccccatctctactaaaaatacaaaaaa

SEQ ID NO: 222142 - DNA, 400 bp, Homo sapiens
tattcagtaaagtaatcctaagaaatgagcactataattattattttttatattcatgaaacatgtagtcatggaaacgaagcttcgtgcagttgaaaaacttgcccagggccaggcacagtgtctcaagcttgtaatcccagcactttgggaagccagggcaggtggatcacttgagcccaggacttccagaccagcctggccaacatggcaaaaccccgtctctactaaaaatacaagaattagccgggcgtggttgtgcatacctgtaatcccagctactcgggaggctgaggcatgagaatcatttgaacctgggaggcagaggttgcagtgagccgagatcgtgccactgcactccagcctaggtgacagagcgagactctatctatctccaaaa

SEQ ID NO: 222143 - DNA, 471 bp, Homo sapiens
tagaaaatcttgagaaacatagatacgttgtcatgatgaggattttttgaaaagtacagtcatgccctgcataatgacattttggttaatgacagaacacatatacaatggtggttccataagattataatactgtactttactgtatcttttctatttagttatgtttagatacacaaatacttaccattgtgttataaatgcctgcagtattcagtaccgtaacatacagtaccggtttgtggcttagaaggaataggttataccctcaagagtaggtgtgtagtaggctataccatctatgtttgtgtacactctatgatgtttgcacaatgacaaaattgccaaaggatgtatttctcaaaaagtgtctctgtccttaagtgacacctgaatgtatatgacccttaaagtataggaaattctaaaaataaaatcctgattgggcaatcttcatccaaccaaatgaga

SEQ ID NO: 222144 - DNA, 441 bp, Homo sapiens
tacataattaatgacaactaaacttcacatgatccttattattaatagagaaaacaggatgaaagctattttaactacctcagaaaattattaattaaaaaatttttttctaaggtaaagtctgaaatatttgaatgtaggatactgcagacaaatactcaaattttcaatagcaaattttcaaactggcaaaaatgtcatcagcatcttaatctacctacttctaccaacttctcaaaggagttagggagttaaaaactgggttcacgattctactttatttataccatgccttgcacaagggccaatagaaacagaatgactaatgacaaaatatttgggcttttggctgctataattgatgcttctgaacaatcatgctgagacaataaataaaatgagagtgacaagttcttcagcacatttctgcttcacagaagt

SEQ ID NO: 222145 - DNA, 112 bp, Homo sapiens
tgcagtgagctatgatcacgccaacgcacttcagcctcggcaacagagtgggatcttgtgtctaaaaaataaaaacgaaaaataaatgcacacatgcacttactcatctgta

SEQ ID NO: 222146 - DNA, 788 bp, Homo sapiens
aagataaaaagaggaagctccgctaaacatttttgttgctgctgctaattaccacaagctatgctttttattaattaatggctctacttgcctccaaatcctactgaagaactttgcgagacaacaggcacttcattcttctgtagctgcagacatgctgctctgtggtttggtgcatggggtacctgtaaattatcagcaccgagaatacgctagctctggaaaccaaggtagagaaaaaaatacatctggaagtctggttatgtgtaacttgaacttgctcaaagccttcagctgacactgatgctttttaaaaacatggcagtgataaattatttcatcactttgctcaaatacattaatgcaaaacattacaaaactagttttcttgactcagcttccagggtctaagaaagcattttattggggggttgtgatgccagagcataagggatgttaaaggtgacacttaaaaaggaaggtgtcgatcttggttctggtctggtggtgcctgagagcagggactccttgaaggtgcaagatgaattacactcctcccaggtgtcaggcaggggagagaagcaccctccatttagaaatatggaggattagccaggcacccgccatcatgaccagctaatttttgtatttttgtagagacagggtttcactatgttggccagactggtcttgaactcctgaccttaggtgatctgtctgcctcggcctccccaagtgctgggatcacaggcgtgagccaccatgcccaccctatgattcttaagagt

SEQ ID NO: 222147 - DNA, 499 bp, Homo sapiens
aagtcattaaatataagcaactgtatttacattctactatgagtatgacagaactctccaatagcaaaaccatgcatgttggaggctaacattctatatcctcgattcctggtatgtgaacagaaatagagcggtgtctcattcaacttagtgtttaaaaaaatattttttaaaaaatagagtagtggtaagaacagggtgtcagatgtaatttaaaattgctttgtttcacatctgaaataatataaatgtgttttatatgtctgtttattaccttttgttataggttttgtgtgtgttatgaaaatggactcgtgtcctttggggtggggtggaactttaatatctgtattctgtaatattacatgaaaactaatgctaacttttattcttccagtatgtgccatatctttatgtttaaaatatctcagaaagagcttaatcacttttttctggctttattttagttttgaagtattgctgtatttgctgtatagca

SEQ ID NO: 222148 - DNA, 363 bp, Homo sapiens
taaatattaaatacatttgttatgcttttctcttttttcctttgctacaggagtgttggccatgaccctcatggtgggtgaggaaaggtatcacagctttccacccctacaatcccaagtgtttaaagagtacctggtaaaagaaaaaatacacgacaaatacttaattttggaaaacatcactgtaaatttttgatcagatatgtgtttctgaaaaatctgtctgctgccagcatgttagtgggcttccgacttatcatcatgagtgaacatttatgttccaagatacatgtgggtgcagctattattactgtgaagagaagtgtgatgtgcctctctttctgtactcaccatattgacaat

SEQ ID NO: 222149 - DNA, 646 bp, Homo sapiens
tggtcactggtgctcccacactcaaactgggcttccagtcgcagctctgctgggagctagcttgttgaccttgggctggtaacttgcctctgccagcttcagcccctcgtccgggagcctcgcattggcctctcgaggttaccgcagcgatcgcatgcgacagtagatgcacggcgcccggcgggccggcacagtcgctgctcggaaatgacgccggtggtgattctcctctctgctgggtggctggtttggctgtccacactgaactcagcagagatgtttgtgcagcgatgacaaattgaggcgctgcccctgggagcttcttgaaaagggcttatttttaggccctttgcctcatgcactccctcgccactcctcgccggccaccccaggcctctcagggccctgcgcatctaggaacatgcctgcccctgccagcctgcaccacctctctcgcgctctcggtcacctctcgggttctcctctgatgtcacagcttcaccatagcaacgctcagctgcgcccccccccgcccccgcccccaccctacaatgtgaggattcggtgcaagaaagcgcagggagctggcggcttcccagcccgagagattgcatttgtatgccagagctgttcatgatggagcgga

SEQ ID NO: 222150 - DNA, 256 bp, Homo sapiens
gagcagacagattgtcctttgctaaggtcaggcagtcccagagctttctgagaggctgtttctgcacttaactcttttaggggacaggcccagagatgaacttggattcaggatgccgtggcctgttagctgaatgccagccgttgtcattactcaaagagaatctaagagcttttaacttctatgagcaaaaccagctaggtccacagagggatggtaaaggaggaaagtaacacagaaataaatataacaaacc

SEQ ID NO: 222151 - DNA, 818 bp, Homo sapiens
cagcagcatagatattacgtgggctttggcttaagaagacagaagggcaaagccacaggtggtaaagtcatgattgttgaaaggttctatatgataaagtgttaaatttcctcaaagtcataggattatggaactctcttcttcatgcttacctgcactttccaagttttatctgaacaatgaacatctagtaggtaaatcactaatgaagcttccttggtgctagggccacacttgagtgcgactgaatagtagatcctggggaaaagtatagtagaaccagagaatagaatgtcttacgtcagagtatattgaggtttccagcaacctaagcttgaatcagagtcccagcctctgtgagttggtctcaaggcccatggtccgtgctcgcttccagctccagcttcccgcttgggagaggccttggtttccatgagctgagcctctagattttggagaagattttctatggacaacacagacccaataacaaaagtactatgggaggaggctagatctgacttctaaacctgttcagttaccagagagatcagtaactccctaactcataaagggagggatggttaagcgaactagaaatatttagactgaagacttagaagtgggcaactatcttcagaatggtagagggtaaacacctgggagagccgtaggggacagcccaaggatacccctccgtgaagttagagggaggcaagtttcttggtttaggaagattattccaacgaccagagatgcccatctgtgagtagactgcctcctgacaccgtcccaccttcaccagaagctggatctca

SEQ ID NO: 222152 - DNA, 709 bp, Homo sapiens
ctgtcacaaattagtttttatcattcccatgagtttctttatattacacatttgtctatatctgtaaataatagtattgtttcaacattttgtattctatacatatgtgtgtatatatatgtgtatatatatatatgtatatatatatttttttgagacggagtttggctttgtagcccaggctggagtgcagtggcgtgatctcggctcacggcagcctcctcctcctgggttcaagcgattctcctgcctcagcctcccgagtagctgggactacaggtgcgcaccactgggcccagctaatttttgtatttttaatagagacggggtttcaccatgttggccaggctgttctcgaattcctgacctcttgatccgcctgcctcggcctcctaaagtgctgggattacacttgtgagccaccgtgcctggcctttgtattccatatttaaaaaaattcagcattatggtgaagggtatgtccatgttgaattgcgtggccgttgaacattcatttttggtattccattgtatccctaatatatgtatccattctgttgttaatgaacaattatgttgtttactttttacttttgctattatacgaagtgataatttagagatttttgttctgttgaagcacttcatatgtatttaactgcttgtagtgaaaactctacttttctctttcagccatcatttctaccca

SEQ ID NO: 222153 - DNA, 501 bp, Homo sapiens
ccctccacctccagcccagctcctgctcagcgcggagctgctttggagaacttgctgctggcgcccaacagctgggtgaattctgcttacagtgttttccaaagaggcctgtaggacatctgggtcttccatggtggtgggggttttggcctcaacaacaaggctctggtggcagaaatgatagcaacccagtgaaaagagagggacaaaagggtcaaaggagtcagtgcaaaagcactgtctgggaaagcgaatcaacccagattgtcccctcgggaaacatggcatgtgcttggtgtgacagctgattctccccttaatcactgccatgaaaacaaaataaccataagaacaatggcagattagacaagggaaattaaggaacccaaatactgacaggacgcatttttgaagatacagcagactcctgggtccttgtgacaaccttcccacaccaattctcagaccaccttctacccgaacctgcacggtgtcaaaatg

SEQ ID NO: 222154 - DNA, 763 bp, Homo sapiens
aggcggttgcacttgtttttgtatcacttatgaaacctagtatagtgctttgtattatagtaatcattcattagatattatgtgaatgatttgaattatatttcatagtagctcaaagttagtcttgatggataaatgaatgtaatacaaccatatacattattagtaaggaacttaataatatcatgaagtatctttaaccaaagtaataattaaaaagtaggagtaaaccatagtaagttcaaatttagaatttgatagataatggagattactttttaggcctaaatattgaaggatagatgtttatgaaactttgaggttcaaattatttgtagaaatgtttatttaatattatattcaagatattaaaatgacaacaatgggaaaatgtataagagatttgttaaacacatcctgaaagcatggaaataaccatatatcttagcctaatgcatgaaatagtatagcaaatataagcaggatgttttcatttttattttaaaattgtgtttgtcactggatagggataataaatttattctatttattttttgctgttaaacatatactttaataaactaaacacatttgtttctgcagtggatggaaatatgtttgtcacaggtaaaattgtcacttgggtaaattttatctcaagcaactcctttttagttttaatactttctatgttgcccaaatcaagtcttatttccatgaatcactgttttatgtaataattttcttggtgaggtcaatttac

SEQ ID NO: 222155 - DNA, 300 bp, Homo sapiens
cctgcctcagcctcccaaagtgctgggattacaggtgtgagccaccgcacctgggctcttctttttagtagaacactttttccatctccaggattccagcaccatcctaaatatctgtaggtcctgtaagactacagatatacactgaaaatctctttcctggattctctaggtgctgtggcctgtaattcatctgggtcaagagacaagtttaattcaatttagacacaaataaaggttctccttagaggggagtggccacattggaagacaatttggcaacacactgatgtcactgaa

SEQ ID NO: 222156 - DNA, 473 bp, Homo sapiens
tagcaaccttgcagtcttaaaattactagttgtaggaactttcttgtttagattcctgggtgttttcctatgtgtaggcagtcatgtcatctgtgtatagaggcagtttttttccctccttttgaatgctctttatttctttttcttgccttattgcactagtttggactttcaggatgttgttaattaggaatggtgagcaggcatacttaccttactcttaatactgggtaaaagctgtctttcaccagtaagtggttttttttttggttgatgccttttatcaggttaaggaagttcccttgtatttctattttgccatttgttagattgaggaagttcccttttatcttagtttactgagagatggttgtttttaatcatgaatgaaagttgaatttttgtcagtgcttttttttgtgtgtgtatgactgggattatatgggttttcttcttaatctgttgatatggtg

SEQ ID NO: 222157 - DNA, 521 bp, Homo sapiens
ttccttattctctaggtgtttcccatacctaatgctaaacctggattatggccttctgttctctcatactaagttagtcaagctccctttattcaagtaattcctgaaatcttatccctccaaagttttccccaatgaattagaagtaacaaatttgtaaatttggtgacaacacttctgcatttactaggatagtggtgatttcaaatatcctgcctttgtttttactatacacctccatttacttgtcagggcacatgtcctgattattggttagaccatatatatccccaccaagtctcaaaatgccatgccatcattttcccttgtccatactcctcctacaactacctcactacatgtaaagaacttaattgacatttgtcctactttatgtatgtcatttggatctgggacagaaaaatatatgatacataagacatctggggagaaggggccatactaggatggggtgagaaggaatggggaggagagactgaaagcttagcagtaacccactt

SEQ ID NO: 222158 - DNA, 567 bp, Homo sapiens
caaatatatatacacacacacgtatcagtatagaaaaatgtgtacttttaaaattcagttgtcttaatctgaagctatttgagtcatattctctggattttttaaagcatcctacaatctgtatatataattaggggaagttgtaataattgcaggagttataaaagcgaaatttaggtggtgggtaagtgtatctacattttggcataaatcactacttttagaggatttatatgtcagactgataagtttcttaccatggtgaaatgacaagaataccactcaggcattggctgagacataattttgacagccagcaagcttgcagtgttgctgagtgcacagatttccacttcctgccaagattaaaattggcaaaaaccaaaaaggatattagggattgtcactttaagaagaaataacatgttaatgttctgcatttgcttaagaaatgtaagagtgatctcttgaactgtagtctgttgaaacttacaagtttgcaatcaatagaagagtttgattaatatgagcatcaaaaattaaaataagtagaggctctctgacact

SEQ ID NO: 222159 - DNA, 529 bp, Homo sapiens
gcatccaagcttaaatgggtggggggaaatacaactgaaaatatagggctgatgcacatagaggatattgtgtggatacagactcaattgtaagaatgtctagaatttattctgaggttcctgagaaaattgatcaatttatctcaagctatgctatgattacatttccaccactcttttagagattttaatttaattaaatgcaaatgttatacaattctccagtgtttattgttgtatttaattcccatatttgccaacaatatctttaatttctaatttttaaatgaaaatactgaaacagggagactgttcacattgaacatcaaatttggctaatactgatttggaaatatggttagatcctgattaaaatatttttcaacattacaatgaaaagaattaagcatatctatatgaaatcctgtaagtctttcttaaaaatgaatttctatctactcaagccagtgtcattttggaatttctgtcactatcagctgatcttcttgattcttttgttttattaagc

SEQ ID NO: 222160 - DNA, 226 bp, Homo sapiens
gccacttgttcttaacaactgtaaacctgcacaatgcctaagggcataaggctacttgatgatggcaaaggcaacaatgtgggtgatgcctgctctgcaagattaaattccatgggtttcagagagtaccgtaggcatatgaccaagagccactggcgaccattcattatgccagtaacctgactctagcctaggctcccctccctgacatcaaggcatgtcaaag

SEQ ID NO: 222161 - DNA, 403 bp, Homo sapiens
cacccaatagtgaaacagacaacgtggtgcaaaaagaggctaacggtctcactcctgggatttctgggactggctgcatagtctgtgcctacctcacttcctttcagtcttggagtctcttagcctctacaattagtctgttagtacaggcaaagaccagttgctgcttgtctgagtccattttatgtttgttttgttttgtttttgtttgtttgtttgtttgtttgtttttgacagtgtcttgttctgtcacccatactggagtgcagtggtgcaatctcagctcactgcatcctccacctcccaggttcaagctattcttctgcctcagcctcccgagtagctgggactataggcacgcaccaccatgcccggctaatttttttgtatttttagtagagac

SEQ ID NO: 222162 - DNA, 339 bp, Homo sapiens
tgtagtcccagctacttggggggctgaggcaggagaatggcgtgaacctgggaggcggagcttgcagagagccgaggtcgtgccactgcactccaggctgggcgacagagcgagactctgtctcaataaaaaaaaataaaagaggctgtctctgagcattcactgagcagctgggctgcggtcaagaaaccagcctcgacagaggaaagcacgttcacatgtgagtgcacagggtcgggggaacatgcatcacaggcaagcagccttcacctgtcttctaacagacgtagacagtaagtgaatgaaactatatttgataaggggctttctaccaaagag

SEQ ID NO: 222163 - DNA, 249 bp, Homo sapiens
gttatccttcccagaggcatctactgttccagtcataaaaaccacatatttgaaagtaattttgaaccattacttaaaacttttaaagatatattaaactcaatgaattttttaaaattacaaatgccccaaagtgaatttattaaaatttgtgctgaccaattgttttctatctagtataatgtcaaagatgcctctatgctatttggctttaattgtttaaacaaagttttgctttttttttttttt

SEQ ID NO: 222164 - DNA, 577 bp, Homo sapiens
ccagaaggtaaaaatgacatctgacctgattgggaagaattgtaattcttatatgtgcaaaaacagatgagagaggatttgcactttcagataagtgtaaccaatctaaatgtattgcattatatacaaaccacactacaccagatgacaagagatgagaaattcagaggcagctccagcattacaagttgtgtgaagatgggcatgcactatgccttcaaaccttggtctttatgttcataaatagctataaatataccttccttaacatctcatagctctcatggtaatcatgtgatgtcaaatatgagaaaatttttaataatctgtaaagtattgttaggtactcttaggtattatgaaaaattgtgcccactgttcagatctttatatctccctgtgtacctaactattggaatcatatgtcaaaatgaaaggcctcttcatttatgtataaagatattgtatcatccaaatattcaagttcatgtacactgtccataacatagtatatgcaagaataatatatatcaaaaatctgaaaaaaatcataatcgtgctatctatttaacattag

SEQ ID NO: 222165 - DNA, 1609 bp, Homo sapiens
ctaccttaatttgataatttcctcacaattaccagatttcattttttaaaacagaggagctatttatcttttcagtgtgataagtattctattatagaacattgtttgcctttgttcggaggtgcagagaagaaaacagtgattcatttggcaattctgacaaaatccaaagatgtatacaattacttcattcatttagaaaatattataggaactataatattctggacactatattaaatagtaaagaaagatcaatagacacaacctctgccctcaagaacttatagcctgtggagatacatcaatgaagccttcaaaaatttcaaaacagaaagcttaatctttagaaataaatagaatgtgtcttaaatattatgctgggtgggagaaagaagtaggaattataaagtttaacaaaattgttttattgacatgattctgtaatttggcaactcacattcaggtctcttactgctaaccacagcatctagcagcagtcctgaaatactgacacatttcaagacaattttttactaactctaccatttgaaagatcaataaacactaaggtgttcttgtgatgtctcttattcaaaagtcatattccatcccagtgtagttcccaaacattttcaagtcacatttctaaatctttaatcttccataacatatctggaatgaaaacaagcaaaaagtggtttccgacagccattgataaaaactggtgttgaaggataaggaattatttgtggagatggtaagattacacctcagaagagagtacatgaagacacggtaaaattacaagagaataacattagaaacaaacctcagcaaaataacttggctctatgatagggcttgagttagaagtcaaagattatacatactctaggaaagccccaagtttgattctgatacaagaagggtagaaagtggagatgggagcaaataatgtctgttataatgacagattacctaggaaatattggcctaaaactacttttaaattctaacttttagactgacacatcctttagagttaccactgtgaaaaacgaaactcttcaataaatgatcaacatattttgcaaatatattttgaagcataaggaactccataattttaaaatattaaccaatctggtcaagactacctaatagtctttttacagtattactgtttattttagaaactatttttcctcatcgtcaattatatgagaagtcaccatgaaagcaaaaaggaaatctacttttaattgaatggtgactgtaagccttttaggttacatgtacctaaatactatgcaataacaggaatttatcatttattttccttccttccaataccactttcctcaaaatatgcttctgcacaagatttccccatattgctacctagaaatctaacaatgaagggaaatattatacttaaacagaagaatgtcagaaaagaatactgatcatgagagaagtataaaaagtaagtctgatttgggggtcacgatgaaaacatttgtatttaaaaaaaggaaaatatttgcattaaaagccactttaaagcagactttaggcaaattaaacatgttgcatcctatgtcac

SEQ ID NO: 222166 - DNA, 310 bp, Homo sapiens
gtagaatgagttggggagaattcccttctccttgattttttggaatagtttcaggaggattggtattaatttttctttgtgtgtttggtagaattctgctgtgaagccgtctagttgtgagctttttgttgttgttattggaagtttggttgggagtttgttttgttttttttggttttggggctttttgtttgtttgtttttactaattaagtcttgctactcattatttgttgttcaggcgttgtacttctttctagttcaatcttgataggttgagcatttccaggaatttatcaatttcctctcgg

SEQ ID NO: 222167 - DNA, 287 bp, Homo sapiens
tggcccaccacccacagcttgaatctcaggctccaacagttgcctgacccccagattctgatgacagcctacctacttgttcttcaggccctcaccagactcactgcccagacacaccacacaggagaacatgaaagggtgaatgaatctttcatcatttgatgaccaagttggcattcttttacattccagccaccagaggaaggtgtattttaacacaattgccctcacatcctccttaacaggatttacataagtttattaacacatatgtttctacaaaatca

SEQ ID NO: 222168 - DNA, 609 bp, Homo sapiens
tgaatagaaggttatacagaagcattagatttttcttccagtattgtctgactggaagaaaattttgtagtgatatggatattaggtaagaaagcaaatatattaagctatttatgttaattttgatttcctgactacttgcatttaatttagctagccctgcttagtttcacccatctgcacatgtatgtatgttctgttacatgaaatagaagtagaaaaaacagaaagaaacttctccctgtaagtagcaggatgtgaagggccagaaatgcagcttaggcaataagtgaaaaagcatatctaaaaaatatagtttggagtctctaaccttttctaacccagtggtggctgttagcattgacactgtggctactttctggaaaacaaagtacattgattaaagatgattttggtaatgaagaaagttgtattcgaaccaattatttatgaatcgtggaaaaagcgctcaaagtttttatttggtcttaattgtgccttcatgatctgtttaccattgtcttatgaaaagattctttttttgcactttatatgtgtgtgtttgcatatctttttaggaattaaagattattctgaataaactcaata

SEQ ID NO: 222169 - DNA, 255 bp, Homo sapiens
tcttgggggtcattttgaatctctgtttcttctgtggtcacgttcatttggaatttacttattcaacccacaaccaatagacatttccagccctttgttagtataaacagaacttctctttgactttcacagcgtttttgttctggaggtgctatccttgattgctaagacacccacgacattgctcttggaattggagtagggtggatgaaatagtattcaaagatgggggtggtgcaaatgttctgtatttca

SEQ ID NO: 222170 - DNA, 268 bp, Homo sapiens
cacccctccatctcccgcctcgccgccggctgcccctcaacccccggcggcgtctgggtcggtcctcaggcgccggcagagcagggctaggggccccgcggcggcggattcctccagacacgctccagccgggactcctcctcaggggggtggagggggcggcggggagcgtgtgaggcgaggggcaggcaaaccgatcgttcccacccggccggagaagagcgggcgggcccgggtccggggggcaggatcccgagaagcggcggga

SEQ ID NO: 222171 - DNA, 662 bp, Homo sapiens
caacggcagttgctggggctaacagaactggctgttgggagagagaggcgaggcaacgccgcccggccctgccattccattttactgcttaactcaacctggagtgtcaggacctattctcctgcattctcgctgcactatacgggggagccaagtcactctgtactcactggacagccaggctgggtggaatagggttctagagtggagcaggggctctgccctttatggcgactttctaaaagattagcatcagtgtcttttgacagtatagcatctggggtgggacgcggagaggaggctttgcttgctaaacggcttctttctccgccggtgatctggatttgtttcctcggccccctccccccgctcctttctttctcccctcccgcctttagcaaagtgacacaggcgacacctgctcgcttgtgtgcgatgttggaactcgcacctcctcggtggtgacggtgccagggcactgctaccagggggacatcggcgggtttcccttccttccagcccacgatgcctagaagggcagcgggtgggctgcgtggggctctgcccgcagcacttcgaggcgggattgaggggctgaagctggccaggagttgctgctaagtggattcgagtggaaggcgccaagtctccgcgagggcacc

SEQ ID NO: 222172 - DNA, 311 bp, Homo sapiens
aggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaatttttttt

SEQ ID NO: 222173 - DNA, 396 bp, Homo sapiens
gagtcgcagctacaaggagctggtgctgatctcaggtgatctttctgcccagggctcctgctcagccagaagtagcccaggccagcatcacacggagacttctctctgcaaacatggtgcaccctgtaggcgcgcgggtgggttcctcgtgttggagaactcgtctttaaagcccttgtgttggagaacagcatggcctggcggtgggtgtgtggctcagcagttcctgcttctggctaactcacagcagagtgaccccctcacgtcccagcactctcatgcttcaaagagctccactgtcttcccctggaaacttctagaaggtctctcatccttcccacttagaaaactcttccttgctgtgattcacattcctgtggcattgttttcttccgt

SEQ ID NO: 222174 - DNA, 577 bp, Homo sapiens
attgttcttatctacagtgtactgctgcttctataatggctattttaaaataatatggcataggaaaaaattatcagaagacctaaattttgagtaccgattccaccctttgctatatatgtgaccttaggtacatgacctaaaacctctgagctcagtatctaaatctgcaaagtggggataataatccttctctggctaccttctagtttatgattataattaatgaactatatgatttacagttttaattgtcaagtgtgaaacgtgttatttagtagtattgatggaatctagaagatggaacatcaaatattactttttaattttttttttttttctttgagatggagtcttgctctgttgcccaggctggagtgcagtggcacgatctcggctcactgcaacctccgcctcccggattcaagcgattctcctgcctcagtctcctcctgagcagctgggattacaggcacacacaaccacacctggctaatttttgcatttttagtggagatggagtttcaccgtgttggtcaggctggtctcgaactcctgatctcaaatgatccacccg

SEQ ID NO: 222175 - DNA, 349 bp, Homo sapiens
taggctcagcctggcacttgaaccccgtgccctccgccccccgcccctcccagtggcgtctccgcttctcacttcagaggcagagctgtcatcgtgggcactgggaagtagcctgcagtgtcagcacagaccggcgctcaccaacgacacggcacggaggctttctagggagcagtccccccaggacagcaatacgttcaggcgacagcgacacagggcagcaacagcggttccctcctggcaggcagccagacgcacacacgcacgcagaccacaccatccagaaagttcacctgcgacctgagacgcagctctttgagggagatcagaagatcagatggtatttgag

SEQ ID NO: 222176 - DNA, 677 bp, Homo sapiens
tttaagcaagaaagggaaaatgtgacaaataaacaagatataaaatcataaccccaaaattaggtaaactggagtaacaaagttatttccacaaaaatttaattgctgtaattctcacaaagtggttaaaatattctaactgatatggagtcatttatttagaaactgggacttgagatttagcatgtttgcttctgtgttaagtaatgacgtttgaataatgaacaaggaaatgctaacaatcctaaatcttcacagttttctttcctatacctttctcgttgcattctagttgaccactgaaaaacacacatactatctgactgcagattctcccaatatattggaagagtggattaaagtgttacagaatgttcttcgagtacaagctgccaacccactttccctgcagcctgagggcaaacccaccatgaagggattgctcactaaggtaaaacatggatattccaagagagtctggtgtacactaataggaaagacattatattattttcggagtcaagaagataagtttcctttaggtcagatcaaactctgggaggctaaagtggaagaggttgacagatcttgtgattcagatgaagattatgaagccagtggacgaagtctgttatccacacattatactatcgttatccatcccaaagaccaaggtc

SEQ ID NO: 222177 - DNA, 677 bp, Homo sapiens
aaaattgagggtaagtatctgccatcctatatcacagtttgaagcacattatggaagaaaagtaaactcagagagacccatgaaactctgagctcctagcttgcaagtatgggcttaaattactgctctacacaagtacacctggggctgggaatcctcttggaagttcacatggttgttgacagaattcacttccttgcagctgtagaattcatggggactgtgtctttaaggccagcaggaggtgacacttcattttcttttaaaggactcacctgattaaactaggtctgcctagtataatcttttaattaactggaagccttctgattagtaaccgattatggaaacgctatcctattttatttacaagtcctgcccacacttaagggaagagtacagaggatgtgtacaccaggagatggtgaatcttataattctacataacacaatatctgacacatatttccaagagaaaagccaccacacattaataaatgataaattatttggaatttcaatctttcccactttcatatatttattgcaaggactatttccaccaaaagtaacccagctcaagatgtgattagtccatcttcactttcagctgctctgcctcttctaggtgtacctattatctgtctatggaccacaggcaatatccaaagttattt

SEQ ID NO: 222178 - DNA, 540 bp, Homo sapiens
gcgccactgcactccagcctgagcaacagagtgagatcctatctcgggcaggggggaaagaaagaaagaaaaaaacaattagccagttgttgtggcatgcactatagttttagccacctgagagactgaagtgggaaaatctcttgagccgaggagtttgaggctgaaatgccaccacacttcagcctgggcaacagagtaagaccttgcctcttaaaaaaaaaaaagaatcacgtaagattcttgtttaaaatgtaaaacaggcttctagatcctgccctcagaggttgtgattaagtaagtctagaatgaagtccagaaatctggatttttaacaagctctgcagtgaactatgattccgccactgcactccaacctggatgacaaagcaagaccctatctcaaaaaaaaaaaaaaaaaaaggggatggcgggcccaaatttggagggggaagggttttttggttttttttcttaaagggctttgggcattatttccatggggggttctttaaaggtttttaaccacgggtcccgggc

SEQ ID NO: 222179 - DNA, 361 bp, Homo sapiens
atagaagattttaatgtatgtcacagcatataaagttgtgatgggaagtgggaaaaaaaagaggaagagaggcaattatcagaaaataaaattttgtatcaattttgccagaagtgagatttgctttcatcctctttacatgatgtaggtttatgtttaagaaaacatatttaggctaaagttgaggacagaaagagggtatgtttgtatttaagttttaccttaaaaaagagataaagatggacaggtggggtggctcatgcctgtaatcccagcactttgggaggccaaggtgggcagatcacctgaggtcgggagttcgagaccagcctgaccaacatggagaaaccccatctctact

SEQ ID NO: 222180 - DNA, 591 bp, Homo sapiens
gagcttttgaaggttcagccctgtgctggcagttcctgccttgagtctgttcgtctgccccaggtctcttgggttcacttcccagaccgggcctggaagtatgctagagtgctcactcttgtacatttgtacactctgctggctcttcctgctgacatgggaagaccctttccccagtgttgagtcagagctttcagagcccttcccaacttcctgcctggcctggcttttatacatgcagcccagcctgttgcattggaaaacacaaaggacatggtctacctcactccagacctgagagaggaaaggaggcctccagacccatgtctagcctgccatttggatatgaccaggacagcatgtagagaaatttaaaagcagtagggtgctgtaaacttctaattttagtgtcaaacgtatgagataatcagtgttgtgatttcagatgaaggtgccatagtaagacaacatcatcttggtggacagatctgatcctaaaaaaacactttattttcttttttttgagatggagtctgggcaagagagtgagatgccatttcaaaaaaaaaataataataaaataaataaata

SEQ ID NO: 222181 - DNA, 160 bp, Homo sapiens
ccagcaacaggtggcacactccatgcaaccgacaccaaggtgcctctgctgctatcattctcttctgcggccatcattctctttccagaatgttcttctcctgccacttcatctggctgagtcctgctcatcctccaagcttcagctcataagccacctc

SEQ ID NO: 222182 - DNA, 239 bp, Homo sapiens
ttgtgggggaccatgctgtggaagcagcatcttggggaagggatgtctgggagttctcaggaagaaagtatcagggaacaaaaccaagaacagtgtttaccttagatttccaagttacaagtgtgttgtgttctaaaacttgatgaggtggtaattggcattccagatgcttttctcagatactaatctatgctagatgagtaaatggagtcttccctctaggacagaatatgcgagat

SEQ ID NO: 222183 - DNA, 508 bp, Homo sapiens
gtcctaatgtttttcaaaaatctttggagataatgttaactgcctatcaagagtcatttttctctgacataactatgtaaaagcactttgaaaagcataaggcactatacaagggtaagatagtatatttttaaaagtactgaactgtaacccaattccatatgtttttgtgatttctgtcatgtattttgaaacaaaaacatacatagctaccaagtatgtttattataaaattattcccatagttcataattcattcttagaatgaagagttattatactgaagtgtaatggctatttactccttacttatttataccctgtcttatttttaaaagttttaaggtactttagagattaatgtatcaagaaaaataggtgctcaaatgttttctgtcttgtccacagaggggcactgttggattatttagaaatcaaaaaacatgtaacatttatttctttgttcatggttagaaatatttgcttttaaagtatttctggtgctaaa

SEQ ID NO: 222184 - DNA, 430 bp, Homo sapiens
tgaagatactaaacaggaatgaaaggggctggtctcacatgtatcacagcctaccatttccagagacacagctctcaggttccaaagggactagttgacatcaattgcaagatggttttctagatcccacagcctttctcaacaacagtttacaagagaattagccatacaaaaaattatttgagtgactgttttttcaattttctgaagggttgtgcataactagtactattctaattgcacaggagagaaattaactcataacattaatgccttagggtaggtgttgacaaactaagaacatagctgcccacccgtttttgtaaaattttttttgtatttttatttgtttatttattttattttgagtggagtctcgctcttttgcccactgtactccagcctgggcaacacagcgagactctgtcta

SEQ ID NO: 222185 - DNA, 539 bp, Homo sapiens
agtattcattgattggataaacttagtattgttaagatgtctctactccccaagttgatgtacagattcaacacaattcctaaaaaaaaaatcccaattggcttctttgtacaaattgacaagctgctcctaaaatgtatacagaattgcaaggggcccagaatagccaaaactaacaaaattggaggactcatagttttcagtttcaaaacttgctgtaaaactacagtaaccaagatagtgtggtactggctatagctcattagaatcgaattaagggtctagaaataagccaggcatgatggcttatgcctgtatcccaaagtgctatgattacagacgtgagccaccgtgcctggcctggaattatctggactttcaaagaagatggcattattataagaagagaagattattgccgaaaagatggattgcctcactttccactttttatgtaacagtagttaaaaaacagctttttttttacttgaattacaaaaaagtttaaataaaacttgtatttatgatacgaaactcaa

SEQ ID NO: 222186 - DNA, 577 bp, Homo sapiens
  misc_feature (57)..(57): n is a, c, g, or t
tcattttcctgatattatgggatggactatacttttacaaatgaatttatcttgtanactcaccgtcatccagtttgtctcaaagccactcaatgttttgtatgttcatttaatctttggagtcagggaaacatagaaaccatgtcagcatgtttaccactttcactcactgtcacctttcttcagttgtcacatcagatttccccttaagaatagtagtcatctttggagaatgccagtttgtgtcatgttggttcttttagaaacaaaaaacaactaaatgcatccaagttaataatggaaaagtttatttactcgatacaatgtaatattataaatctagcaggtaatttagtcccaaagtgctatgattacagacgtgagccaccgtgcctggcctggaattatctggactttcaaagaagatggcattattataagaagagaagattattgccgaaaagatggattgcctcactttccactttttatgtaacagtagttaaaaaacagctttttttttacttgaattacaaaaaagtttaaataaaacttgtatttatgatacgaaactcaa

SEQ ID NO: 222187 - DNA, 380 bp, Homo sapiens
caagattgcaccattgtactccaggcctggccaacaagagcgaaactcccatctcaaaaaaaaaaagccgggtgtggtggcccacacctgtaatcccagcactttgggaggtcaggctggtctcgaactcctgaccttgtgatctgcccacctcagcctcccaaagtgctatgattacagacgtgagccaccgtgcctggcctggaattatctggactttcaaagaagatggcattattataagaagagaagattattgccgaaaagatggattgcctcactttccactttttatgtaacagtagttaaaaaacagctttttttttacttgaattacaaaaaagtttaaataaaacttgtatttatgatacgaaactcaa

SEQ ID NO: 222188 - DNA, 351 bp, Homo sapiens
cttaagagtgtttagccgggcaaggtggctcacacatgttatcccagcactttgggaggctgaggcgggtggatcacctgagtcaggctggtctcgaactcctgaccttgtgatctgcccacctcagcctcccaaagtgctatgattacagacgtgagccaccgtgcctggcctggaattatctggactttcaaagaagatggcattattataagaagagaagattattgccgaaaagatggattgcctcactttccactttttatgtaacagtagttaaaaaacagctttttttttacttgaattacaaaaaagtttaaataaaacttgtatttatgatacgaaactcaa

SEQ ID NO: 222189 - DNA, 454 bp, Homo sapiens
tgagacagagtctcactctgtcacccaggctggaatccagtggcactatctcagctcactgcaacctccgcctcccaggttcaagcaattctcctgcctcagcctcctgagtagctgggattacaggcacacgccaccacacgcagctaatttttgtatttttagtagagatggggtttcaccatgttgttcaggctggtctcgaactcctgaccttgtgatctgcccacctcagcctcccaaagtgctatgattacagacgtgagccaccgtgcctggcctggaattatctggactttcaaagaagatggcattattataagaagagaagattattgccgaaaagatggattgcctcactttccactttttatgtaacagtagttaaaaaacagctttttttttacttgaattacaaaaaagtttaaataaaacttgtatttatgatacgaaa

SEQ ID NO: 222190 - DNA, 457 bp, Homo sapiens
aaggctctgggtacaattcagttgtcattcataataaaagctcttaagaaggaacaggaaaaacactacctagatatagtaaagactgcactcaacatgtttttactaagcatccattatatgcccagtaatattccagcagttaacagacaaaacatttagagccatctcattttttaaaaaagaaggagttgaatgtttagtttgtcagatggtaataagcgctttgaaataagaaataaagcagggaataggaggttgccaagagctgggatgtaggaattgtcagggaaggactcattggtaaggtgatatttgagtagagaactgtaggagagcaagtcaacaaagcaggcaaaaattccagccatcatgtatcctacggtctcatggtgggggagggggcaatacaaaaaacatgataaaaacatatagcatattagaaggttatagtgga

SEQ ID NO: 222191 - DNA, 497 bp, Homo sapiens
gccgctgagaccctccgggtctcgtttccagctgactccaccagcctcaggcctgccagcctcacctccaaaccgtgtggccctttcagctgagcaggcaggtggcactcagacctccaggctcagctcacgcactggctcttccgggggcctgagtctccagcttgtcatcacatctttctagattctagatttgtccgcctgccatcctctcagcctggggtcaatagtgtattaactatgatttcttattttctgcattcctgatgactggcaatgtggcctcacagactggagagactgcccctcccagtgggtgacatccttagagattgcgaaaggctggagcgtatctttcacaggcaaacccaccaattccaggcccagacccccaacttcccctcatcaaactctcacacaccaaggcaatatttccctgccctaaatcatcccagaccagggaccaggcaactagagaccacctctgtagttcaaag

SEQ ID NO: 222192 - DNA, 459 bp, Homo sapiens
acagaccttcggagacaggccctgccccaacagccctgcaagggccaggacaccgaggggccgagccagggcgctgctctcagggaagccaccattcccggtttatcccagaccctgggggcccctggggaagccactggggctcaggtcctggcccctccccactcggaggcctcacctgggagggggctccagaggccctgcagggtcccaggcaggaaggcctggggtccaccatcaggccacccctaccaagtaaagggacacggtccactcggtgcattgctggttcagcccctggggagtagcaggtccatggccttgagcctccacagaccatcctcccggaggggaccacaccacatcatgtcacatcaagcatgtcacgtggtgccgcctcctgccataccacaccatcaaccccttcctgagcaagggcctgcacttccaagggtcctg

SEQ ID NO: 222193 - DNA, 506 bp, Homo sapiens
ggaatcctgctgggcagcatatctctggctgtccagatatgtgtttctactcagactggcactctcctgtagcatggggatgttagattaaggaaggtggttaaggggaaaggaatgaatgaactgtggtgtgaaattttctccaagggagcccatcagacagcagacagctgttgcacattgcattttccagaaactttgctcaggcatttgatctgatcttcatacaaatcccagtgggacaaatatttgtatcagtcatcccttatacacatggaaacctagacccagctaggttaagaaatttgctaggagtcacccctgctgcttggttggtgctactctaaaacactactgggatcttaggaatttcttttcagagttgcagtatagctaatggattgtatattgatctataccagtgctattcaatagaaatataatgtgaatcatatatgtaacttaagttttctagtacactcattaaaaaaggtaaaacgaaacag

SEQ ID NO: 222194 - DNA, 569 bp, Homo sapiens
tatctcttagttctggtaaatacatcgtccataaaagtcagaagactagagattatctgtcctatttgtttgcttttacacatccagaaataacaccccaattttattagtttggaccacatgaaatgtcaatttttatcagtcaaaaatggttgaatatcacaatttcatgtgattccaccctgacgtcagaaaactcttaataaatggaacagtaatcctcaactagaagtatacatcagaataaccttgggaacttttgaaaaaatactcaggccactacctactgaatctaatttctctaaagttaaagccctagcatgtctgtcccctcaaaattcccccaagtgattttgatatgattaagaactactgtctagccgagcacattggctcacgcctgtaatcccggcattttgggaggccgaggcgggcagatcacgaggtcaggagatcaagaccatcctggctaatacggtgaaaccctgtctctactaaaaaaaaaaaaatacaaaaaattagctgggcatggtggcgggtgcctgtagtcccagctactcgggaggctg

SEQ ID NO: 222195 - DNA, 401 bp, Homo sapiens
cgtgttttttgaaggctctgacataactgctttatcagaagaaacattttgacagtgtcttgttggagataaacatccctaattgacatgtgatgactacttcttattccattcatctaagagtcattgaaattttgttttctttgtttgtttagcttcaaggtctttggtagtcacatgttagggatgactgaaataattccaaaggagtgatgttggaatagtccctctaagggaaagaaatgcatttgaacgaatgtgatataaaaccacataatcaaatagaaatttcatgtacttacaaaaatttagtttgtaaaattaccttcatttctttgacattaaatgcttatattagcaataaagatgttgacactttctcataaaaaatttaaaaaaat

SEQ ID NO: 222196 - DNA, 438 bp, Homo sapiens
aatgttaattatatttacaattgtttaaaaatttatgtttgtattctgacaaggtggtatgtgtacataacaaaaagttcaggatgtactaaagagtgaaaaataagtgtcctttctgttcacctagatttaatctccccaggacaaccactgttaactgtgtgtaactattctgagccttgccctgtgttttttgttttgtttttgcttacagtatatcttggggacgaatccaaatcagtacatataattttgcttcatgatttttaataactgaattgatgggcttttatgttgtttttggtcttttattgctgcattgtgaagttggtcctgcttatctacttagaaaatttagattacaggtgtgagccacagtgctcggcctcttttgctttttttaaaaaacaaaaccctctggaaaaccaaaaaaaaaaa

SEQ ID NO: 222197 - DNA, 2653 bp, Homo sapiens
cacctgttccacagctaagtacagccctaggtttggtgtgtattctccatgcatttagagaatcacatgacacagactgctgctataatgtcattttcccattcttcctttactaataaaatttttgagttttacctggacgtctggctgctcagcttaagactacttctcagcctctcttatagttaattgtggccatatgactaagttttaaacttcccaattggccctttaaagaagcagggtatgcactctccttgacattcccctttcttgctggctgggaggccaatgggagcttcagtagtgacctggcatctcaagagatggaagtgatgtgttgaggaaggagaagttggcctgccagtcttgaactgctctcctttgacctgttatttaagagtaaaataaaatactgacttgcttaagctactgtcttttgaagtctattatagcaattagtttgctttaaatatgtaatttatattaatggccttataccatccttattttgcaactaacttttcatttaatattatatgcaagacatttctattcctgtaagtatagctctgcctgcacagaattgttggattaatgatgtagattttaaatgtcagtggatgtagcagaattgcttgcatcaattcaccctccataaaaggacccatttctccaaacccttgccaacagtaagtggtatcaatatcgataggttgttttgttttgttttaaccagtctcgtgattgaaagtaccttgttttcacttgaatttccctgattacgtacaaaatcaaacatttccatgtttattggccatttgtagatctctaccgtacattgcctattagtgttatgttggcctagttttcctgtgggttgtttatcttttaggattgctcccctaaacaaaaacaaaaaggcagttattccaatgatcaacaaatattcttttctccaccagtttaaaatgtcagctttcaactcatcacatgctaagttgtctatttctgtcctgtggatccaggtgttggttctaccaaccacactcctcacgctgtcatttggtgctttgcattgtgttttgccattcatgggcaagttccttttcctttctccccctcttcagtgtcttatacttgggtgttttctgttccagctgaatcaagaattagtttattaaattccagtaaaattgtggtgttcttttgactaggattgcatttgtttacacattaatttgagaataatagacctctttataattaatataatgtttctgattagtgttatgataggcctcattttattaaagtcttttatattcttggatgaaattttaataactttcttcataaatgtcttgcacatttcataataggcttattcctaggtgttttatagatttttagttttggttgtgagtcttttaacttacataaaaatatggagaattagcatattcacatatctattttgtgatgtttatcatacggaagttttaaaatatagtaaattcagtctttccatttttttttgtttatttaagaaccattccctagctagggtcatgaatacattcttatgaattattaatcccatatggatagctagtttccctagcacctttaaaaaatagtttattattttcctcctgatgtataaggccacctttaccaatttacatataatgtacggaaatgtttcttggctctgcattctgttaaattggtccatttatctaactttgcttagtaacccactgtttttatcattgtggtatcataattgattatcacaaatggtagaatgattgtcctcaaagtcttttctggtatatattgatataattgtatagcttttcttggtgtagtaaagtacacagttaaattttctaacattgaaatatcttttagattttcacttccagaatggcaatgtgaagggccctgtggacccactgtcctaggaattagctataactagtgaaaattgtaacaaaaaataaacaccttcctctcatacagagagacacaaacacttaatgccactggaaattgtcctaaaagcatgtagaataaagtaacgcttattcaagaaaatccaaatcttggtaagaacagtgagtcagacatttcagccacaacacactcactccctccctcccatttcagtgggtgcagccaagaaaacagagctccgtctccctcagctccctgtccagaggtatggtacctcacagggaggggcaagatgccagcatttcttatcccctccagcttcaagtggcaagagctaaattcatgaagttaaaaactataataaggaaaaaatgcactaaaggggttcaatagtagatttgaactggcagaagaaattgtcagccaactggcagatagaataagagagatatgctttccaaagaacagagagaaaaaaaatgaaaaatgagcaaaacctcagagaaatgtgaagcaccattatgtgcaccattaagtatgcatgtaatgggagtacaagaagagcagaagaaaaaggaaatatttaaagatacaatgactgaaaactctccaaattgattgaaaaacatctaggaagcttagtgaacttccagcatgataaatgcagagggattcacagacacatcatagt

SEQ ID NO: 222198 - DNA, 276 bp, Homo sapiens
cctcacttggttgggtttaaatgaccactccccgccctagctgtgcctttgagtgtgtggcaagggattgcagacgggagactgcttgtcaattcagggaagtcagcctctttctgccacttaattcgcccatcagtagagatccgactttcccacggttcactgtcacccccattgcacaggtggggaatccaaggcacagaggcgtctgggccagagtcccgggactatccactcattccggggttgtagggcagcatgtgtcaggagcttggg

SEQ ID NO: 222199 - DNA, 576 bp, Homo sapiens
gcacgagaaaaaaaaaaaaaaggaaaaattctgaaacaaccatgtaagaataaatgcatccaaatgaacgttgttcatctcagaagagtcacctttggaggtgatgcacttagttcaaactttgctgcctttgagcacaacattttagggaaataattttttggaagtgttgtcaaagtctgaaatacattcttgtagaatgtggaaaatctcatacttgaaattttttgataagcaagacaaaatgtcacgtttagtaatactgttttttgtttaagatgaggtttttctgctggacatgggggctcacacttgtagtcccagcagtttgggaggccagggcaggtagattgcttgagcccaggagctcgagacaaacctgggcaacatagtgataccctgcctctacaaaaaaaattgcaaaaattagctggatgtggtggttgatgcctgtagtcccaactactcaggaggctgaggtgggagaatcacttgagcccgggaggttgatgctgcagcaagctgagatcaagccactgcactccagcctggacaatggagagagaccctgtcgga

SEQ ID NO: 222200 - DNA, 301 bp, Homo sapiens
gctacaaagagatagcacctccaggattttctcaagtgttaatagttgttttgggatcagatttaaggaaatatttagttttctggtttattcactgtaagtctagtacagttggcctttgaacaacataggtttgaattttgagggtccagcaaaggatggtttgataattttagaaagatgtttgggttaaaaaatgtccagataacagaagaattaacttctcaccaagagctggcagagaagttccagatgccattgagaaaatcattgaggagaagaggtatctgcctgaacaggt

SEQ ID NO: 222201 - DNA, 315 bp, Homo sapiens
taaagctggagaatgcgctagaattggaaaatcattttgcaaacatagtaaaagatcagtgcaggtaagaaacatcaatgcatgctaatttaacgggacactttcataggcaagagatttgcatggtctgaaagtctacatatactggttataagttccaggtagggggatatacagagaagttggacaccttgaccaagtgatcaaaatttaccactatcaatgagggggcagatggatatcaagtcattatgggcaaaaacacataaactgattctaaatatgaggaaatatcaaactgagttgttttctgtt

SEQ ID NO: 222202 - DNA, 479 bp, Homo sapiens
aactttcctagttattcctaagactgtgtttgacctaaagagcattttgatctagaagacaccttaaattggagggtctagtgaaaacctgcatgctgtgaagcagagagctgagtctctgagagattcagtgatatcaccaatgccctggactggttggtggcacagacatgcttaccactaactccagcctcccaagaaccacaatccatagttccttaactccactccatgctgactcttggacttaaactcttaatttcttttggtgttattatttcttcccttctctccttttcatgccttaaaggtggtgccacaatcatctgaactgacatatattagcccactaactatggccttgtagtttttgccaaataaagcattagttatgtaactctactctgttttctgggagtatagagttttaaacagaaaattttaaagaaattggaaatttctttaagaaaaaaaaagag

SEQ ID NO: 222203 - DNA, 389 bp, Homo sapiens
cacaggggaaaaggtagacacaagttgacactggagaagtaggaggggatagagcaagaagaacttgacagaccgaggagtctggattgcttccaggacaataatctaaactgcagagtggtatgaagcaagaaagggatatccggttgtaactgttcatattaagaggggtgcacaggggtatatgagctttctcttccaaggagcctttgagtcctcatctctgctgttacagtacagacccagaatttcttatgtaggagagtaaatacatttatgaaataataatggaattcattttatgctagggccatatttctaactaccttccaatgtagcaggagatagcaagacttaaggatatcttagtctgactcttttaaaaaaga

SEQ ID NO: 222204 - DNA, 558 bp, Homo sapiens
aatttcccaatttgttctgcctcgagtctaagacaccatgtcatggatttgaacaatgttgatggtggagactcagacaaatggggctggagaaacctaacctggctcatgaactgtccaaacgatgagacaagttgccctgacagggcagttgtttggaattcaaggtacattaggagaaaaggagggctagataaggaaagcaatataaataagctaatgaaaagggataaatataactaaaaataaataaaaactctgggcttcacattttccacctttcgtcttttagtcatctgctaatgaaggagcttaaggacaagaggttttatgaagttgaagcacaactttaggttgctcaatgtaacacaatccctagcttctatctttatcaatgaagaaagaataagaaaataagaataaccaataccctgtattcccttagaataaaatcacaagaaacacagtcttttgttttccagaaaagattattcttgttagagccatgaaaaatgaaggaaaaaaacatcaaatacaaccacatgttccaacctttaa

SEQ ID NO: 222205 - DNA, 360 bp, Homo sapiens
gtttttctgtattttgctaaaaagttactccaaagatgataccttctatttggacctttcccaccctttatatacctatctaggaggtagtaacccaaccattaatctctccatgcaaaatacatgtattgactaaaaattatgtgctaggtactgtaatgtttcctacccattattttacttaattctcacaattactctgtgaggtattcacaggtgaagaaagagaaagtttaagtagcatgcctagtgagtggtaaaacttggattttagtatgaatctgtctgacttcccaacctgcactgtttttttttttgttttgttttgttttttttgagacagtcaccctctgttgccca

SEQ ID NO: 222206 - DNA, 723 bp, Homo sapiens
aaagactttggattgtacttatttttttccctaaaaattccgaatggctaaactatttgaaattagactattcttaattttcaatggctggttattgtttttgcttgattctagtatattatcatcattcttatctacctttttatttttcttgaaaaagcctttgttgaccaatcacatttttatgatttctttcccatattattttttgagttaaacttaaaaacaatccaagcaatatcagtgttaaactgtcctctctcatgggccaactggatgaagcaggaagtctccaggtaactttccaatgttgatatgaggaatgagtcactaaagggaaatctctggatttcatccttttcggagaatctagagtcactaactcctgcctggttcttatttctaaattaaagtttaaaaatacaccacaattgactgagtagccagaatgtctcagacactatgatgagtgctatggtagtcactttttagtcattgtgggcaattcaaagattaccaaaacatattgtttgttttccattgacttatcatataccaggaaaaataaatttataccaaataactaagaaaacctgtaagactacggattggctcaataaacactcacttcaacacattctcccttggctttccatgctatacaggctacaaggcaaatacagcactccagttcctagccacttttgtaggtagaggtggcca

SEQ ID NO: 222207 - DNA, 631 bp, Homo sapiens
atctttctcttaaaggacacagctgtttgctcatgctcttcagtgcttgagaacagttatgtcatatattttgttccattttgtagattttatttgccagtagagaaagtctatataagttgttctgtcatgcccatatctacttttgcattgcttccaaaatgatctgaatgaaacaaaaatctatgatatcattgctcactttaacacttactattgtcatccattgcctatataatgacattcaaactcctaaatatgagactcaagatcccttaatttataacttttctggaatcactttccatactcttttcctgtagtctctgcctgttcaaccctaatggttttcaatgtaatgtgcatgaggatcatatagtaacatacgtttaaaatgaatatttccctttctactttactctcatttaaattggtacatctagggtattctaggaatctaaatttttaacaaacaacctaggaattttgatgtaaacaatctaggtctacatattgtggattactgttcaagcgtggcaactcaaattatggtcacatgatcagtagcatccaccccaactaaaagatttcagaaatgctgctctcatttcctttccagccctattcaacc

SEQ ID NO: 222208 - DNA, 553 bp, Homo sapiens
ggactcagttcaccctgcctgggtgaatattatttttccctcaagatcacaggcctctgagggcagctgctgtgacttcgcatggctttgagctcagaatacatgtgggcacgtgctcctcagtctacagggaaatcacaactatatcatactgcaagtccaaaagaaccagcccaagatttctgcaagggtgccaccaaagtcaatgaggattagctatttacatgcccagtgacaagggacacccttgtttattcttcacgtgactggcctttggctaatttcatccagttacttaacttgagttcttgagtgaactctgctgagcctttccctctgttcctgctgcagtgcgcaataaacgtttggtctttgcccctccaaagctcttcgggaaggtactgtgccatccttgtgtgtatctgagtattttccaacatccaaaacagtctgtcttgcagcttgggttatataatgtatttgaaaacttacttcttgtttctgcttcccaaaaagttacccccaaataaatactgcctaacagttactggag

SEQ ID NO: 222209 - DNA, 445 bp, Homo sapiens
ctcatcgagagcagaaccccatagcctcagggattgcctggaggtgtgtttttcaatgccctcctcctttgaaagagcagtggcctgccccacttctaaaagccctggggctccggtaagccgacagggctttacaggacacctgcaaagagaaacaggagcaaacccgaggcagagaccatgtgactacgcgtggccctggcctatcccacagcagttggtgttaacgtgtgtcaccggaggcatacggggcgacggcgaaacaaagggtgttgtccaggcgtgtgccggtggaaggggaaaacaggtgacatttccatcaatgccaaggaaaatcgaaaacacctgggacccgaggggtgtggggggggcctgtgactgacccaagccacgttttcgaatgcctaccggaggagcaaagaggtttctgcaaaattcgccccaa

SEQ ID NO: 222210 - DNA, 450 bp, Homo sapiens
gcctgcttttggtgtcagatttaaaacatcacgtgcctaattcaaggtcatgaagattttcacctatgtttacttctaagagactaatagtttaagctcattaatttagatctttgacctactttgaatttttgtatatggtataaggtaatgagctagcttcattcttttgcctgtgaccttccagttttcccaggaccatttgtcgaagagactgtcatttccactctgttggctttgacatccttgttgaaaatcaattgactggccgggcacggtggctcatgccttattcatttattacacttttcagctctagaacttttctttggctcttttcaataatttctatctctttattgatattattttatttatacattgttttcctgatttccttaagttatttgttcatggtctcctttagttcagtgaacattttgaagatgg

SEQ ID NO: 222211 - DNA, 248 bp, Homo sapiens
aattttagaaccttttccagaaaaattttgaagaaagcatgtccgatcattctaaacaaatgccacacttgtggagtgggtttcttttctacaatccatattttgtaacactaagtattttccttcttcgtcccgcacctctatgtattagcactatcagatagagttcattccatgcctgtgatattgtaagcagaataaatgtctaaagtaggtgtaaatagtaaattctatggcttacagtttta

SEQ ID NO: 222212 - DNA, 449 bp, Homo sapiens
gctatttaacatttttactcatttttcctattcaggtttttcacagagctgtaatcacactttgtatagatagttttcacttaaggttgtgtcttaagcattgttacccatcatggcaaagtagttaatgacatgtgcctgtggggtcagactaccaatgttcaaattccagtgtttccaccctgtgtgaaccacacacattattcattccctctctgccatttctccatctgtatttggagataagaatagtcttaccttacaagattattatgagaattaagtgaattaatagatgaaaagattaaaatagtgcctgatatatagtaagtattcaaaaatgttccataatagtaattttattacatattatttaaaactttccgaacatagtttctaattgctgcatcttatgtatttctcaattttagatactttaattttttcca

SEQ ID NO: 222213 - DNA, 799 bp, Homo sapiens
gaaacaaaatggacatttgggctaacaatgaaaggaaggaaagaaggaaggaaagaaggaaggaaggaagggccaggcacggtggctcatgcctgtaatcccagcactttgggaggccgaggcagacggattgcctgaggtcaggagttcgagacccgcctgaccaacatggtgaaaccctgtctctactaaaaatacaaaaattagcagggcgtggtggcgtgtgccagtattcccagctacccaggaggctgaggcaggagaattgcttgaagcgggaggcagaggttgcagtgagccgagattgcatcactgcactccagcctgggcgacagagcaagactccatcacaaaaaaaaaaaaaagaaaaaaagagaaaaaaaagaaaagaagaaatggctaaaacaccacaaccaagaagaatgacaatgaattgctaattagggtcccttccaaatattggtaaggatgggatgtatctgttaacttggttaagattctatagcttgagtttggttacttcaggaaagcatggaatgaatcccagctttggttatgaaatctgagatctgtgaaattccagcactttatccagcatagtgaaagcaacattcttccccaaggaaaccaaagcccatccttgatccccacaggctcaaccatgccctaattagagtgtctgttaatcattttcccttgtttcccaggctggtgggcggagagacccacatttgggatggtgggggaaagacaccagtttctccatgtgtctgttcattatggcgctctgtggtttgag

SEQ ID NO: 222214 - DNA, 300 bp, Homo sapiens
cttcagaggagagatcccgacagcaaggagctgacacaattgtgcctggaaatgacagggagccgggggatgtgtattcacaagatgtgcaggggggttctccctatgacagctgggaattgtgcagctcatggactgaatttgttcaacaatgtacctgttctaactggtgccaccaacatgccccaatactgctttcttagaaattgatttcaaggagcaggtgttttattattgcgcttgtcattagtattattttattttcgatgtcattacaacaaatgttgaaaatcaaactga

SEQ ID NO: 222215 - DNA, 358 bp, Homo sapiens
cagaatgaagctgcatttccccctctttaatttatccctaaagttaagtgtctgacttaatgaacaatcacaaatctgtgacttctgagtactgtccctgtgggtaataataccatatgactcgattttcagatactacaaataacttagaaaaattcagtcagactgaatagcatccttaaacactgcatttacaatgcctagaaattagtaagtagtctatcatgtgcttttaatagtcaaaagaaaaatgacaaagaaatatcaattggaaagttttgaaatgcccacagtttgacagcttgactgaaggtttggtttcaaccaaaatgcttaacaactttttgacctttccctc

SEQ ID NO: 222216 - DNA, 411 bp, Homo sapiens
tacattagtggctgcccgggatccaagataaaccattttcccatgcctggtgagagactgtagcacagacgcttgatgttttattgccatgttattagaaccagcctcctaatttgcactggaaaatttgagagggtaaacatatgggcatatgtcttcatgtgtgccaaactcacactgtgggcgcgcatgcggtacacacacacgttccttttgttacctctttgaactctgaatgagattttgtgagtgtgcacctggggtagaccccttagtattaggtacaaaccccacagcagcccgcctgggttttctccctcacctgagcatctgagcccagggagaataagcaggtaagtgccagccccttcctgccgaggcgtgcaaactcgcctgcaacccctactccat

SEQ ID NO: 222217 - DNA, 388 bp, Homo sapiens
ttaatgaccttttgcccatctgactgatgactcaatgaagagaaagggtctttccaggggctttgtgaggaatgcagcaagccctatctgggccatgcccagggccaacagggcaagcacagatctaggaggcaaattcagggctcttgcccaatctcagcctccctgaccacagaaggaggaaatgagacccttcaatagccggagttcctttggagccccttcagcccagtgtcagtgtcgggttaggggcatctccaacgtcaagattctctagaagaagtctggactaggggccagggaagtggggtttctgtagggcaggcccagctctgtaactcactgaatgacctggaggggagtcatattgtcaacagaacggaccagg

SEQ ID NO: 222218 - DNA, 358 bp, Homo sapiens
ggagtccaactgagcctcatctgccctttgaacacacactctttctcctctgggagtctctgaagtgggtgatatcctctgcttataatacgcttccccttaaacctctactctcttcctagctagcttcgactctgtcacttgtccgctttggcatcacctcctcatggaagacttctttgactccccagattctcaggagcatggcaggtgaggtgctcctcccatgaatggatggagattagggagtgtgtgttattcatgcttaattcaccagtgcttagctgagtacctggcataaaatactgtggtggccaaagtaataacccccacccccaccaattgctcatgtcctatg

SEQ ID NO: 222219 - DNA, 518 bp, Homo sapiens
gacactttccagaagagcggaactaccaattcacctatcggggacattcattgtattcctttaaggcagtcgaagtttgggttctagaccatgttctacattctattagtaaactagctaggtttgggagtctatttgcaggactagcataaatttcgtttcattagatccaggcttattcgtccagcctacagccaattctttcaactaactcattagatagactgtgcagttttgagttgtaaaagttgtcagaattagaatggagtcaccagtgttaagaaagaaccctgacaaatagagctggggaaggctatgaagaatgggttctcacgcttgtatgctggataactatcccaaaagactgcaaagaccacagccttgcacaaaagccatcacaaccttacacataaaaaaaaatacttctacaaggacatctgcccaacaattgcctgtccaacctcagactagcatcacacttattgttgatctttgtagccaaggataattatctcaaa

SEQ ID NO: 222220 - DNA, 341 bp, Homo sapiens
cttagcagtcaacccaatcaacccagtcattgcttgttggtggtgagtcttaagaggcttaagttgtaggcctaagaccactggcaccctacaggcagagttgggatgaggacccaggtgcattgtaaaaggttccctaaaccgtttctctttctgtgaataaatgaccttggtttaatgtttagctctgactcatctgaaatctaaagtgaaatgtcaatattaacagccaccatatagggtatggcaaagagattcctgacacgtgaactgcacctggtttgggaaggtgtgatgcattcttaaaacagcatatccttcgttgattgggttgacgtcag

SEQ ID NO: 222221 - DNA, 332 bp, Homo sapiens
aagaaaagaggaaaatttatagcactaatgtccacatcaaaaagctagaaagggccagtcatggtggctcatgcctgtaattccagcactttgggaggctggggtaggcagatcacttgagaccaggtgttcaggaccagctctgggtgacagagtgaaactctcccacaagaaaaaaaaaaaaattagaaagatctgaagttaacagcctaacatcttgattaaaagaacaagaaaaccaagtgaaaacaaacctgaaagctagcagaaaacaagaaatagccaagatcagagtagagctgaaggagatagagacactgagaactcttcca

SEQ ID NO: 222222 - DNA, 310 bp, Homo sapiens
tgcccgtctacccatatgcaagaagcagcccctttgccgaaaccgccccctccctggctggccagtaaagaaacagtccaaagccacacggtcatctgctgcgtggctaccagggagcgtcgtcctggctgtgaagcttccagacagtcactgtctgctgtgtgtggttagaaggacttggacatccgtgttgtgtgcgcacaagactgtcctcgggggatgggccagagggcccaggtttgcctcggtgccataagtatcatttccatttcaggaaggaggttctgtggacccgttgagtgtcaccacc

SEQ ID NO: 222223 - DNA, 507 bp, Homo sapiens
atgtccagactgtttctttagatgagtgtaatttccaatgtgaaaccccacaattcggcttcaagaggtacaggacagtttttgaattccacagaaaaaattttgcattgcaacaaacttgaccatcctatttgtggtagtagaaatgtaaattcattcccctcagagatacctgcaaaaatgaaatgtgaaatattctgcttgcattttaaagactggttattgcattctagaatagatggaaaagacattagtgagggccaatatagaaatatgagttttcccaaaagacttttatgtatatatatgacatggcaggaaaattgggtcactagtggtttttacttcttcgttcatttggcaaacatatgaatagactgatgtgtgccaaacactgttccgagttctgggaactgaggaaagaaacaagctatctgttttcatggagctcgtattttacttggaggatggagaggctgacaataaacttgtacaaataaatacaaa

SEQ ID NO: 222224 - DNA, 455 bp, Homo sapiens
agagtataaaagcaaggactatttcaaattttctgacttgggtaactgctgtattgtggtgggacatcattaggattgcccacaaatagctcctaaaaggacatgaatagaaaactcatagggcttggtagcagaagtatagatcaagaaggattgctcaagtgctggcacagtaagaatgtcaaggcctcggccggaagcggtggctcaagcctgtaatcccagcactttgggaggccgaggcaggcggatcacgaggtcaggagatcgagaccatcctggctaacacagtgaaaccccgtctctactaaaaatacaacaaaaaaattagccgggcgtggtggcgggcacctgtagtcccagctactcaggaggctgaggcaggagaatggcatgaacccgggaggcagagcttgcagtgagccgagatcatgccactgcactccagtctgggc

SEQ ID NO: 222225 - DNA, 256 bp, Homo sapiens
tcttgtgacctcagactggtcacgtcctctcctgcgccctgggctttctcatctataaatcaggaaattggttcaagtgatgcccaggtctccttgcagctctgacacctccgggggatgggcagaggatgggcaggaccaggacggaaaggcaagcaccaggacccaaggaggtgaggtgtcacgggcatcagaggtcacgggcatcagaggtcacagggaggagagcaggtccacaggccagtgtcgggagagc

SEQ ID NO: 222226 - DNA, 595 bp, Homo sapiens
ggaggctgaggcacgagaatcgctggaactcaggaggcggaggttgcagtgagctaagatcacaccactgcactccagcctgggcaacagagtgagactctgtgtcaaaaataaaataaaataaaataaaatatatgggagggcctggcatggtggctcagcactttggggagcagggggcagggtagaaggaggatcatttgagcccaggagttcaaaaccagcctgggtaatacagtgagaccccatctctacaaaaaataaataaataacaataaagtataagggaacatgtgcatagattatttcatatggccgggcgtgatggctcacgcctataatcccagcactttgggaggctgaggtgggcggatcacctgaggtcaggagttcaagaccagcctagtcaacatggtgaaacccgtttctactaaaaataaaaaaattagtcagggtgtggtggctcacacctgtaatcccagcactttaggaggccaagatgggtggatcacctgaggtcaggagtttaagaccagcctggccaacacagtgaaaacccatctctactaaagtataaaaatcagccgtgcatggt

SEQ ID NO: 222227 - DNA, 429 bp, Homo sapiens
ttgaaactttcttttgaatcttacagttaccattgtgtgtttcctataggcccttctccagattctccaagttgttcccaagaaccttttcactggggcccagaattgactcacagtatccatcccaattcccctttctcttaaaaaggagaagctggaaaactcaagtactaaatttcccagcctctcttgcacagatagtgaccatgtgaaccagttctggcaaggagctgcaggcagaggtccccggggagggctttgggtctctgaccctggagatgtagcagccatctctccaagcatgctaagactggcagagcagcattgtaggactgatttcttaaggggatctttgatcagctacacagccctgaaatgtctatctctgcacttgtcatgtgaaaaaataaaaaaataaaataacctgca

SEQ ID NO: 222228 - DNA, 278 bp, Homo sapiens
atggcatcatttattatattcgcatgttccagttataacttttttcaacagaatccgatcaacactcacattttgcacctggcttttgtgtctctttagtctcttttaatctaaaacagtctttttttcattacattgatcttttcgcacaattcaggagtttcttgtagaatgtcccctatgcgttccctcctggtgtcatttactctttcctttattaccgtatttcctgttacttgaaagataaggctggagcctgattaaacatttttggcctg

SEQ ID NO: 222229 - DNA, 363 bp, Homo sapiens
gacacggctaccatgccatccacagtgttgccatccacagtgttgccatcactcctgcccacagcaggagctggctggagcatgaggtggattctgtgctggagcctcaccctctgcctgatggcgcagacggccttgggtgccttgcacaccaagaggcctcaagtggtcaccaaatatggaaccctgcaaggaaaacagatgcatgtggggaagacacccatccaagtctttttaggagtccccttctccagacctcctctaggtatcctcaggtttgcacctccagaacccccggagccctggaaaggaatcagagatgctaccacctacccgcctgggtaagagtcagaggcctgtcca

SEQ ID NO: 222230 - DNA, 293 bp, Homo sapiens
tactggtaacgcagcaggcactctgaagaaaaggaaggcaagactatttctatagtgataagacacagacacatttgtaaccttcagttctcaagttaggtcttaagcaaactaatctctctaatgtctattatacaaatatacttccttaaaattctaaagaaacaccacatacccaacattagctgctttaaagacttaagtcaaagtagtcattttcttgctagtacaaacatattttgtaattctaaaaaggcaactaagttatttgaaagacagagggtctagatttg

SEQ ID NO: 222231 - DNA, 378 bp, Homo sapiens
gtatgagttatttaaaataaagatggcagaagtgaacagaaaaatgaccatataacgctgtttttattaagccttgctccttttcagcttgcctcttataactgatatgtaggttaaaaagagagctatagactttgggaggccgaggagggtagatcacttgaggccaggagtttgagactagcctggccaacatggtgaaaccttgtctctactaaacatacaaaaattagctgggcctggtggtatgcacctgtaatcccagctactcaggaagctaaggcacgagaatcacttgaacccagcaagcagaggttgcagtgagccaagattgtgccactgcactccagcgtgggtgacagggagagacttcatctc

SEQ ID NO: 222232 - DNA, 953 bp, Homo sapiens
tttttattggttgaattttatttttattttttgtattataaaggcttaacatttttcttacagtgcagaatttccttcagagtttagtgcatgatttcttgcctgagaagggtcatgcttccccactcatagtgagttttcgtatctcttcctaagaaaaatgaaagtcaagcctcaggagggatggtcgagattaaaaattgccaaggtgagagtgtcaattagtgtgctctttctggaaagccatttggcagtatctcattagagcctggaaacgcagtttgcacttttgacattgtaattccatttctagcaatcagtgggtcctaaggaagtaatccacactcggagcatcgtgcaccacagtagtgagggcagcattgcgtggaggtggaggattaggcacatcgtcagtgtccagcagaagacaaaggagtgagttaacaggacggtccatatgctggaattgcatgtcactatccatcaaaaattgtatatgtgacagatgtaataacatgttgcagcagctacaacagcagaaggcagtattacgtacatggatcgtctcaacgttggctgaaaacaggccctcggaagatgagaattagaaggaactgtgtcccacctgcggtcatatttccccaaggacattttccccacttctctcctttcccattggttccagttttcctaggatgaacgtgtattgatttcatatttaacaaattaaagcaaaagttaaacttccagtgtttttgtaacctacagaatgaatagtcaatgtttaaagaataggacaaatttacagaaaaggatggaatgcaatttaagatgtaaaaaaatgggcttcttctccctcatatacacaaagtgttcaaaacactctgttatactttatattttgaacataaggaaataaagtaaaataattttaaagagtctttaaagtagaa

SEQ ID NO: 222233 - DNA, 660 bp, Homo sapiens
ggggagctggagaaaaggactgaagatcatgagggacatcttttgacccaaacaagttgctttaggtcagtgattctcccaacgtggttgggaccagcagtattggcatccgcatcagctgggaacttgctagaaatgtaagctctcaggcctaccccagacctactgaatcagctctgggtgtggcatcaggcaaacttgtttttttgtttgtttgtttttgagacagtctcactctgttgcccaggccaaagtgcaatggcatgaacacagctcactgcagcctcgaccttctgggctcaggtgatcctcccacctcagcctccagagcagctgtaaccataggcacacgccaccaagtgtgggtaatcttttggtatttttagtagagatggggttttgccatgttgcccaggctggtctcgaactcctaggttcaagtgatctacccacctcagcttcccaaagtgttgggattacaggtgtgagccactgcacccagcccaaacttgttttaacaagccttctagtggttcttatccactttcaagtttgagaaccactgctcttggctctccctctcggactgaaggggaatgtcaagagaaggaagaattatgagggatgcagcaagcagcctcatccaaagaaaaaaagaaa

SEQ ID NO: 222234 - DNA, 1271 bp, Homo sapiens
ctcagaaagtgctgggattacaggtgtgagtcaccacacccagccatatcatgctgttttaaaatattgaaatactagtattattattggtataaaacagttatttcaatttttaaaacaaaacatttttaaattaaaaacttctaaaacctatatttttaatgtctttaagtatatgtagagcgttacatgcttcattaatagtttaatgctgacagatgcacttttgagcaactatgaaataagtgcaaaagacaatggcaacagtatctcactcttaagacttttaggatgtacactgatatttttaatattatgtgaaaaagacactaaaatgctggtattagcatttttgctgcagtattgtaattactgtcaattgtaagtggcaaagccagtgtccaaatttaggtactggaaacggcaaaggcctgtggcctccaagccagtggtacccaaagtagtccatctgccgattgttcttgttctgtgatgagataaaggtcagtcattgcacagcttccttgatcaaaaaagtctcgcatgaaaacgtcaaccgaatctaacagtatgctgaggagtgcaaattgacaacaatgtctgtgaactagcactggtccacagatcacattttgagtagcactgctctaagcagcagtgcctcttggatacttagtttaattaaaacaaaacttgcctatgctaacactttattgccaaaataaaggaaataattgtggtctgcataatttatgaatgacatccctttacctttttgatgccacctaattggtacttagtgcaatgctaatcacattatacaagtttaatatatgtttgtttggtcaggactaaattgtaacacaagtattttatattagtggtgtgaacactttgaaagtctaatgctatctgtacgtaattttagttaggtgagaaggaatttaagataaatgttaaaatagtaattataatggttggtcactctcagggaagatgttatcagctctgatcatcctaactcagggattaacgatttaggctatagctgtagctataaaaacaagagcacagtagaatgctgtgcagccacctggaacaaatctatatgaaaagacctctgagataagtaggaaaaaagggagacagtagtctatatagaatacatatgcagctgtttgcatgcatatgcatacatttttttctggaagaatatttaagaaattgataattttgtgttgggaagcaggacaggtagattggggtatatg

SEQ ID NO: 222235 - DNA, 354 bp, Homo sapiens
ctagtgatcaagctagtggccaatgatttaatctctcgcaccttcacagtggaacctacataaaaacccctaaatgttgggatttagggaacctcccggttggtgaacacatggaggcgctcgcaaggtggggcgcctggagagggcatggaggctccacccaccccaccccgcaatcgcctgccctgtgcatgtcttcatttggctgttcctgcattgtatttcttatcctacactcataacagaaagtggttctgggagctgatatagcaaatcatcgaacctgagaaggggagttgtgggaactcccaatttatattcggttggtgagaagtgtaggaggctcggacgtgt

SEQ ID NO: 222236 - DNA, 487 bp, Homo sapiens
gatgatacagcttggtctaatgtggttctaaggaggctctgccggcgagtcttaggggttccggcgggcagccgcgtgaacctggagcttggggtctgcagtgctgggaggccgaggcctggcatgttggggacaggtcttgggagctgactgggggcctggcgtggtggcggcagcccgcagtccctgcctggcccttgtctgggaggccgcggttctctgcggcctctcgccggtgtcgcccttggccactgggctgcgaggaagccggcgaggagtgggtgtgcgccccgcccggctctaccggcgagggatgcagtggccgccagcgtggccgtgcggctgggtcactcccttcccgcttccagggcctttttctgcctccttttcaggacgtgacccgcacattatgagggacccgtaggggctcttgacacagaggggtcaccctatgtgtgaacaggttacgaggttgggggcttggctt

SEQ ID NO: 222237 - DNA, 375 bp, Homo sapiens
ggagggaagagtgaaagtgaaaaatggagaggaaacactgctacccgcccaatgcctggagccaaatgcaagcctgggccaggcttgggggaggaatcaagaggaagcttaaacttaaaatgaaatagaaagtttagactcctacatgggattggacattttaaatgctgaacagagcctatttttatagctagaagttacaggacacatttttggtcaactgagaatgatccaaaaatcatgtgaattttgtgatccagaaagtcacagaacatgccctagattttatcccaggggcagggaggagtgacctgcagagcaagtttgaattggtaaatagaaaacaagaataaaatagtttgctgtttacattca

SEQ ID NO: 222238 - DNA, 417 bp, Homo sapiens
gtatcaatgggagccacagattctgcccaactagcatcccgtacccaaaactgttttttgctttttgtttgttgctgttattttaatgaaacgccaaggaaataggagggctgtttagccatgaatggtaaagaggcaattctgttgctcaccagttgtttccagttctctctgcttccaggcacatagtagggctgtgcttcctggatcccttgtgactggctgtggccacatggctggttgtggccaacgagtcataagcagaagtgatgtgagcacatccaggctgagccccccagagctctctttccctctggcacagcaactggcaacaaccaagtgaagtgaccatgagggaccaagctccccactgaccggcaatggacacacagcaggaggaggaaatactgtgtcatg

SEQ ID NO: 222239 - DNA, 558 bp, Homo sapiens
cactgatcagccagtcttgagaaggacagaatccagtcaaaaccagagaatgacgtcgcaggaactaatgggacagcctcttggggccgccaccattgggatgaatcagcttcaactattttcagttcttgtgtcactccacttcaagcctcaaattccagcgagagtctggctgacatcatttggatcccctgtctagcccttggcctggggataggggatgaaggggatggggctctgtgatggacagttccaccaagattgcattccagaaagaaacacagaagggcactaaccaaaaggtttcatgggtgctgggcagacagatacaagatgtctgctacagtggctttaacacatccgtgatcggaggagcaagatttatcctattggaaacattcaaaaagatgcactatagaggcaattcctaaagaaacagtccaaaatgctcagagcactgtttctcaaaaggatcactttttttagttaacaaaggatcagtgtgaagttgtatcaaaaggatcacttttaatttaaaaaataaaaatgtttaaaaga

SEQ ID NO: 222240 - DNA, 964 bp, Homo sapiens
ggaaaatgcagctgcatccccgaggggactgacgggggcctccaccctcctcggtggcaacccaggtggtccccagtttcctagccagcagctgtggccaacctctgcgcgaagcaacgggccacgctgcaggaccacgaagccaggcagccgcgtcgactcctgcagggtgttctctccggagtgactcccgagctttcccgcttcccaggccccttagatatcgcctgcgcttcaaattcggagattgacggcgtctccggaatgcgtcgcagtcctgcgagttctccgccagggggagagccgcgcgggcttgggcctgagcgaagacagccgggctgcagccctccaggggaactgccgagtcccgccggggacagcggagagcctgcggattgtgaagccgaggaaggctcggcttggttttcctacccgctcctcagttctggttgatcggaacttaagagtgtctttgagcctagcacaggccatccgccctagatatggctcctaactcgagaggccaccctttgcggcagggaccaggtggcaagtgctgtgcattaatgaaaagctgtgggctagacaggccccgggaggcctgggctctggcgccagccccacctgtaattggcaatgcaatagctaaatcattccccctcttagaaacacagatttttccataataatgttataatgcacaaagccttgtagtttgcaaagccctctccgcacatgtattctccagtaaaatgaagataagcgctggttatccagatcccttgggaaatggatcttttaccacaccgtgtttccatattattttaagcacgtctctagagaagtctgggggtgtagcctaaagcattctgaaagtcttgttttagctttaaaattcatatgaattttgcattgtactttgtaatttttttttgctttaataaaacaatagctaccttctcaa

SEQ ID NO: 222241 - DNA, 439 bp, Homo sapiens
cctgtgtcttctcataagagcactaatctcattcagaaaggatcgactcttatgctgtcatctaatcctaattacttttcagagatgtcaacttctaatactatattgggggtaggttattaatatgtgatttttttggagtgatgcaaatattcatgccgtaacacccccccaaccatactctatagagcatcttggctattcttagtcattgtgttatatttcagtttttagaagtagtttttccttaattttagtgaaaaaaacaaactgccttgtaaatttcatggactaaaatataactgtagtcatatttcagaaacgttacatcatagtgctatttaatctccttttaaggacacatgacattttttcatttatttcattttatattgatgtttttcagtgtagactttttgcataataatcattttatatc

SEQ ID NO: 222242 - DNA, 599 bp, Homo sapiens
agagagagattagttttctaaacccatcgcaaagtgaagggatagctgattgtcatcccatttttgagacctcagtcatccttctgcgtgcatcaccacaactaagaggaaggaaagagcactggatgtggagtgaggagacatggattctgtcactaccctctctgcagaacccaatagtatgtcattgaaacaaaacaatacaaaaccctgtctacaaaagaagactcataagtcaacaataactcgggtttcataaaggaagaaagtcttagaggaggaaaatcaacccattcaaatacaggagcatctgcttaacacaagacggaacgaaccccgctgccagaccggtggtgtgggcaggcgaatgtgtgcgtgtgcataggaacaagcctatatatggatgagacattagtggcaacgagaggagagccaccacgattgacaaagccacaactattacgatttgaaatatcccccgcaggcactgacttttggtgccagaatctccccggatttattttcaggcaagtgactcacaacctggtctccataagtaattccattaaaatgagtcgccggttccactaacccgactt

SEQ ID NO: 222243 - DNA, 696 bp, Homo sapiens
tccaacatgctccaccacttcttccctagagtagggcctgtgctgtgcctggccgcccagaaacgaaaagctacaacctggccctttgggcccaagctgctagggagtacatcagagttacagatcttggctctgtggtaaacctacctccaattctaccacatggagcaaatctatagctcaaaacccaggtgccacaataggttcatcagatgctgagcctagaaccccagacccacagctgccctgagcacctgcacctggaacccagagccactgtacctgcctataggccatatcatacttgacagccgagaagtatcttcatggctaagtaacttcattgtggggcaaatgaaaataggaggactccaaaaaagcccttgccattaacaacctatgccattactgctacaaacttttacaacctaggccactgaggaaaacaaagttactgccaacattaaatactgttgataaagctgaacaaagactataccatttcacttatctggaaacagagttactacacccttctcaactagcacactaaggaccaagtgcaggtgaaagcctctatgaaagtgactgtagaaaaatgggaagacgccattgtttcaccagatgcacagacatcaatgcagggacaatagaaacatgaaaaggcaaggaaatgtgtcaccatgaaaggaacac

SEQ ID NO: 222244 - DNA, 616 bp, Homo sapiens
tccaacatgctccaccacttcttccctagagtagggcctgtgctgtgcctggccgcccagaaacgaaaagctacaacctggccctttgggcccaagctgctagggagtacatcagagttacagatcttggctctgtggtaaacctacctccaattctaccacatggagcaaatctatagctcaaaacccagagccactgtacctgcctataggccatatcatacttgacagccgagaagtatcttcatggctaagtaacttcattgtggggcaaatgaaaataggaggactccaaaaaagcccttgccattaacaacctatgccattactgctacaaacttttacaacctaggccactgaggaaaacaaagttactgccaacattaaatactgttgataaagctgaacaaagactataccatttcacttatctggaaacagagttactacacccttctcaactagcacactaaggaccaagtgcaggtgaaagcctctatgaaagtgactgtagaaaaatgggaagacgccattgtttcaccagatgcacagacatcaatgcagggacaatagaaacatgaaaaggcaaggaaatgtgtcaccatgaaaggaacac

SEQ ID NO: 222245 - DNA, 351 bp, Homo sapiens
cctgcattaccacaagcaggattactagtttaaagtgtggacacatttggaattttgaaagctattggcaaattgacttccactgggcccataccagtttattcttctgctagcaattgtttgagaatgcctgcattcccatagtcttgctcaatgagtgcatgattaaacttttggatgtctccattctgaatttttagtttcatttcttttactaagagtgtgacaagtacctcttcatatgtttatgtgccacttgtgtttctttctttctttttttttttttttttgataactgtttatccattggccactttccccaccattggaccgatgatttaaattggccta

SEQ ID NO: 222246 - DNA, 610 bp, Homo sapiens
tcctgcggtcttattcaccacaataacctcagtgcttggaacactgcacgtagtaggtgctcaaaaaacacattttgaacaaatgaataaaccaatttaagcagcaggaaaatctgttaaatgggaaataagcgacattttctcttttatttcatggtgaggtcttggctgatttagccaaatttctaaggactaaccgaaaaaataaaactgaaacacatcatttggccaattcgtttcagtgaaactcctttcttctgaatttgtgatcaagcccgccataaagaagagacatgatggcactgtaaatctgataaatttctgatgagatacatggcagtttaatgcaacttggtgacatgacccttatgctcttaccactgctgggtcctcattcatgcgatgagactgtagcccaaactctaagtaggttctgacaaagatggaaagcttggagtactaagaactgctccagtgatactccagttcttttcccattctttcctcctttttactgatgcaagataaaatgggaagtacagcaggacaaggagtgcgattcgtgctcagagtagctgtattatgggttctcacctggctgaaactccta

SEQ ID NO: 222247 - DNA, 406 bp, Homo sapiens
ttcccacaaggtactgcggccccagggtgtccagaggaatgagtggccaagaccttttgttggtccctattctcctcttcctcctttactaattgaactccaaatttaagctggacccacctaaatactacatttctagcttcccttgcacgtaggaccacattctagccaacgggacgtgagtggagttgaagtgttccactggtgaacgactcccttaaaaggaatgggcatgcatgccccttgacagctgggatgcagatgtgatggtgggagcgggagcagccactttggttccagacatggaaactgcaggtgatggtgacagagccaccctaccagccctgggccactgacttctggctgtttgtgaaagagaaataaacttctatcttatttaaactac

SEQ ID NO: 222248 - DNA, 522 bp, Homo sapiens
ggaaggggaacttcacactctggggactgttgtgggatgcggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaatttaagaaaaaaaatttaaaaaaaaaaagattgtaaactacgaaagagagtgacaagtatagttggaagaggcataaatggtgcccacatgtggccagaagaagtatgaggcctgcttcacaatatctttaaagttctacccactccccacaccctcagtgattctggaatttgttttaattttaaccatgtttacggtagtaatgtatatagacagtcccttctccttttaatttgaagtacctggataccataacatgactagagtgtggcagaagcccaaacaggaatttatttttcaattgcctggtctctgtgaaccta

SEQ ID NO: 222249 - DNA, 458 bp, Homo sapiens
atatagttgttacatatatatatgctttgaaagtgattatcatggacactgtagttgcaatcccaacatttattccactcttcccacattgtgcatagtacacctaagaaattgaggtgaaattaacctcacctttatctccaaagttagtccagttaagataacccaatcccaacctacgttgttcccctggccacaagatgttgttcagggttgagcaaattggcaccaattacaggactttagccccaaaattgtgggctgtggctcctttctctcccttgataaatgagaaagcatgtggttcttgttactgagggcagtcatcttgtaaccaagaaaataaaaaagctggaaccctgatcaaataagcaaagatttataactttgtatataagaagaaggacataaacagtaaactgtgaaggttttaaataaacacttttctgcctccttcc

SEQ ID NO: 222250 - DNA, 366 bp, Homo sapiens
ttattttctacttattgaaagagctctttcagaccgagacatcaatttttccatatatcactctcgggcatagatagatacaaaggaaaatacaagtgaaatacattgagcaaagtgttctaaaagtttttcagagtccaagcactctgagtcactttttgactcagatgttagtgcctattttcttcaaacagagtcatccactgtgccaccaaaagcgctggtgatgtagcatttcctaaggaaaaaaatccataaaaatactaagagccattggttctggactttgaagacagcttggcaatgaagtcgaggtagccagcctttgactcttctgggaattttgcctaactcctcaattcacca

SEQ ID NO: 222251 - DNA, 483 bp, Homo sapiens
gtcaatctatgtgccccagcagccaacttacatagcactgtgtgcaggcttgtaaatagaccttccagttctgctataatcaataccttattgtccataactcaatttggagaaggtttagctgtctaccaactcttgtggagagtttctgtgaagttttgttttgggttgcaagaatctggaaaacagatgcagatttttttgaggaagattttgaaatttctacttataaggtacccaaaatgggatccaaactcttgaatttggttgatcttctgaaatacatacctgtgttttaagatttgcttgagcaaacctttaaccatggaaattttaaccaatgatttccaggttgaaacaattccagttttgtcatttaaataccacagatgaatctgttttagcacagagtacaaatatcttttttccttttgagcatttggaatagtgtgttttggtaataaaacatagctctgcatatta

SEQ ID NO: 222252 - DNA, 310 bp, Homo sapiens
tattattttaatttgcattaataaaaaatggcttgagttaagtcataggtggagttgcaaacttgtttgccttaggcaaatgtagaaaaatatgttctttatttcctgcttacacctgattaagcaaaatcaggtacaagtaggaaatacatttaactgattagactcgttcaatggaaaatttcacttatatattgagcctaatatatcaaaaaagggcaaaatatgagaacaatttggcttaattaaaaaaaaggagacctaatgaaattgcttttgataaagaagaaggtagagaaaaaaaaaacaa

SEQ ID NO: 222253 - DNA, 558 bp, Homo sapiens
atcccccctccatttaaggcatttgtttagccacaatcaatgctgccttttatcacataccatgtaataacctttaaaaaataaacctatttactaaagcacagcatacatatagaaaaatagaaaattcacaagtttacagtttagtgcattatgataagaggataccaccataaatgaatcaccagaaccagggaataccgcatcaccagcatccctggagctcccatcctaccctgccaccatgcccttccttcttccctaaaagtcaatgctctcttaatttctaacaccatgggtttatttcatgtatattttcatccttctgcatgtaaaatcatgcactatgtattcttttgtgtctaacttattttgctcagctttatgtttgtgacaatcatccatgttgctgtatgtaactgcagtttgtttattgtcattgctatatagtattctgcaaatatataaatcaacatttatttattttactgttgaagaacatttatactgtttctagttcgaggctattatgaataaagctgttgtaaacattccaat

SEQ ID NO: 222254 - DNA, 221 bp, Homo sapiens
tcactcatcaccccaccccttcctaggcaagcccatatctactcctctctcctcctctgtcttccctgcctgttactccctccctactccccatgtggcctccttatgcctccatttcttttttttagttctctctctccttgcctaggaaggggtggggtgatgagtgaagagaagtctaaaggagccaaaaggggtggagagagataaggaggagggct

SEQ ID NO: 222255 - DNA, 354 bp, Homo sapiens
atccctttaatttccgtggccaatcccttcacccgtccccaccccgaaaccattaaaaccttctgttatttcacatcacccccgactaacacttcagaggcttggagatcctctaatgtgttccacgtgtccccaaagccatctaaattcagccctgggcctgcattcttggtgtgagaaaactgaactcatcttcaaaggcccagcctccccttaagattttctgcccacaccccccatgccctttcctttttcaaggcactcggctccctgccccgaccatcagtggctgtgggctgctcagagagactcaggccattcccgcttggttttcttccagtgaaagatgaccag

SEQ ID NO: 222256 - DNA, 374 bp, Homo sapiens
gcaatagggttcatactttctccatggcagagtatgaggggaaggagagagagttctagagagatactttcctgcatttcgagactcaagaaatagcctcctgatttactaaataaaaacaggaaaggagttttgtgtggtctgctctttctcctggaacttgaaagacttagtagtcatgaggtggctatccctggtgttttcctaattttgaatctaggacctattatgagattgagttttatttttactactttgctaatcagagctcaagggtaagtttttcaaaatcttcatcagctggcaaacacagaggcaaagtgtggacatagttgtgtttatattcattgaaaaataaaaatttggtgcttttc

SEQ ID NO: 222257 - DNA, 425 bp, Homo sapiens
gactcagcatgctaaatgcaaaaataaattttacttaaatgaaaatttaaaattttagaagaaaaatgtaggagtatgtatatgtaaataatgggatggggagatcttttactatgataggatacctagaaggtgtatagttgtcctcagtatccagtggtagggggattggttccaagacccccaaggataccaaaatttgaggacgctcaagtcccttatacaaactgtgtgttatttgtatctaaccttcacatagactctaacatactttaagtcatcactagattacttataacatctaatacagtataaatgctctgtaaatagttgtactgtattttttaatttgtattttttattatattgcttgagcccaggggtttgggtccatactgggccacgtagcaaaatcctgtcaatta

SEQ ID NO: 222258 - DNA, 483 bp, Homo sapiens
agtacccacctttttccaatttagctactggcatttgtatacattaatgtccatacctcctaccgcccactccaccccaccatttattcattggtttcacaactatttattgagggtgtattataggctctcaatgaataaaatagactcctgcccttgggagcttatattcaaaaggataataccttctttgaaggcgggacgctgtcttagtcaccattattcccacggcccatagcacagtgctttctttgcctaacatgctctataaaaatatgcaaatcttgagacaagtcacaaagcagaattttgtggaaccaaaaataaatgtgctcatctcttttattctttaaatggctcatacagactaattggaatggagatgcgtatttaactcaatgccttcctctaaaacatactcaaggtccatttatttccaagatggcattttgacctgtgacaactaaagccccatattgcaaa

SEQ ID NO: 222259 - DNA, 368 bp, Homo sapiens
aatttgaaggactcacactgtaatcaagaccatgtggtcctggcatatggatagacacgcagaccagtggaatagaattgggagtccagaaataaaccctcacatttatgatcaactgactttcaacaaaagtactaagacaattcataagggaagaacagtcttttccacaaatggtactaggatctacatgcaaaagaatgaatttcaatccctacctcaagccatacataaaaatgaattccaaatggatcataggccaaaatgtaagagctaaaactgtgaaagtcttacaagaaagcataggagtaagtcttcatgaccttgggtgaggcaaagctttctcagatatgtcacagaaagtacaa

SEQ ID NO: 222260 - DNA, 277 bp, Homo sapiens
agaaacaaatgtgaatcctctgtggagaaagataacatcatcaacattttcaaattactttgaaaaccaattgtgtgaaaataaggttttggctgggcgcggtggctcacgcttgtaatcccagcactttggtgggccgaggcaggcggatcacgaggtcaggagatcgagaccatcctggctaacacagtgaaaccccgtctctactaaaaatacaaaaaattagccgggcgcagtagtgggcgcctgtagtcccagctactcgggaggctgaggc

SEQ ID NO: 222261 - DNA, 469 bp, Homo sapiens
aatgatcatcaactactccttcttaagggatcagcatgttttcattaacctcctaccctgtgccagactgtgtttatgagcttaagaaaccaccccttactgggctgcttctgtgcttaaaggcaggaaaagtcttcaaatgtaaaaacaaagaaatgagtaaaatgctagacagtgggggtttgctatttttatagtggcaggaaaaacctcatacccctcccagtttctactttgtgagtggcaaccaattttgcctataaatgagtgatctttgatacatccccagtattttatgtttatacaattgccttatgtatgcaccaagtggataaaaataaaatgaagttttagtgtgttttaggcaattatcttctgattaacgtaaaaaaacactggggaatggtgtatgttgtattgctatttacatatattaataaatgaataaaaacattcataaattacctaa

SEQ ID NO: 222262 - DNA, 409 bp, Homo sapiens
aacaatatttttataaaattacagtacagttatagcacattcatctctactaatctgtatgctggcttagaagaggaaaatcctacactcttctaaattttcaccgagtttcctttcttaataatccaatacaaaatgtttgctcattatttttaataggaagtttgtgaaaggcacctaagtatactgaaagaggtcctctatctctcaagaataagttgctattttgtctcagtagcaaagatttaacaaagaaaaagatattttctactgtcacaatcatccaaggacatactaactaaatccttcccttggcatctagcaaaagaggtcagggtctgtgaataaggcaaggaaatttaggagtgggaggagtaaatcagaaaacaaaaccaaaaccaaaaaaaaa

SEQ ID NO: 222263 - DNA, 254 bp, Homo sapiens
tgggataggcataggttatatgcaaatactatgccattttatataaaggacttgagcatccatggagtttagtatcctccaggttgcctggaactaatccctcatagatactgagggacagctatatatagaaaatcctaaggactccacccaaaactgctagaattcataaacccaataaagttgcagggtacaaaatcaacctacacaaaccagtagcattttgttttacactaacaacaaactgtctgaaa

SEQ ID NO: 222264 - DNA, 2316 bp, Homo sapiens
tccctaattggcccagatcctaataaacacacacacacacacacacacacacacacacacacacgttttgttgtttgttttgttttgttttgatcttttgggacctacccaaatccaaggtctccccatccccttttcacttcactctgccttttcatccaggccagtgacttggaatcatgcatgacatattcactacttgatcttgtgaacactggaaagactgtctttattctttcatgaagataattggagagtctattctctgtgctctaggggatacctattttgtttgcctttcttttgaatgagaaagaggcatgtctgagggtgatatttattcctgctgttttgttttggggaccaggtagggaggctgttgaagaaagccaagaaaacccagagaaggcaaaactctaattccacaatatgccaaatactcataaagagcaagatttcatgctccaaagctgccactgtgtatcaacaagcagtgcacttcatgccaaaacaaagttttttttccaaagcacattggcaaggactagatttagagagcccacaacagaagtgtgcatgccctccacttcaaccaaaggcagaatagcatttggccatgttattaaaaatacactgttcataattgaggtgatgtgaacattctgctcccctcctccagaaaggactgggcatttctggagttccaccattactagatgtcataatttaggacaagaaaataaagttagtaataggaagcaataaaatttcatttagcatctgctatagactgtggatgacattaggcattttcaaatatcatcaccatctgaagattaagaaatctggccaggtgcagtggctcaagcttgtattaccagcactttaggaggtcaaggcaggaagatccctggagctcaggagttcaagagcagcctgggcaacatggcaaaaccccatctctacaaaaaattagctgggcactgtggtactcacccatagtcccagctattcaggaggctaaggtaagaaaatcacctgagcccaagaggtcaaggcttcagtgagccatgattgcaccactgtactccagcctgggcaacagagtgagaccctgtctcaaaaagaaaaagaaagaaaaaggaatgagaaatctgaggcttgcccactagcccacaaccacatagcaaggtctgaaacctgaaccaacatctggttcacctaatgccctggctctttgtacttgtttatatttaacatagagtggacagggcatcagaggactctgcaagatcatgaggagaatatttgaaggaatatttagtctgatagagagaagtcttgatgaaacaagatagctgtttccaaatatttgaactatttactctttgtacgaagcagcaaacttacaattaaaaagtctataggacagactgggaccaaagcctgaaaattcagtcaagaaggaacactctaatacgacagaaggaaaaaaatactctctaatagtgaaggggctgccttacaagatgaattccctatcacagcacacattctagaaaagaccaggcactacttggaagaaatatcagataagtgaggtgctcatctagctgctactactttcccttcaagccttagggtctaagaccagcataagcttggagaggttcaacttctgacatgcagattgctgcagaagacaaattaagacattaaaaccaaatgccaggtagttagaaaaaacaaagttctgcatgagaacaaatctgcatgaccatcccctcctgacttaaaaaataataattaaataaagttctagacacatttgggctcccttggaaaaaaatgccatacaattgcattaacacaactgttgctattaggaatatttacctaataataataatatgtagaacaatcaaaatagggaggaaatagccagaaagtcattcttgcagatggtcacatgtctagggaggcagaaataagaaatgtttaacaagcagtcttctttaagttatgacaaatgatgctctgactttataaaaccccctggccaaggatctgaagtccatccccataggtggaaacaggaatgatagaatcataaaatgttacaatggagaacctctaattcagtcatgtctttccacagatggggagatagaagctcagatagcttagtggatttgctcaatgacgcacagttcattcattgcagagttggggccacaaccttcctcagacctagccttacgatccaggatctcttcctacagcaatgcaccaaattcatttttctagaattgaact

SEQ ID NO: 222265 - DNA, 472 bp, Homo sapiens
agtaattctaggaattcagtgcatttggcctgcaaatttatctctcactatttttcttcaaatccatccagtgcatctttgttttaagcctaataaaattaagccttaataaaattattcaggcaggagtgacccagacaaagaaagatgggcttggttggggtggcaagacagaactgtaaattcatggaaaaaaccttttgataggataaagatgggaaagtcatgaagaagattgtgaccattcaggttcccctgtgagcgaaatgccaaattgaagaagaaaagaaaaagaaggaggtggagaaggaggaagaagagacagggaggaagaagaggaagagtaaataaggagaaggagggagaataagaagagaagaaacagaagagggagatgaggaagcaggaggagaaggaggaaaagaggaagacggagaaggaggagggacaggacgaggagaaaggagggcag

SEQ ID NO: 222266 - DNA, 774 bp, Homo sapiens
ttatggaattaacgttcttaaatgtgaggatggtaacgtaattatataggagaatgtccttgttcttaggaattacatgtataagtatttaggagtaaagtgttaggatgactgcaacttcccccgcaaacccacgcttttttgagatggaacttatacacagtagagggtacaaatctgaagtatatcgctcagagtttttacatgtgtaactaccatgtagattaagatgtaggacatttcctgatgctttagagggttctcctgtgcccctcccaattcactaaaaataaccactatttcatttctatctctgtcagttacttggaaacttaacttcaaatggtgtgatggaaatcaacatgcagagaaagagaaaagcaaatacgaaaagataatcttagaatctaagaaaatttcgatgttaattgtaccatttgttcagattttctgtctgaaattttttgtaatagagttggaaaaattgaaaacatagaaaaaaagaaatgtagaaagttcaaaagaaacagttatctctaggaaaaaagagtgaacatactgatactcatttgaggatgtagcaagataacactttaagtaaaatttcagtatgtcaagttagttacagcaaattacataggaaatgtttaaatgtcacatagaaattcaaatatttatttaaaaaactcagtgaataaggtaaagctagattaaacccagccaaagaatgaattagtgaactctggaaagtgaagaaagagagttatagaaaat

SEQ ID NO: 222267 - DNA, 1356 bp, Homo sapiens
  misc_feature (2)..(3): n is a, c, g, or t
gnnctagagagtcattctcctttctgtaatttgcattctgcactaaacacttctctgatatagccattttagtcattattctggagacatttcccataaatactatctgctaaccacatacctccgatatctatggcagtgatttttttttttttgagatggagtctcgctctgtcaccaggctggagtggagtggcacaatctcagctcactgcaacctccgtcacctgggttcaagcaattctcctgcctcagcctcccaagtacctgggactacaggtgcacaccaccacgtccagctaatttttgtatttttagtagagacggggtttcaccatgttggccaggatggtctcgatctcttgacctcatgatcctccccccatcagcctcccaaagtgctaggattacaggcatgagccaccttgcccagccatgatttttagtctcttcgatcatggactcctttggaaacctgccttagaaaaatgctcagatatacatatattcatatgcaatttcaggagagtgactcagtgagtgactgtgtctagcaaaagaactgtaatccaggtagattaaatcacagttacactatgcctgctaaggaaagaggaaatagcaccaagcacttgcattcccatgcggcctgacgttgacagttttatgcgtattctctaagttcaacctctgcctcatctatactactagtaatatgtatgcatcctgcattgctgtaatgttaatattactgtgcacttttttcctgtttgtactaactctgtaattttttcctgtttttacttactctgtaatttatcctgtaggaactgtacttaagaattgagaggggttttagttttaactaatgccgttgggattattagtggtatttatcctaaccttcagactctacctctcagcccatttgctttatttcttttctttttttctttttcttttttttttttttttttttttgagacagagccttgctctgtcacccaggctggagtgcaatagcacgatcttggctcaccacaacttctgtcttccaagttcaagcaattcttttgcctcagcctcccgagtagctggggctacaggcacgcaccaccacgcctggctaatttttgtattttcagtagagacagggtttcatcatgttggccaggtgggtcttgaactcctgacctcaagcgatccacctgcctcggcctcccaaagtgctgggattacagatgggagccactgtgcccagcctatttctaaataagaatttacttgggttctattaatagtttttaaaattaacaaaagcaacaacaaatccaacctaaatgtttgacttttacc

SEQ ID NO: 222268 - DNA, 1025 bp, Homo sapiens
tcctgatgaggaaacaggcagatgtttctcctgctgttacttctgaacagaaactatttagaaattccagttagttggttagaatctaaaccagattttttcagtgcatgtaagttggctgtttggatgactgtgaaccacatattcctaagagagactgttttatgatggtgtctttaaatgacagattgagaggccacccccataatgatacacttaaatccacctaaacaaatgtggaatgagacaatgaaagcaccaggtgctactggtttaaagtaatgtaaagcagtaatcacctaagcaggatgattagtttcaatgctagcagatgcaaagcccatattatgacaaatgatattttaactaccttgaagtctcagtccccaatgtggtctgagtttctcagtaatcccactgctaactttttgatggctctcctttcttgaacctctttattcacatgtccagacacacatgatactatttacatgttttgctgagggtttaaaagtgcttagtaagccgctgacccaaaaaagatgagctgtttctcaaaacaataagcagtgtggtctttctacccttagctctgtcctatcttagcattgcagagaacagaaaaaatgcctgtttactaatagtatgttaccaaaaaaaaaaagttcagcatggtggaaggtgacattcttttcacagccattggaaacatacactttagagcaagtcgggagaattttattcgttgtacttctgcagacaggtctggaatgggtttatcagactcactaaaggaggaatggggtgagcacctctctgtaagacatactaaagggtctgttttacaatgcgagtcccttcctctagactgtacagttgacagaaaattggccataaagaacaaacttttttccccagtggccgctatcagaagtacatttccattggaaaattcacttcatagttgaaaagttttgctgaatgttcagtgaggctccccgatatccgggatcctctcgaccgcc

SEQ ID NO: 222269 - DNA, 552 bp, Homo sapiens
ggacttttaaaaatatatatggataaaagtgggaaaaggagatcaaaagtagctgagagcaagaaaataaatgaacaaagtataaattgaattgtggaaattcacatacaaggggctagagttaaaagggacctcagtagccacagggactatctaattcatctctggaccatgagggcctgccacagcgcctagcatatcgtaagtactcaataaatgcttgtggaaaggatggatggatgggtggatggatggatggatggatggatggatggatggatagaaatgcaacttcaagatctggttctacagtattacatatgaagcaactgagactcagataaaattcagtgagttgctgaagactattcactcattgagcctcacattctgatgctatatatatcaggtgctatgcagatgattagggaagggcaggactgagattaaactgacaccccctacatcctaatccaggctttttccactgtatggcgatgcctcccaaaagaattatcacagcgacttaataaaggagggagaaagttagct

SEQ ID NO: 222270 - DNA, 3677 bp, Homo sapiens
gaggcctccctctagctggcctcaggacccagatgggggacaggcggagtgtcagtatcaaggaaagatgtccctgggaggaagggctgagtcttgacttcttaaagaggcactgcccagctaaacacttgggggtctgatgagtctccaggtcggactccctccccgccattgtgtcactgccaggggcacagataagcatcccccccgccccagtttggggaattttccaacacctcatggggagaaaaacaaggaaaaaccaacaagtgcaggtggagattattccatggtgctgctgacaacagtgggagggagacagtgcagctgacggggacctcaccctccaccagccttgaggacagggtgggtgggagctgacagtaatgttcgcctggatccaaatcaaagcctggaacgaccaagtaaccggcctgctgggtctgaaccacagccctctggccgcctttggccccactgagcccccgtgtcacagtgtcactgaagcgccttcccttgacgggtctgtgtttccaaatgaaaggtgtcagcaggaaagttcctggtgccttcagagtcgaccggttcaaggccagctcacgaatccactgtggagacttgcattggtgaggtctgtatgcacttaggaggcacgctgggctgtgaggcctgggagagctctcctgaaaggggactccgcagctccctctgtgtctgctgtcttagccctggacggggccaccttctagttctcgtatctgggtgggtcacacgggccagaatctggatgtctgtggccgatgcaaaaccaatagtggctgggaaacacactggctctgatttctgcttccctctggcattaccatggaaccgagacaccgtaggggcatgacaccaccctagccgaggcctgcccactcaggatggggttcattttcagaagcaaataagtggttcatttcagcagcctcttggaaatccgcagtttagacagctcggcacgctgggcgatgggatggccccgggaggcgcccggcacctgtcctcactggcgctccaaggtgtctgatggcacttccaccccaccatgtgcaggacatgcctagccacttcccattcattcatttaccgacaatgaaattgtatccaactccttcaataattcgaagcacggcctagctgatctggtatttgcactactcttaatgcgaacttccaaaagaaccgttccgctaacctagaaatgccacttcctaatacacacatttgcctgagacagaaaggcctgcttttaaagaaataccagagagggaagaggtttcccgggaacagccacacacgcaaataacccattgatggaaatttggggtttgtaaattagagggttctggagaggcaccgccggggcaccacctccacaagtgaggtgcgggtgacctgggcccccctgactgccagcatggactgggctgctcctgcacaggtaaaaacatgccctgaacagcagtctcagaacgtccacgctgaaagagtcacgctgccaatctgccgggcagtcagacagccctcttggcatttgctcagggaagtggaatcattcaaaccagaggaagcagctgtgccctcttctaagttagcacaaatagtcaagatccagtgaacccagaaaccaccagctgatcggctgagcccccgaatgccgtgaacatggagagacgtcatcttgagtccccagaggagagctggttatggatgattttagacaatgatacgacccaaggggacaaacaaaaacaattaagggtcctgtcttcactcaacccatcccttcagagtggctgaagtacactatctgatcatttcctctggaaaaaaactggggtatttgcagtgggaaaagtgattttaaacagaaaacaggccgggcacaggggctcatgcctgtaatcccaacactttgggagcctgaggcagaaggatcatttgagcccagagttcaaagaccagactgggtagtaaagtgagaccttgtctctatcagaacattttaaaattagccagatgtggtggtgcgcgcctgaggtcccagctacgtgggaggctgaggtgggacgattgcttgagcccaggaggtcaaggctgcagtgaagctgtgactgcaccactgcattctagcctgggcaacagagcgagactcatctccaaatatgtaaaaaccaaaaacttagggaaaaaaaaaaaaacagaaaacaacagggctgcatccaggcctgggtggaatttgctttcccaccaggagatgagggtgataaaatggctggcgctattttaaaactgaagttaacaattgttctggaactaccagaaatgctaagccaaatgataccttgaaaccttgggtgttttttttttttatgcttttcgaaaaaacgagccctttgcgggttggggtcacaggaaatagaattatgaatttcagaaagagaacagtcatttcttcaagctgccgttcaccccacttacctaactcttccctacccaagacagagtacctgagtcatgtgtgaagagttctgttttttttaaatcagcgtttaatatttttccaccagaaaataaatgaagggctattcaagaaactctagataaagcaggttttgtttctggcttttattaacaatgtcaccattttgtatagacccccagtgcgcatctagggtcaacaaaatcaaactcactgccgttgtaaaatatttataggtcaccaagagccagaaacaggtcagggtcttgggcgatttaaataagccacatgggccagtcacgtgtaaccccagtacttcaaggtgggaggatcgcttgaggccaggagttccagaccagcccaggcaacacagcaagaccctacctctacaaaaaaaaaaaattaaacattagccttgcgtggtgttgcacgcctgtcgtcccagctactcaggaggccaagacaggaggatcgcttgagcccaggaattcgaggttacaagtgagctctgatcgcgccaatgcagaccaggctgggcaacacagcgagaccctgtcactaaaataaataaattgacaaataagccataggatagctgtgcacggtagagattatcaagacggctcagaaacaaatcgggtgctttctgtgcattgacatggcagggctgtgttcaaagagccatcccaggagtcgaagcatctataaataacacatctcacacctaatgatgaaggaactaacaagcccaaaggaagaaagcgagggcatcacacatagtgaaaccaattctgggaagacaacacctgaagctttcagagaacaagattttcatgtatcaaggaagctgctaaaaactccttgaagcgacggcatgttacaatctggaatattttttcacacagagaaaaacaaagccaggctttcgaaatcccgagatttgcttccgaaaaggcacttaactttgctcaacagttttttggagctctttttgttttggctttcagagtggctgttctagactggatttcttttttcattggagctggtaactgaaatttaaaagctttaaaaaaaaaaaacttcaaattgctcttccctggcgcgatctgcctgaagtccttcaatttgcacttgtggcacaaaatgcatg

SEQ ID NO: 222271 - DNA, 493 bp, Homo sapiens
accgggactgtgtgccacgagccctaattggaggacgtccatcagatcgcgccagggcagacacactttgtaattttgtttcttacagcttctaaagtgtcagataccagctcccatgcatagagaaatccagtctaggacaacacctgaagctttcagagaacaagattttcatgtatcaaggaagctgctaaaaactccttgaagcgacggcatgttacaatctggaatattttttcacacagagaaaaacaaagccaggctttcgaaatcccgagatttgcttccgaaaaggcacttaactttgctcaacagttttttggagctctttttgttttggctttcagagtggctgttctagactggatttcttttttcattggagctggtaactgaaatttaaaagctttaaaaaaaaaaaacttcaaattgctcttccctggcgcgatctgcctgaagtccttcaatttgcacttgtggcacaaaatgcatg

SEQ ID NO: 222272 - DNA, 393 bp, Homo sapiens
ctgagggcgaggctgggggcggggacccacatggagagaggcaggggaaggtgcccagtggcgcgtgtcaggtccaaggacggcgctcgggtgcagccacctgccagagaccagggtcaggcagcaggtgtgggggtggagagcactcactagaccccaggtgccaacatgccaggcctggtcactgaggagggggcagtcctcatgcacacagggctcagtcagaggtggccggtcttccaaggagcacgctgcggtatggagcaaagaacccctttcaccccggcaagtaacgctccgcttccggacgccaacgccacaactgacagaacactgcaaggacaaggctgtcagcagaagctcggccttgcccccaggagccacgccagttcg

SEQ ID NO: 222273 - DNA, 451 bp, Homo sapiens
taaataaataaataaataaataaatggagggagggaaggaaggaaaggaaggaaggaaggaagcaaggaagcaagcaagcaagcagaaaacaaggaaagaaagaaagtctttaagttcccaagaatgagtccatttttaaatagtggaattccaggccccatgctaggttggtagggagatattttgcatcaggagtgctcatccaacatcctcaattgctgaataaaccacagccctctgaaaccagccctggacactggagctggccgtccttcatccagggttgtcctgggctgggctctccgagtcccagaataacagcgggcttgcttaactaaatgaggaaacagcctccagcatgatattatgaagccatggcaaatcagtttatcaaggaattccacatgaaacaggaaagctcacatctattgctaagtgaaaaacaaaaaa

SEQ ID NO: 222274 - DNA, 534 bp, Homo sapiens
acaagtagaagtattgaccctcaaggtcattttagtattgatttcattatgagataatcacattattttctctttatccattgagaataaatagcatgcaatctgtcacagtcactggtttggctaacttgacttccatgcccagccttattttctcttgcctgcctctaacctagagagtggaaaacctaaatatgcaagtttccagccaaccctgaaaccatagtggccacgtgactatttttgtttttttgcaaatgtgatctaaacataagtttacagggaagtttctagaaaagcttttgcttttttgagaaaaggggacaaatttggctgatgttttatcttcttttgtaatgcctgccttggttatggatgtgacacctaaagttagggaaaccttgaggctgaggttggaggatcacttctggccaggagtttgaggctacagtgagctacgatcaggccactgcaccccagcttgggcaacaaaataagactccgtctctaaaaaaagtttaagaaaggaaaaaa

SEQ ID NO: 222275 - DNA, 348 bp, Homo sapiens
tccttagcccgtagcctcgtcaccacaatctgcctggtctccacatggccctctctgtgtgtctcttgttgggataggcgcattggatttagggctcaccctcatccggaacaatctcatctcgagcctgaacttaggacagctgccaagaccctgtttccagacaaggcctcactggaaggctccagatggccatgaactgcggggacactcttgaagccagcacgccctcccctttctcaggcttccccccacagcctgggcatggccgtctcaaaagctgtcagtttctctttttgggcttgtgggtcctggtggagcggttgacaccgcccaggaagcactttg

SEQ ID NO: 222276 - DNA, 324 bp, Homo sapiens
cagtaactggcattttggttcactttgcattttactcatctgctgatttaatgagtgttctgtgtattgagcaatagcaggagttctacttaactatcactaaacataaagaagaaaaataccatatgaggtgtctagttttttttattttctttttaatttacaggggagtcatctgttaacttgcgtaattgaggaatagagcagtccagttaataagaaagcttagttattagaaagttgccatctcttctgagtccccttttcaaaggattagaatgtgataaaatacacttaacactaaaactcataatttaatctttg

SEQ ID NO: 222277 - DNA, 334 bp, Homo sapiens
ctgtacccactcccagccagtatttctcagttgtgcatctgcagtgccttctttagtattcctgtagatccacacagccaatatttgtttgccttcacctgaagagaatggcaatctacatgatatacgtggactgtaatgcctcaaaggtgcgtggaaagtcccacttatttttctgaaatattaaagtgtgatttagaggactcaatttttccctgaggctctatgcttatccaataagtggatggcattctctttgggtcagacacactctcttcctctcaggaatatatttcatatttactcaaactataagccagtaagagacaaagtg

SEQ ID NO: 222278 - DNA, 451 bp, Homo sapiens
gcacgagaaaactgctaaactctactgacagaaatcaaagaaaatataaataaatggagagatatcccatgtttatggatgggaggattctctattaagatgtcagtttttctcaacttgatgtgtacattgaacacaatctccatcaaaatccaagcaagttattttatgtatattgacagactgattctattgtttatgtggagtggcaaaagacccaaaatagccaacacaatgctgaagaaaaagaggactggcactaaccaacttcgaaacttgctgtaaagctacagtaatgaagacattgtggtattggtgaaagaatagacaaataaataaatggaacaaaacagccccaaaatagatctactattggcaaaggcaattcaatggagaaaggatagtcctttcaacaaagggtgctgtaacaactggacatcacatacaaaaa

SEQ ID NO: 222279 - DNA, 345 bp, Homo sapiens
  misc_feature (308)..(308): n is a, c, g, or t
  misc_feature (310)..(310): n is a, c, g, or t
ccaggtttagagtcgtggctttggaaaaagcaaagggaggaatttaatttcacttaatgttcaggactctgtgatcctgtaatgtggttgttactgatctatagttggcaaagcttataaatgtgtgaggtctctttccagaatttacaaataagtgatttatatttcgccatttgggacaaaaatgttaacatctctttgaacacagtcaaattgatacatctttagtctttgatcttttcatttcaaggaaataagtgatactattctttgagcttataaaacttcacagtattacccaattcatngnccaaagactgccacttcgttgatttagagtgtatt

SEQ ID NO: 222280 - DNA, 440 bp, Homo sapiens
ttctccatggtaaagttagtttttcctcttttgtgattaataaatgttgtctgatgtggtactttgagattgtgtaaactccagtttctcctctacttttacccactactttgaacatccattaatacttctttcttggattgattttacagtcatggttgccaaatggtaatttttctaactttattaccccttctacatttattagtaggcattctattgtaagcaagaagcttttctcctcctatttatttttttcattcatttatttatatcaatgtctactcatgggttcctagtcagtgggttataattcattgctatcattatttattatgatgctcttattatcccaggtttggctttttaagcaggcttctgtgtccttgtgtcatatcatttaagtgttgtttgaggactttctcaccttctagcacaag

SEQ ID NO: 222281 - DNA, 473 bp, Homo sapiens
agttgaatgcagttcattgagtgtactcccttgaagggaaatccaacacaccatattgatactccatagctagaaaaatagcaagtagttttctatgactcagtatgaacccagatacatagttggatcaaaactttggcttttcccagttgtcagtaaggggaaagtcacttatgctatctaaaccttgttttcttctcaggaaaatggacaaaatgccattaactttgaagtgccattgtcaaaaaaaaaaaaaaattaagaagaggagctgagtctaacctcagcagacgatgtttttagtcctaattctgcattgaatcagttctgtgaccttggccaagtatttcatcttttcacgatctagtttcctgagctataaattggtcataataataattcctaccttacaaaattgatttgggattaaatgaaataaagcatataaaattcaagatctggtctgataaata

SEQ ID NO: 222282 - DNA, 592 bp, Homo sapiens
ggtttattttatgttcatctgcaattttttgcatgctttgcttgctaaatatgttatttgttcgtactaagctgagctgtcaccatgctaatgacttctaacttgctgtattttctttatgaagggaactgtatctggacatttcagtttgtaatattagactcatttagactctgccacatattcctacaaccagttaaaaagtgaaaaatctgtataataactgcttcctaagtaagtaatgtcagctagttgggatgattttaagcactgagttgagtttgtcagtttatgaaaattcaggaagccagctgggtaaaatgagaagagtacttatctaagaatttgaaagcactgggttttcttcctgtcccatcatttcccggcctttgtgtgatcttgggtgggtgttttagcttctccatgccaccttccttttatgtaaaatgagcataatgaacttgtcatgataccttcacgaggttatcaagatcattaagaccgaaaaggaatgaaaatatatgttaacatcttcataaatttcaggtgcttaaataaacttcagtggtattaaatcagtaatcatgtaaga

SEQ ID NO: 222283 - DNA, 406 bp, Homo sapiens
cagaagaatggcgtgaacccgagaggtggagcttgcagtgagccaagatcgcgccactgcactccaacctgggcgacagagccagactacgtctcaaaaaaaagaaaaaaagaaagaaaacatatcaatgatatagtgttacgttttcttaacagataaatgcaattattctaacatgaacaagaaaaactgaaagattcacatcaagggatgcaatcattagtaataagcatgaacccataaattagataaacatgccatttaccagccaagtcatcagtaaaaaatattttattagtaatagaatcaggtgactgaaatgttgtaagcaactatccagcatgtttgtcaaactctccatatagctattacacagtatctttgcttatagctttttcctaagata

SEQ ID NO: 222284 - DNA, 685 bp, Homo sapiens
gtaaagccccatagaacctatgttttttcaagaaactcacaatacctagaaaataatgatacagttctcctttctccaagtcatttcttggtgagggattctactgcccatatcttgttccagagcagtagtaagagggaggaaataggttataaatatatatgtgtaatttttctttctcctcttctatataaatctctcacacacatatatccacacatcccactaagtatttcacaacaggaaggcagctgtgaaatgacagtctttgtagtcattcagcaggcctcattgttgagtatttgtggtagcagtatttaaaactactgttaagttacttagagtaggaattgacacagagtgcattagaaccatacaggaaagaattgaaggcagttggaattggtttgaaagagatgacagtataagcaaaactgtgtgtgtcaacagtttgagaattatacatagcaaagtgtatgagaaggaagggtgtatgtcagaagaaaatgtgtgaatatatgtcaatgcatgtgatagaaccagtgcagaagagaagtaaaaagaattatgcatggtaggaaatcagaaatgaatagaagaaaataaaaactatttgacaccataattactttgaagaacagattgctctcataagcctacttaatggaaagaactaatgacccac

SEQ ID NO: 222285 - DNA, 508 bp, Homo sapiens
gtgcaaccatcaccacaacctaattccagatcatttcatcacctcagaaagaagctccttcatttgttacaaaagtagtttttttaaaaaaagaaaaaggccaggcgtggtggctcacgtctgtaattccagaactttgggaggctgagacaggtggattgcttgaggtcaggagtttgaggccagcctgggcaacatggtgaaactctgtctctactaaaaatccaaaaattaggcggacgctgtggctcacgcctgtaatcccagaactttgggaggccgaggtgggtggatcacctgaggtcgggagtttgaggccagcctgggcaacatgatgaaaccctgtctctactaaaaatacaaaaacttagctgggcatggtggcacatgcctgtgatcccagctactcaggagactgaggtgggagaatcacatgagcccaggagatcaaggcagagagctgatatcacacctctacagccagggagaatgagtgagaccctgtctc

SEQ ID NO: 222286 - DNA, 311 bp, Homo sapiens
gtgatccataaatatttatctctgttcctttaattaatatcctatagatgcccaaggtactggataaaaattaaagtaaaagcatgcataatctcagtgataacaacggttaacaaagtgcaatatcttttagaacatacacatatgtatacacacattcatacatgcacgctctcacgcacagacacacactcaaaatttggattgtaccataaagctaccctgtaacctgttttgttgtttgttttttcccttctcagttaatgtacagtggccactgccactcactgctgcttccttcggtgaatgag

SEQ ID NO: 222287 - DNA, 316 bp, Homo sapiens
acaatcctgcaggttggacttacctgggttccaaaccagggctgtttactacccacggggacctgagattacaggctctttctgggtatcagctttctttccagcaaaacagagatcatcgtatctacctcttggagaaagacttcaaagtccctggcatcagatgatttcttcattgacagggatccaccttactgttcaatggaatgacatgcaagatacaggctactctcgctaaaaagttgttagccagtatccaaacgtgaatgtgccaaaacttataaatgtattttgtataaattaaaacagattcaag

SEQ ID NO: 222288 - DNA, 425 bp, Homo sapiens
aagttaactcaacatttgaggttcctatatcctttaatcccatcccatgtgtatctttacaataaaacttcctgctagaggtatcctgagggaatctttgtttcttgcatctgaagagaataacactaaacttattgcatatgatttgggggttggatccaatgatagcacagagggacaggaaatgtgatttattgaccataaaagctttaatttaaaattgctggccagcgaaatccagactctgggaaatgttataggccaaatgatctgtttcttcaacaaataaattacaaaactgaggggaaaaaaaggaacctattaaaaagacattatctatcaatcactgtgtgtgtacagttttgagctcctgatttaaataaacaaattgtaaaataaaagatcttttgaaacaaaaaaaagtt

SEQ ID NO: 222289 - DNA, 272 bp, Homo sapiens
gccaatgaagagtcccctcacattgtggcctcgctcaaagttaagaagtcgctgtagtgttgcccttgaagaatctgcttcaaattgacacttcagaactccccagaaacttgtcttctgggccaatgtgtaaagctgtttatgaagaaatgtcaagccagaggggctctactacaaatttggcaaaggacaatttcaggagaagctcttggccgctgggttctcctggccaccatgaacttcaggaagtgggtgccatagcagcagcctga

SEQ ID NO: 222290 - DNA, 705 bp, Homo sapiens
gggggagtttgaatgtttttcctataatgattaatgttaggcctgttggggaaaactgcacactgcaaaatcccaaagatttttcaacaacctctgattgcttttggaatcgcaaagcaacattttcaggagacagttttgacatggcacattttggagtccctaaacagggagctaattatacatctacttagcattaaggatatctctgaatctctgagtgcctgaaaatgttccagtgaaagtcatatatttattcctggcttttatcccaaatgaaaaacttcctagactttcctcctttttcctttggaatatatattgaatttattttctagattttctccaatagaggaggtacaaaaataaatatttgtactcagcatttatgtcctgttatagcttctgattactttggttatcttagcagttgatttaaattgtcacagtaaactaagctattcttggtaatatcttcccagcataacaaagtttatttgccactaatgtaaacttttgaggggggggttgttttgttttgctttgtttttgagacagggtctctgtcacccaggctggagtgcagtggtgtgatcatggctcactacagcctcaacctcctgagctcaagccaccctccaacctcagcctcccaagtaactgggactataggcacgagctaattttttttttatttttgtagat

SEQ ID NO: 222291 - DNA, 303 bp, Homo sapiens
atcgttcttattttatggcgtttgcatttgtcagtcagcagactctatagatttctagttctgtactggaggctcaggtgaacaggacaccacgcctccagccaacctcatctgggaacagcctcgaagccaggtggaggagcctgcagcaaaatgccgggttaggtggccccaggggtgtatggccatgtacaacccatggggccgtcttcccactgggcagtgcagcgggactgcgtgtctggggcttctagggctcgctggctctctgtcaatgcttcacaaataaaaggtctttggtta

SEQ ID NO: 222292 - DNA, 451 bp, Homo sapiens
ttattaaaatcagtaagtctttagtcaagctaactaagaaagagatgatacaaattactaatgtcagaaatgaaataaaggatatcaccacagattttatggacactaaaaggataatgaaggaatattatgaacaattctatgcccacaaacttgaaaacctagatgaaataggccaattccttgaaaggtaccatctgccaaaactcatatgagaagaaatatacaatctgaataattctatatctattaaggaaatcaaatcaataattaataagcctccaaaacaaaaagcaccagcacagataggttcactggtttctgctaaacatttaagaaagaaatgataccaattctctacaatatcttccagaaaatagaagcagagtgaatacttcctaactcattctaccaacccagttttaccttaataccaaaccaaagacattac

SEQ ID NO: 222293 - DNA, 500 bp, Homo sapiens
gtggatgtatatgtgcatatatatatatacagagattgtgtgtgtgtgtgtttatttgtatgatagaatgagggagacaaaaagaaactgagtagagctgttctaattctgtagtagcggtagaaaaaatactaaaaaaaatagtttttttttcattttaccttctcattatagaaaatgtggaacatattcaaaaagagataaaatagtataatgaatcccgggtactatatacccacattcaaaactatcaactgaccaatcaggtttcctttgtaacccttacctcaggatactttgaagcaaattctgtcacatcatttttcttcaaaagtattatagactttttaagaaaactaaaatattagattgaaaataattaacaaaactccttaatatcaccaaatatctgatctgtatttaaatgtccttgatggtcttataaagttattttacattttgttcaaacctctcccctaataaaatacatgtattgcaac

SEQ ID NO: 222294 - DNA, 275 bp, Homo sapiens
agtatgcagccattaaaaatcaagttataaatgacaggaaaatgatcactccattttagtttagaaagcaaattatataagtgtgtgtagtttgacatcttttgtttaaagtgtatagatgatacgttagctatctgtataggtacacaaacataaggacagtttctgtaacatgtatcactgaaaaatggaatgacaagcggatcacgaggtcaggagatcgagaccatcctggctaaaacggtgaaaccccgtctctactaaaaatacaaaaa

SEQ ID NO: 222295 - DNA, 384 bp, Homo sapiens
tccttttaaaatttttattcatgtattatgtgtacatgttaaatagtactgagtgccccaacccttggaattcatctacagataactgcttttaattgtttgctactagctgggcacggtggctcatgcctgtaatcccagcactttgggagactgaggcaggtggatcatgaagtcaggagttcaagaccagcctagccaagatggtgaaaccccacgtctactaaaaatacaaaaattagcatgatggcaggcagctataatcccagctactcaggaggctgaggcaggagaattgcttgaacccagggagcacaggttgcagtgagccgaaattgcgccactgcactccagcctgggtgacagagtgagactccatctcaa

SEQ ID NO: 222296 - DNA, 539 bp, Homo sapiens
gatgtcattcattccaagtcaagtcagatgcacaattccagatcctggctgagtcaagtgatgaccttagttgtgtgcatatagtatggtctcatactgaatcaaggcatcttgtctagtatttacaagcatcaggagaggaaggtagttatcttcaaagttacttaccagaagcacaatgatatgtaataggaaattatatacattcctcttaaagaaacattaccaagctggtgctagaactattacgcctttgctcatgcaacaaaggtttattgtgtgtacaatatatgccaggcactgtgctgggcactgggactacccttataagcagaacaaatatggtccccatactcaaggattagtaaaatttactacaaatcttatcttaaattaatcattgtcataaacaagcacaaatatatttacagttaaaccttacatctctgcattgcaattctctctctctaaaataaatagtttctgtctgtatttagtagttcataagagtagttataagacagtaacctctgaggaaa

SEQ ID NO: 222297 - DNA, 94 bp, Homo sapiens
cacccggacctagtaatcacttctttattatacattactaaagtatcagactatgatggactggaatttttttaaaaatttatcttttggctgg

SEQ ID NO: 222298 - DNA, 543 bp, Homo sapiens
agagggctcacacctgctggatatcctcacccacctgggcaggtaactcgccgggcctctctctcctgcctcagctcttcccctcgatccacacgggagatcacgtcggatttggacccaggcagccctgcccctggggaaagatacaagagttggctgtgggtgccagaatcacagggaggtctacagggaaggtgcacgcactgagcgcctaatgattggacgtacaaatggccaacgccaagacttatttgttgtgtgcttagcacactgcagagaggctgagccaacttatttgttgagtgcttaggacactgcagagaggctgagctctgacaaagctgtttaaggctccgcgtctgtgctgttcgagttaactgcactgtgacagtataagaaacatcgtcttctgtgtttcgaagacttactaaagaaaaaaacagtaaaatctctcaatcatttgttaattgattattatttcagtgtgtcaagatgataagattttagatagcttgaggtgaataaaatgtattattaaaatta

SEQ ID NO: 222299 - DNA, 674 bp, Homo sapiens
  misc_feature (626)..(626): n is a, c, g, or t
  misc_feature (632)..(632): n is a, c, g, or t
  misc_feature (653)..(653): n is a, c, g, or t
cctacttatttattcaaattcaggacacctcctaatttcacagataagaaaatgaaaacataggatgattagggaactttttcaaggtctcctagctagcaaatgcagagttgaactttgtgtccaggtccttaactcacacacttgcaaaccacaccgtaatgctattgccccatgtttctgcagatgagattgcaacagggtcttaagtaaggcatttttagcatacaacgagatatcaattaatttattaattagttaaaacagacaaagggattgtttagaaaaattgaaatgacgtagaatgaaaagtagggagacaagaacataaaggactttgaataacatgctaaggggtatcaattttattacagtagaggaaagtcattaaagttcctagagtaaaatcatgtgaatgtgaaagaaatgttttcagatcattctgacctggatgaacagagtaaactaggtgggaaccaacagcaggggtagggagtaacaggataatagtatattgtattagttccaacaagggtccatttcagtatctaaagtaaggggacagtagtgagaataaaattttggaaaatattcaagagacattatgaaagaaatagaaaaacttnaacacngtggggaatatcccttttgangaaattgtcaacattgctcga

SEQ ID NO: 222300 - DNA, 727 bp, Homo sapiens
taaggaggagacaggaagaagcctcacatccatctctgctaggaatttgggaatttggggttagagtttgtaagggtaatggagttgactgattggtgggagagtgctggtgaaatcgtggtacaaggagatgaagaaactacattctcatgctcatcccattcctctgtggggggtcttcaaactggttgaactcaactgtttcaccggaactcgtggtctgaaaaacatcttaagcgatccttaaacaaaagccttatgattctaatgtcagagatcctgtctacaggaacaacagggatgcaaatcaattcttagtctgatgtctgaaatcctatctataggaacaatagagatgcaaatgtcagtatctagtgccttgtgactattagcaacaaggaagtaggccgaagtgcagcctgattaatgcttaattataactatatttctgtccagaacctgcatgcaatttttgtgaaccctgttggggcggtttcatgtgtgtggtgataggataagcacatgaccctggttttccaggaagtcttcatttcaaacatgtatgaatcaaaccctgctaaacctgtatttcaacacatgaatcaagtcaatgcccataacagtataactatctgtaaatcacaaaagtatgagaactatcctgttggggcaactgctcttgagcagactaagttacttttcgcctgtggctacatatgcagtccgt

SEQ ID NO: 222301 - DNA, 441 bp, Homo sapiens
cttttctccctagtgggaagaaaatcgactataatgtagtgtttgccagattgtcataaatcccagattgtgtctgtaaaatgacttgctggatgatagttctaaaacttgacagtgatactccggaagtttacttaaaatttgaagttcacttaaaatgcataaagtgctttcagattttgtgccagagaacagtcattaccatattcatgaaatatctttttgtttttatttcacttccaagtgctgaatgttaattcgtgtcatgctttatgccttagtcacatataatagctttttaaaatatgatttcaatcggactccctcatgtgaactgtatacagagttcaaatatacttctggaaattcaaccacatttccattttttaataaccaccagtgagtgtattaaaggcagaagcttttagctgaaaaaaaaaa

SEQ ID NO: 222302 - DNA, 423 bp, Homo sapiens
gtggggcgtggtggctcacacctgtaatcccagcgctttgggaggccgaggcaggcggatcacctgaggtcaggagtttgagaccagccgggccaacatgatgaaacttcatctctattaaaaatacaaaaattagctgggcgtggtggcaggtgcctgtaatcccagctactccggaggctgaggcaggagaataatttgaacctgggaggtgttcactacaagagcataggcaaaacagaagcactgtcgaatcatgcattgtccaggtccctttgagagtctgttatacagcagtcctcctctttgccctttcgttttctgtggttacagttacctgcagcctgaaaatattaaatggaaaactccagaaataaacaattcatcagttttaaaccacatgccatcttgagtagcgtgata

SEQ ID NO: 222303 - DNA, 310 bp, Homo sapiens
caatatagcagttgccatttattaaaaaatgattaaaaatagcgaggtgtatggccaggcacggtggctaacacttgtaatcccagcactttgggaggctgagacgggcagatcatctgaagtcaggatttcaagaccagcctggccaaagtggcgaaaccctgtctctactaaaaatacaaaaattatctgggtgtggtggtccacacctataatcccagctactcgggaggctgaggcagcagaatcacttgaacctgggaggtggagtttgcagttggccgagatcacgccattgcactccagccta

SEQ ID NO: 222304 - DNA, 318 bp, Homo sapiens
acgtgtggcagaaaaactgggaggttgagggtgtcccattggtaggcccagagctgtggttccagctgggagaggtcaccccggcccttctgcccctgccagcatcccctcctctttctctctcccagtctttctgcctgggaaagcagcagacattcccagggctgtccagtgagtggtgttcagtgggcatcagctccaaggaatccaggggggtctctgcattggggtttctctattgtgccttcagaaacccgatggaggcaatgtatccacacatattctacttccactttaaaaacctacgcaaagccatgg

SEQ ID NO: 222305 - DNA, 707 bp, Homo sapiens
atagataggcacagatttaccaaagaagtatacaaatgttccaaacataaataaaatttatttaaatataaataaaatttataattagaaattaaaaatctgaaacatctaaaatcgtgtggtagatttaaaaatctatcacacaggaaccattttcaaatacttattttaaaatactagatcttccaattattaacgcaaaccaaacactaaaaaaaaaaaaaacccttacaatgcaaatttcaaagcataagaaaatataactccataattggaataagccttatttattttaattatggcatgatttaagtaaaaccaaatgaaacaagttccaataaaaactgtgatttcagctcatgagagtatcaaagacttgagaatatttgagggtaaatgtactttgtcttaagtaccagaacatttgttcccacatatactaataacaaatatacagttaaatgcctttaattctatttataactggtcattctggaagaacccaaagggaacgaaagggaaaatatccaaacttttaaaaaaaaaaaaaagcctctatgcctttcttcagcagactttaaatattttccagatcttcaagtcaagagtaaatgactgttggaatttacaatgagtcatctgttttaattttgccttgaaatgactacatcatttattttgaactgaaagatcctaacactatacca

SEQ ID NO: 222306 - DNA, 484 bp, Homo sapiens
aaattataaggacttaacatttatggcattggacagaataatacatattatggaagtgtaactactaacgaacaatttcctgagataattattgaactcgacagttggtttaacaccacagaggcccccttaaaagcatctaggtcagaatcacaaggcaagtcaatataaatgtgtttctttgacgtcactagtattacttacagtcagttgattgattaggtgcattgtttaggaaatgtgaaatatttgatgtattctgagacttaaagattgaaatgtgagctagcgattagttctttactatgactctgctcagactcagggtgtattttctatgaaatagtattttgtaaaacctactcaggatcgttttgtagtctattataagcgtgatgattgggtgttcatatgcatatgtgagatgtgccaccctcaaatcttgttatgacgtcatcagcacgttactcttctgatacgaaaa

SEQ ID NO: 222307 - DNA, 560 bp, Homo sapiens
cctgttattccctccacctgtgctggggatgtcagggaaaattctgtagatgcctctccgagtcttcttgagccttgattttcacattgatcgcgtcttccttgttttctgtgtttgtacctcatctccaccctggactacgagctccttgacttcaggagctaaggctgagtcctctcctcctcaaagcacagctcagcacaggctgggcccagagcacacttaagtgtgtttgcagaaggaactgaaatttgggagggcacaagtctcgccgggagtattttcctcttctgaatacccttttctgaactcatagcgtcctctccaggtcacacagtctagatttagccccaaatcccaaaactaccttccaataggactaccaaaatctgagcctaggagacttcacattgattttaaggtaaaagttgaaaatgtcaacttcatagtaaagtaaaagtagggtatattaatgtaatctcaattaaaggcatagtttgtttttttctaaaaggaaaaattattatgaaggagacattatcaggaaattttaaaaaata

SEQ ID NO: 222308 - DNA, 992 bp, Homo sapiens
gctgtctttcagtaaagactagtatagttggcacctttgtgcagcccaaggaggtctggaaggagggttgcataaccttcccatgggtggaaaaggaggaggaggcagagtctgaactagtgagatgacccaaactggttactgagacttggtcaggtaggtgtggagagctgacccgtggcagaggagtttgttccctttcacagggcagcgcaagtgtttctttcaatagctccacctcggtatctgtctccaggcaatggacagtcctaagcgggaggagctcaggccctgtcgtgctgaacccctgtcagtctcattagagatggcaccatgttcaagaggccaagaagagacccagagccagcacacgtgacatggggttttactgcaggggagagtccagtggtggcaggctggacaagataactgcatggcccagcagttaaagagccctaaggttcaggatctttcactggcaacatcccattccaatgccctgtagctaatgtgatattcctaattttgtatgatttttctaaagaggacccccaaaattgtataaggcttagaacccacaaaaacgatctatccatgggtcagggacacacacactctgagccttctgccttgtatggttgctagggtgctaaaactcacatttgattctcccttgggaataggcattgcctgtgtatgccccttctgtagctagacctgcattccctaagaggacacctaaccctttccgtgagggggaagcgaggcccagcgaggaactgctgtccaggcatcttcctgaccaccagatgccatcctcagggtagaaagggccccgtttgtgcaggaagggagggcaggcactcagacctccagcagcttgctttgtggtttctcagagggaggccctacagaggagaccgggtgggagggagccccgtgtgaggcttcacctggcttcagaatttccccagtggaaaattctcctgaaa

SEQ ID NO: 222309 - DNA, 422 bp, Homo sapiens
tattgcctcagtgttaccacaaatgaggtcagttccacattccagaaggaatcctgctctcgcggccaaacagatagaatgataaagagcattctttgcaaaatcagctgaggctctccctgcctaagacaaatctattctccaacagctgggagagagacaaatacatgcaacctttattgtttaccctgctaaaagggaggccccttgtgtggtcatgaggatggccatttaccaaaagggctgggatttagagttctggcttatctttacctaaatcagtagttgaagactaaaacaaattgtatccacaaatagcaatggaaaattcccaggaagattaagttaggcagataaacagctttgaaggaatacttacgaaattttattttatattgtagtggttgttctctaagctgagc

SEQ ID NO: 222310 - DNA, 1632 bp, Homo sapiens
tttaagaaggcatgcactagactgggtgagtttgctgtctgtacatcggcgccctccgatctggggtgcgcgccccagcttgggacaccgggcgctcattctaggacttcaggctggaggcacattaaggctgccccctcgctttgcagactggccccagagatgctaagtgacttgctaatggtgcccccgccagttaactgctcggacctgcatttttcattcgagaaaacggaaacccagaagattaagatctttgaatgctacctagcagaaggagaacttctgtttataactacagcttgggaattccctgcagggtttctccattctctgggtaagaaaaatagtcccaaaagcatcctgaggacagctcagagaaggtcctagtgaaagagtacctttcttgcttcttgtatcccttcaggaaaaagtgtttggaaagttctgtgccaagaagttcctccctatgtccttgctgtttaggtaattttctttgttctgttgatttgtcggggggcgggggggagaaaaaaacgaccactaatagtaaaagcagtaactgctagggctttagagcttccagcgccctctaggtacatcattctcttagtttccaccctagaacaggggctggcacatagtaggtactcagtaaaccgaatgaacgaatggatggatgaatgaatgaattagtgaatatataaataaactgtaggaggaaagaattacccccattcattttatggacaggggaaacaaaggctaagagactagaattcaaactctggcctgattccattgacattaatattttagacactggaagacaaagggctcggcaattttagtgagagtttggactgcatctgccttggacccagccaaggacgttaaacatgacaggcagacccattaagaaaacctaccctctaaagtgaccataaataaggtgccgccatttcgtggtggtggagtccacagatcttttctaagaggaacagtgagaagaggaagtggaccatggcgatggggaggggcagagatcttggaagtcaccatggttttcagttgaaaggatttgcctagcttccccaaggagcacaacaaataacttctaggtttcttttacatatttttaggcttttgataatctttattgtggaggccatgcctaaactaagaaaatgcaatactctccatggacctaatgaaatgagataatgcacaagagagagcctcccacaatgcctggtacatagtaagtgttctgtagtgtttaataagcgctataattattaatattatttacctagtttttctaccagccctctcaataactaaaatatgagaataattgttatgcctaaatgtatgagttaagacactcttgctccctcccttttcccccttttaaaaactcatataaggcactaaaggcctgaaatgttagtgttgagttgtactagaaaagtgccttagaagtttagcaagggacagggctatttttgcctctagtttcttgtttactacatcacagagaaacactaaatttaaaatccattacagatagattctgatttactcacttggaaaaccaatttaaaaaccaataaaaaacagtacagatag

SEQ ID NO: 222311 - DNA, 668 bp, Homo sapiens
tttaagaaggcatgcactagactgggtgagtttgctgtctgtacatcggcgccctccgatctggggtgcgcgccccagcttgggacaccgggcgctcattctaggacttcaggctggaggcacattaaggctgccccctcgctttgcagactggccccagagatgctaagtgacttgctaatggtgcccccgccagttaactgctcggacctgcatttttcattcgagaaaacggaaacccagaagattaagatctttgaatgctacctagcagaaggagaacttctgtttataactacagcttgggaattccctgcagggtttctccattctctgggtaagaaaaatagtcccaaaagcatcctgaggacagctcagagaaggtcctagtgaaagagtacctttcttgcttcttgtatcccttcaggaaaaagtgtttggaaagttctgtgccaagaagttcctccctatgtccttgctgtttaggtttccccttggtcctgccgattcgccgccgcccgtctcgctagatctctctccccctcttcgccttccgcctctccgccccccctcccgaccttctaccgctctctccccccctcattctcttcgctcccccctctacccttcctctctacctccccccgcctccctccctctctcccccc

SEQ ID NO: 222312 - DNA, 473 bp, Homo sapiens
ctgatgtttttactcaccatcttgccacccaacagcattcacttgggagcttattagaattgcagaatcctcagccccaccctgacctactacattagaatctgcattttaccaagaggtccaagtggtttacattcacgtggaagtttgcaaagcactggtctacaacggtggtccatggagcaaagcttgagtagtaaagctgtagcacagtagttctcaaacttgattgctcattagaatcatacagggagctctgtaagcttctcatctccagccttcaccgtcagagattctatttgttagagtggcacctggacatggatagctttaaaagcttccccggtgattctgatgcgcagcctaggttctcaacaccttgctactcccaggtgtgggcctcagactaacagacatcacctggacctggttagaaatgtgtctctcagataccaccctggacctgctcgagc

SEQ ID NO: 222313 - DNA, 446 bp, Homo sapiens
ggaccttaacaaaacattcactttttttcaatcaaagagctgcccaggattagtactagaaaccaagcagatcagctagttattactagctgtcttgggagagacttcctttccatatgaaagagaaggagcttagaagcagtccacctgggtctgagtcctgggcctgtctctctacctggctatgctgagacttacttaacctcttgctctctgttgatttaaaccataaaaagaaagcactatttcccaagaattgtgttaggattgtgagggcactcaggaaagttccaggaacacagcctgacatatagtgagtgcttaaaaattaattaaatctgtctttaagagcagtcgagagggaagcagttatcataagtctgtccaaatttggggaatagagaaggtggtaaccagattcttcagaacgaaacttaatgtaacat

SEQ ID NO: 222314 - DNA, 373 bp, Homo sapiens
gtcaacgataagtactcagcaaaaaaatttaacacatgaaaatagcaccttattagcatagctgataatgctttaaatttcactcagtgagtatttgccctggaaagaatatgaacttagaggcataacgtgaagtttcctgaactggtctcagttcctgcctccctatatttgattttcactttatgtattaactttagaatctcatccttggataagaaaaaaatgccactgcagatttcaaaaaagaatagctagagattttgactcaaccatattagcatttccaccacaacactaaattaatacaatacacataaacaggatcaatgttcttgcttttagcaataagtaaacaggtacctgaaagata

SEQ ID NO: 222315 - DNA, 293 bp, Homo sapiens
cccaagcccaactctgcagttccctgttctgtacctcagtttccctctgtgggactggggtgaggaggcaggggagacaggccaactggcacccagaggaacagctgtgtcctgctgctccctcagcaaagctctgacccaaacggtgcccctggggcacaagagggtgagtgctgggcagcaggaacagggtagggctagaggaacctggtcactggctgggtaacaggctctggggcgccccacaaaatgtctctaagctgctgcactgggcttccacacaagcacggtcc

SEQ ID NO: 222316 - DNA, 348 bp, Homo sapiens
atagtctggctctggaacccctgatcttaagcacatactctatatgtacaagcatagaaaaatgaattgcaatttttgaatgtagtacaaagctgctgagattggtattggatgcaaatgccaggaagctagcataagacttcagaggacaaaacaaaaaaagaaaagtttccaatcatcagtcaaatatgagaatgaataagaaacaaagagacagacaaaaaccagactgaagtgtgaaggatatgtttcatgtgaatcatttcaaattatgtctggggcagaaatttcctgcattccaaagggaaagcattagagaaatcatcgtgcactgtaagtctttaagtg

SEQ ID NO: 222317 - DNA, 374 bp, Homo sapiens
gctccatagaagagtgggcttcgtgcctggcttgttcagggatcctttttctgcaattctcttagcttcgccctccttctcatttcaatactgtctttatattggttttcctcatggtggcaaaatgattgcagcagtttctggcatcataccctcccctcccatctggcttaaagggcacattccgttcaggcttggaaatgatctgctggaggtttacactgtgttcagggttgtccccgtggctccccatgccctggccttcgaagttaaagcagctgagaggcttgctttctattccttctccctcctagggggagaggttgccttgttgattactccagtgaggatgattaacagcttaaaaaaaaaaa

SEQ ID NO: 222318 - DNA, 477 bp, Homo sapiens
ctctgctgtggaagtcttgcatgtgggtttttttctggggggaggggaacagcatggactaccatggaaataccagaggtagcttttagtcattctatttagaggcaggttgagcaagttcaccttctcttcccagtccctcatgtttgttcaggcttgaaagaggtcagacccaggtgtttgaaaaaatggcaggtcctgacctatggaaaagagaaactaggtctgcagcccctggaatgctctgcaccaccaacatccctcactctgcatttggttcacacactggggagaagggcagaacagccacctcagaccctcctacccatgggaggatgcatcccaggtggcaggtgctggcactgttggttgtggcctgggtatcatcacaccgtcacacacagctcaccagaactccagaactcccaggcacaggtcactgtttgctggcttccccttgcctgagtactggaggga

SEQ ID NO: 222319 - DNA, 626 bp, Homo sapiens
cagagaactttcagaaaggcaccatcggtcttgagctggaagcccgccttttaggttttgaagagagaagaggtggaggaggatgtgtgctccatgaagacgtgttcacagactctaacttgctatggagtggccagagggctcgacgaagatgccaactgccttcagatgtctccagctcctatcacggctgtgtgaagctataggctgtggtaaagaccaaccaggggagaacaagcaaaggccatttattcagaggctgctgtatcaggggagtcagccacccatacatgtcttatggaaagctgcttctgccccaaccctgttttagctagtcttcagtttaatctgatatccggtaccacctcctaccccatttctacccatcttaggttcattggctgggacgcctgtgacaaaagacagattaacaagagaaaggtacacaaatttatttaatatgtgttatgtgacacaggagccttcaaaaggaaatgaagttctgaagaaacagctaaacctgaatggtttttgtcgtagatttgagaagaatgaagcattgtgggaaaatatgacaaagtaaagaaaaagaatgagagaaatgtaataaatcggggaatcttaga

SEQ ID NO: 222320 - DNA, 670 bp, Homo sapiens
  misc_feature (323)..(323): n is a, c, g, or t
  misc_feature (330)..(330): n is a, c, g, or t
  misc_feature (338)..(338): n is a, c, g, or t
  misc_feature (340)..(340): n is a, c, g, or t
  misc_feature (346)..(346): n is a, c, g, or t
  misc_feature (359)..(359): n is a, c, g, or t
cagagaactttcagaaaggcaccatcggtcttgagctggaagcccgccttttaggttttgaagagagaagaggtggaggaggatgtgtgctccatgaagacgtgttcacagactctaacttgctatggagtggccagagggctcgacgaagatgccaactgccttcagatgtctccagctcctatcacggctgtgtgaagctataggctgtggtaaagaccaaccaggggagaacaagcaaaggccatttattcagaggctgctgtatcaggggagtcagccacccatacatgtcttttttggggggggaaaaaaaaaagggncttgggnctttttcntngccccncccccccccaacnaacccccctgttttagctagtcttcagtttaatctgatatccggtaccacctcctaccccatttctacccatcttaggttcattggctgggacgcctgtgacaaaagacagattaacaagagaaaggtacacaaatttatttaatatgtgttatgtgacacaggagccttcaaaaggaaatgaagttctgaagaaacagctaaacctgaatggtttttgtcgtagatttgagaagaatgaagcattgtgggaaaatatgacaaagtaaagaaaaagaatgagagaaatgtaataaatcggggaatcttaga

SEQ ID NO: 222321 - DNA, 426 bp, Homo sapiens
gaaggcttttgatatcatattaaatacatttgccttaatcacaaagttgtagaggaacactgtaaagattttaagcagagaaattaatattttagaggatagctggtggtaatggatcagatctagcactcaggtgaatttagttttgcttggagtgtttgtagttgtcagtgtctcacaggagacacggatataagggttggttcaaaaatcggtaggtctgcattgctgcgaggagtctatcagctggggcctcttaagtagctggcccatttggaagaagtatgtgcctcatttccctgtggagctcacttcctttagtgcaaatgcctgggacctgtaggaagtcaacctggtgagaaattaggcttcattttaagtagtggtggtgggaacaaagagaaggagagggattgaaagatactg

SEQ ID NO: 222322 - DNA, 333 bp, Homo sapiens
tttattttcattcttaaatttttattgatataggtctttaaagttaggaatttttctctggttactactttaaatatatcccattgttttatcattatttttcagaaattctctatttttgatttgtatttcaccctttcattaaatagttgtttaacagaaagctttttagcttacagaaaaaaaaagattaaaaaaattttgtttagaaatttctagctttattgcattgtgttcagaaagtgtttatatttttgctttatgaaacttatttttaaaattttatgaatttgactgttgtgtgacctaataaatgatcagtttttttggaca

SEQ ID NO: 222323 - DNA, 459 bp, Homo sapiens
ggatctaggcagctgggccctgctcagattgtggcactgccagctctctggggcagctctgcagtttggagctgcttctgaagccatctgcacccacctgcctgctccccttgaagtcaccatatacctgtaaacatgtagatgccacaagttgcaggggcagctagttcagctgctcactggctggtgaacctcttctctattgaaatgtccataaccaatagctgtggagcctctttttgaggccacgtggtgatggggtactcactgcctctgtggacaggtgcccctggaggcaagggctgcctagttcctacagtccccactaagggcccagcacctaggagctgaccttgggcagggacaaccctgggaatgtctgctaaacaaaggagtagatgaacaggccagttgttggtcttagaatattttcattaagaattatttcccggccaggcg

SEQ ID NO: 222324 - DNA, 916 bp, Homo sapiens
aaaatacaaaacgttagccaggcgtggtggtgcacgcatgtaatcccaactactcgggaggctgaggcacgagaatcgcttgaacctgggaggcggaggttgcagtgagccgagattgcaccactgcactccagcctgggtgacagagtgagacactgactcacagaaaaaaaaaaaaatctcactctgacatcccaccagaggtcttgccagcctacaggtccatttcccttcttggtcttacgtctcagggtctaagagacaggtaaataaatcattaaaaaatgatgtatctgatagttcaggggccacagtaagataatttttcaggctgagcatggtggctcatgcctgtaatccagcattttggaaggccaagatgaggatcacttgaggccaggagtttgagaccagcctgggcaacatggcaagacccccatctctatgaaaaatagagataaaaagaagaaataaaaaagtgtgtccctttcccactgagcaaaagcatcctcctgaggaccccaggtgtgttttgagtgtcaattctggccgggtgctgtggtgtggccatgatcgacaacacagtccttgtccacaaggaagttaaaatcttaaggaaagcgagactgttgtggtccagctgaacatgcctgtgcattgagacctaaagctcatagagatgctcactctaggggaccatcacagtttggcccctgccaccctccaacatcaccaaaaccactgttgttgcaattggggaacactctgacaactgttggacagataccacatgccaagacccagaagagacaaatgcatgtttttagctatgttgtgtattctcaaagagcttacaacctgatcaggagacgagaagtattccaagtagtaaatggtcattggaaatacaaagcaa

SEQ ID NO: 222325 - DNA, 1351 bp, Homo sapiens
ttgtggcatccttatatggataatgcccaatgatgcctgcaccctgtaacagtttaggaaggcctgaagtcgcacactgggtcctggctgctgtaactggagacccccagaagatcccctgcaagcagccaccagcctgctgtcaagccaataataaaagctcagcacaaacagagatgaagaaactcacattgagaagagttaagaaacttgctcaaattcataaaatcaagaggagaggtggatgtaattaaaaccaagcctttgacaaatcaaggaaacttttcatgtcgtcactgctacctcatccgtggccacaaaatctcagtcaagatctagggttgatgcaaactggagtcattcccagtatccacaacacttctcttgtgtcttctgggaagctaagatttcatcccttgagtttcattgctgcctgaatctattgcatcttacttgagagcctcatttattccatgctacaagatccatgcaagattccaggatcaccaagatcactccaggaaatgaagagatcaagagagctgccatggacaagtctctgcctctctgcttcagcttctagttccctcataatataggacaattccttgtacaaaacgggtgctccataaatatttgttgaatgaacttcttttctagatggtgacgtgatggcaaccttaaaacctcatgccattcttcctcatcattctctgggttaaagaaaggcctaaacttttccagcaattgacagagccttggtgtgtcatattgcctcattgtgcctcagttgtcccatcactcccacttgggagaggatatgaatgaatggatcttagttttaaagagctgaaggtggaattcagttgcctgattgctagcatagatagtacctctatgtatgtgccatttctttttttttttttttgattgtttagttcatttatttgtgtaaccaattttgattaaaagctgaacactgtgctggaagctgaggcttcactggtgtagggatgccatttctgccccctaagaatcacaagggctagagcattgcaggaggtccttacagcaacaattaccatgaactaagcctttgcttagtgcaggcactgtgttaagagggaagttagtaatgttcttcccattttagaattttgtaactataaaaatataatgcaggcttaagaaagagcagtttaaaatgacataaataaacctttgttttagggaaagtttgcatatgtttgtgcttctgtgttatactaagaatcctgagcaattcccacttcagtataaaattctagtggtgtgagggcaaaaggtgaaaaagagttttaaaaaggtaaaa

SEQ ID NO: 222326 - DNA, 466 bp, Homo sapiens
ctcccatttcttcctgagtttgtcctacatggaaatcgctcaccattaacctcacttttaaaactataccttttcttctgggcttatacaataaatctcacaagactttcatcagctattccaaacctccctcatccccactttgtcctcaactgtaaagccctggagaccatgacatgcaatttggaactgtgacatactctctcaatcgattcaccaaatcagctgtgtctcctaaaccagtgggtaggctctctgagttcaggcactgggcttctggtataccccctgggcccaggtatacccccttgaccacactgggtagggagcagacactcattcacaggtaccgactactcagacggaacaaagataaggtgaggaacttggaccaggctggctgacagtctaaaaagatccttcccattcatgcagaagcaaccctctcccaatataattttttcac

SEQ ID NO: 222327 - DNA, 488 bp, Homo sapiens
atcagtgaaccttctctactctgatgagacgcaggtccaagaaagtaattattgtttgcatctatgagttagcaaccatcagattgcatccctgaaaagcatgctaaccaggaaggcaaaaccttactaaaaacctttataaggacagtaatacatgaacaaagcaatacaagagcactgtacatctgcatacattaggaagtgaaatacgtaaactgcataaaacaaattcaattcatgttgaggcataacagaagcaacctggttgtatcaggatgtctgttccagctcataaagttcttaccagagacaactacgaaatctgtcagtgcctataagggtcatagcaaagaacagaatttgggaaagagagagtattccaaagtactgtgaattcctctcctgtaccacaagtcacttcccccaccactacacattaaacaactacctacattttctactaactaaatccttgccctaagttttcc

SEQ ID NO: 222328 - DNA, 576 bp, Homo sapiens
catatgtaactaacctgcacattgtgcacatgtaccctaaaacttaaagtataataataataaaattaaaaaataaaaaataaaaaaataaaataaaataaaaaagaatctactttagacattatgttaagcaaagtaagccagattcagaaagataaatactgcattatctcacttatatgtggaatctgaaagttgaactcatagaagtagagagtagaatagttgttacctagggctggagtggaggcggggtgtggctggggagatggaggagatggtggtcaaaagatacaaagtttcagttagacagaaggaagagatatctatttaagagatctaatgcacaacatggggactgtagttaataacaacatattgtattcctgagaatcactaagagaatagattttaagtgttcttaccacaaaaataagtatgtgaggtgatgcatatgttaattagctcaatatagccattccacagtatatacatatttcaaaacattgtattatacatgataaatataatttttgtcatttaaataaataaatacattttaacatgaaaaaaaaa

SEQ ID NO: 222329 - DNA, 468 bp, Homo sapiens
tcccttcctagacctaagggccacctctgaaaaagtgtccaggagagatctcagctgctcatagcaactggcacccttgttctgataaggcaggcagggtaaccacggttctggcacgtgatctggagatgacatggcatctcctgctcagaaccaggctggtggccctcttgctcacaaagtccacgcccccaaatgccctgtgcctggagaactgggactcatgccttccgctgagactagacacagtgaaatgtcttcagaagacaccattcactgacgatttgttgttactttttagatcagtctattttacaatagaacagaggaaggggagggggaatagttgaggttcctggaagaaataattgtggatattgacagggcaccattgtgaataagagagcggggactgtcacagtccccattccttccagagagccttttgattgcaaagtctggaaaaga

SEQ ID NO: 222330 - DNA, 300 bp, Homo sapiens
aagtaatgagaagtttccttttagaaggaaaaaataaacccactagtatgtctttgagtattcactccacaaagacctatctatagagaaataaaaactatcagaaaatgggttgaatttgctcctatttggttttgttttagtgaaacctatacgttagggaaagttgatttgcagtattgcaatcttaaatttcacatcaaggaacccaatataagaaatagtttctggtaactgagaacagtgtcagtgggattcatccaaaaatgtttgtccctgatgtacttattttccatctgg

SEQ ID NO: 222331 - DNA, 426 bp, Homo sapiens
aaaggccatattggatcctgaatccagaagggtgcaaggttgctataaaggacatttttggaaaatctgacaattcgaatatgcaccatatattcgacaatagaattctatcaaagttttgtttcctaaaattgaaaatcaagactggtcacggtggctcacacctgcaatcccagtgctttgggaggccgagatgggtggatcatctgaggtcaggagatcgagactatcctggctaacatggtgaaacctcgtctctactaaaaatacaaaaaattagccgggcgtggtggcgggtgcctgtagacccagctattcaggaggctggggcaggagaatggcatgaacctgggaggtggagcttgcagtgagctgagatcacgccactgtactccagcctgggcgacagaacgagactctgtccca

SEQ ID NO: 222332 - DNA, 429 bp, Homo sapiens
atcctctaataagcactttttatgtttaaaactttgctaaatgagggctgggcccacatgagagaacagatccatacacactttgaaaaactttgttcacttttaggaaatataattttgaaaaatcatttacatacaagaggtccactgaggcattgcttttaatggcaaaatattgcaatgtacttgaatgtccttcacattagattggtaagataaattttagtatgtgcatgtactggaatattatatagccagtaaacaaattgacaatgaagctctatttgtaccagtaaagaatggtcttgaagagacattgtaaaatgaaaaaaaaaaaaccaagttgtaaagcaatgtagattatcttatcagcatggaaaaaatgcaattattatatggaagcatgcaaatatatctctggaaagatta

SEQ ID NO: 222333 - DNA, 481 bp, Homo sapiens
ggactcaataggttgcaagtgacggtgaccaattcaaaccagttaaggaaggaaggggctcaaaatagcagtcctgaaagggccctggggcagctggacatgggtaggcatccttccttggcctctgtgtgcaagcttcaccctcaaccagctgcttctgtgaacttgagatccaagcttcggagcctcacttctcattgattcaccctagaaaagaggtgatgatcactctccttctggttccaagtttaaaatcccagggatgggatctggttgactcaaccaggtagggacccacccacacagctagagtggggtcaggagcactgcccgaaagaagggaagcagttatcacaagagggagtacagagggcctcccattgccttgggatgaagtccttgcctgctcccaacagtctccacattacctcgttcctgcccgtctaccttctgggtcaggcttcagctaagacgccattcc

SEQ ID NO: 222334 - DNA, 142 bp, Homo sapiens
catttaaaaatttgtatagcaatttgatagaatgactgctgaatttaataataaatatgtgactatatccatatgcctttctcttattaatttccttttgccagcaatagattttcattgattatataatacagttgataca

SEQ ID NO: 222335 - DNA, 381 bp, Homo sapiens
ttttccgtagccataaaagagatacatctcattgctggaacttgtctctattaaaaacaaaacaaaacaaaaaccttataacaaacagcatggctggatgcagtggttcacacctataatcccagtactttgggaggccgaggcgggtggatcacctgaggtcaggagttcaagaccagcctggccaacatggtgaaaccctgtctctactttttagacaaatacaaaaaattttagccggtcgtggtggtgcatgcctgtaatcccaactacttgggaggctgaggcaggagaattgcttgaacccggtaggtggaggttacagtgagccaagatcgtgccactgcactccagcctgggcgacagagccacactccatct

SEQ ID NO: 222336 - DNA, 435 bp, Homo sapiens
ggcttataatacaaggttaggtctcttggaagcctaagaagattatccaaaaaggctgttttcagttgggttagagtgtaaatagcatacaagtgcttcatgaaccccagttcaaattcaaaggtattcttagaaggttttcattaaataaaggcaggaaaataaattaagaccaagaaaatgatttcaacagaggggtgaagggggagctcctattcttccttcttactgaagtgcttcatccaaacagcctcctttacttccatggtcccttaaaaccactttgctaggagtcgacttatgtggagcaaaggcaatactaatggagggtgtggctcctctgtggccactaagtggaaaatataaccctcttgccagctacctcatgtggcaagtgtgtgtgtgtgagtaaatctgtgtctctattgggggggg

SEQ ID NO: 222337 - DNA, 220 bp, Homo sapiens
gtagtgacagggtctgcctatgttgccagactggtctcaagctcctgggctcaagcaatcctctctccttgccctcccatgctcactcttttaagaccgtagaatcattaatatctcatgggactagatcagggaaactcactgtgggaaatgcttacttaaattctgccctagttatctaatgtacttattaatagtaaatcccttctgtcgtcttctc

SEQ ID NO: 222338 - DNA, 428 bp, Homo sapiens
aagaaggctggagtggctctattaatatcaaagtagatatcaagaggacataaccactcatgtggagataaaaacttcatgcagtcatccttgggattatattgttgctgctgggggcagctgaggaaaaaagggaattgtattggtttgctagggctgctataacaaaataccacagactagatgggttaaataaagagatgtgtctcacagttctggaggctggacgtccaaggtcaagatgtgggaaggctggcttgctcggaagcctctccttggcttgcagatgtctgccctcttcctgccgcttcacgtggtctttcctctgttcctgcacacccctgggtttctcctctgggtgtccacattttctctgggtgtccacatttctcctcttatgatgccagtcagattgggtgacagtccac

SEQ ID NO: 222339 - DNA, 292 bp, Homo sapiens
ccttcagtaaaaggaagacagggagaaaggaaagaaggaagagcaggccacaaaccagaaaacaaataacaagatgacagtaataaattcttatcaataataacattgaatgtaactggactaaactctccaatcagaagacatagagtggctgaactgatttaaaaaaaaaaaaagaaaaaaaacccaagacctagaatatgtcacctacaagaaacacattttacctataaaaacatacatagactggctataaagtgatggaaaaagatataccatgccagtgaaaacc

SEQ ID NO: 222340 - DNA, 439 bp, Homo sapiens
taaagtaaatttgagacattatgtcatttcataactccatatgcatttaaaaagtaaggacattttcttatacaactatatgccatcatcatctctaacaaaatcattaacaaattattgataccatctaacagccagtctatgttcaaatttccctggtaaatttggcttcttaaccttatcatcacataaaaaggggttcttcctgttttttaaaaaagctataaagtatttttttaatctcaccagaggctttgatggcagaatttttttttctacctgttaatttggcaagagagtttcctttatgcaggagcacagattattaatcttgggtctgaattctagctgtgtttctgcttctaatttacgtatccttaggggactcattcaaccctcctcagcttcccacctgcatcctccttcggcctaataactg

SEQ ID NO: 222341 - DNA, 381 bp, Homo sapiens
aacaggatacctgaagttcagaatggaggggctgcatctggtgagaacctccttgcaacatcatctgatgacagaaggacacacttaagagctcaattcacgcttataataagccaactctcttgataactaacccactcctacagtaacgacattaacccatttatgagggcagaacccttaagacctaatcatctcttgataggccccacctcccatcttcgttgctttagggattaggtttctaatacatgaacttcaggaacacgttcctacccataacagttaaatgatatttttgttgttctttttgattttgttgctcttgtctaaattattattataataaaatctgggttgatttatagtcccatagttaat

SEQ ID NO: 222342 - DNA, 810 bp, Homo sapiens
  misc_feature (806)..(806): n is a, c, g, or t
tgtgatctcttagcagaatagatttattatttgattgcttgcagaatattaaaacacagactacagaaccttgccccacaatcaaaatttctgattctctatgtctagaatggggaccaagaatttgcatttctagtaaattgtcaggtgatgctgatgttactgatttggagaccattactttgaagagcagtgctttaaccttttttagaccgtggacctatttttttttttttttgagacggagtctcgctttgctgccctggctcttggctcactgcaagctctgcctcctgggttcacaccattctcctgcctcagcctcctgagtagctgggactacaggcacccaccaccacacccggctaattttttgttcttgttttttagtggagatggggtttcaccatgttagccaggatggtctccatctcctgacctcgtgatctgcccgcttcggcctcccggagtgctgggattacaggcgtgagccaccgcacctggccaaccgtggacctctttgaggatatgatgacagctacataccttcccctcaaaaaagatagtactcacaattctacctgtaatttcagagagttaatggaacccttgatgcctaaagacctcagaagaaaatgtagtgttaggtaggaaggaaatgagacattcatagatgagcacaatttgataaccgataataagtattcagtagttgataagcaatagaaaacattttctaaaattctgttttagtttttgtttttaatttttagaacctaaaaggagcccttaccagattcttttangttt

SEQ ID NO: 222343 - DNA, 715 bp, Homo sapiens
  misc_feature (39)..(39): n is a, c, g, or t
tcgaatcgagctctgtacccagcagcatagatattaccngaaagagaaatggcagatgagctccagcatagctaatgtatttttagtactgggaaaatatacaagaaattttattcacagagtccaaattatatttaatggattatggaaactcaacaattaaaaccaaataaaaatttctcacttagatcattagaaagttatccttgaaaatgttagttaaatgggctgccctgggcaaacagggcacaaaatccaaggcattatgatagaaagcattgtgacctttagctttaaatttagttattttcaaatttatttaacaagtatttactagtaataatatgcattatacgaagaataaatgcatttgttgagcatttctatgtgaaaagtaccatgccagatcctagaggctggaagagtgagaacacaaagttgaatcagacattagcattaccttcaaaaaagaacataacgaagagggagatacataggaaggcctggacaaaaaagagggacaagaggaacgatgctgagtggggtcaggttccaaataggccacagtgttgaggctggctactgttcctaacactgctccagggacagatcagggagtcttcccaggtctggttggcatattctaagggacactctgacctttacaaacacatgctgctgttttgctgtttgctcctcacacattctcatgtta

SEQ ID NO: 222344 - DNA, 367 bp, Homo sapiens
ccctctggacactccttccctcccaggtacttagctcatctttaaacaccttatctttccccacccaccttataaccacctagaccctgtatagacctgggtgtaactccagccagcctggtcactgacctgtgaggtggccttggacctgttactcctcctctcagcaaggtagtgcagtataaattggtggggaaaagctagaaatattttcattaaaaaaatcctcctggctgtggctcacgcctgtaatcctagcactttgggagctctttgggtgggtcacttgaggctaggagttcgagaccagcctgggccaacatggcaaaaccccatctttactaaaaaaatgcaaaaattagctggg

SEQ ID NO: 222345 - DNA, 295 bp, Homo sapiens
gaatgaatattgatttaatacaagtgtatagcaaaacttttgtgagaaaaggtgtaagagagctgaccctcattgcccatcatgagaaattaatcactaataccacaagtcgttgcatctcaagattgctgtaaaaacatagaattcagagccccagagttagtgctgaggggatggaaaggagcttctcgaaggagtcggctggagtattggaagggtggatggggcaccgctgtgttttgttgtatctttttgcacttaatgactattgattaaaatagttctttgattaaaa

SEQ ID NO: 222346 - DNA, 611 bp, Homo sapiens
atgaggctaggtacgaggcatgggtgttgctcagataccatcctctcagcactagggcctttgttacccagagaagaagaagtaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgctgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactgggaagcaccacctgtattggtggcgctccctcatagagcgcattgattccctggcacgccttgaggtgatgtcagtgaaatccccgcaggctcctctgtgggtgtctcatggcaccatc

SEQ ID NO: 222347 - DNA, 822 bp, Homo sapiens
atgaggctaggtacgaggcatgggtgttgctcagataccatcctctcagcactagggcctttgttacccagagaagaagaagtaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgctgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactgggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgagctgctgccgtacaaaccacaggtgattcgggccttagccaaacccctggatgacaagaagagactggtgcgcaaggaagcagtgtcagccagaggggagtggaaccagtgggagccatgaagatgagcctcagcctgcctagatgtccggaatctacctggataaatgtggcatttcccaagaggaccg

SEQ ID NO: 222348 - DNA, 410 bp, Homo sapiens
aatgggccaaatggagagtagatgccatctaatcagctccagctgatggctgccatatgaaaataaagatctagtgttgccagaattttgggcaagagttgtcagaaatccacactttatgtggattttcccatttaaaaaaattgaatcagttcaaattttaactcagagcatgcgggccaactcagagttaaagcatatccgagtttgagacttggattgagatgctcaaccaaagctcctcaattagacagccaggctatattctttccactgttctgaagtccagtgctatgctgggtataggtgacataaagatgaataagtgttcaaactatccccagagaactaggataaacttgaactcaagcaaactggtgtgtgataaatgctttaaaaggaatgtggaa

SEQ ID NO: 222349 - DNA, 408 bp, Homo sapiens
gacaagggcctaatcttttgcccaggctgtagtgcagcagtgaaattatagcttactgtaaccttgaagtcttgggctgaattaatcctgctgcctcagcatcccaagtagctaggactacaggtgcgcgtaaccatgatgggctagttgttattgttgttgttattattattattattgtaaagacagggtctctctgtgttgcccaggctggtcttgaacttctagtctcaagtgatccccttgccttggctttctaaaatgctggaattgtaggtatgagccaccatgcccagcctgtgaatattattgatttatttttgctttcattttactcttctccattttatatacattaaaatatctttactgactttgatatattatttagaaatatatttaaatgta

SEQ ID NO: 222350 - DNA, 540 bp, Homo sapiens
aaagttttaaatctcatccctgcctgagaggttagcttcctacatataagctccttttgtattggacttgtaattgctcattcagtgttagtattgccctgtagagtgtaagctccttgagggccaagaatgcttctgcctcttccattgttgcttccccagtaccttctgtatatttcataaccaaataatgaaaaagatacattccatttaaagggcattgactttgggttaaatgattgttatattgttttaggattatctatgatacactttgacatctcacacacacacatgaacttttctttttacaatgcaaaagtttaaacaatagcttaaatttagactgcaagaatattataatctcaatatggtatttggtactagagatagatttcttttataaaatcttaaaaacaggacgttctcttccttttgaacctttatcccagaggtgaaaatatccaatatgttgttttctgcatatattgaagtagtagtttcactttaataaagatggattaaaagttaaaagcattc

SEQ ID NO: 222351 - DNA, 230 bp, Homo sapiens
gctggagtgcagcggtatgaacaagctcactgcagccttgaactcctgggcacaagcaatcctccagcctccctcagcctccggaggaactgggactacaggtgtgcaccaccacaccctaaagccaagttttaaaccactaacttgtccctttcacttcttcccgagatgacccctccagtttcagccacgtttaaccaaagccatagctctcatactgtgcatcagca

SEQ ID NO: 222352 - DNA, 765 bp, Homo sapiens
agtttttgacagcgtttaatgtaatcatgattcaataacactttcttcccgagcaccgtgaccccatttgtcaatgtgcttcgcttttcatttcctctagttcagaagtgctgtgcttgtatttcaaactaaaatgtgcttgccttatattgctgtctttgtcaaaaatacaaatatctgccctgaggccatttctacttcaaagatgcaatatggtgcttggtacaatttgggaaatttcttttttttttctttctttgtttaaaatttacaaatccattcaacaacacatataatgatctgatttccttttttttttttttaagaccatgagagaatgatgcagagattttaatcattagctcattcttttggtttaaaaccataattggtctagagaatttatatttcataaattgttcaatcctatattaaaattcaagatgcttttatttatcatcttgaattgtacgaattaaacccatgcctttttctcttgttttctcctcttgatccatgtaagcaaccccagcccctgaccttcctgaagtctggtcttgtctcctgggcctccagcctcactcctgccctcacacaggcacacatacaattcagggattatgacatattatgcacgaaaacctttttgaggaaagataccaatgtgaagttgtgaatatggactcctgttagaggaggagggcttcctcattaatccgggtgtgctcgcttttctatcgtgtggaggacttccccaaatagttc

SEQ ID NO: 222353 - DNA, 504 bp, Homo sapiens
gtcttggcctgggggcacacgctgctgccctcttgagtcagaacaagggcgttgagtgtctgctcccactcccatgcacacccgcaccctgacagcacaagttccactccatctctgctggttcactcagcctgccctcattccgtgttcctgactcttctccagccacgagacacctgccccatcaccctcagtctgtctgctcatttgctcaggcctagcacacaagttccagtagtattaacagataccacggagcaaagcagggccactaactagaggtccacatgtgttcatagttcttttctaggtagaatttacgtatagtgggaggcataaatctaacagtctgtgagttctaacaaatgaatcaccaggcgcagtggcttgcacctgtaatcacagcacgttgggaggctgagacaggaggatagctgagcctgcgagttcaagaccagctcgggcaacatagtgagacgtctgtctctacagttaaaaaaaaaa

SEQ ID NO: 222354 - DNA, 522 bp, Homo sapiens
cgggtggatcacgaggtcaggagatccagaccatccttgctaacacggtaaaaccccgtctctactaaaaatacaaaatttagccgggcatggtggcacgcgcctgtaatcccagctactaaggaggctgaggcaggagaatcgcttgaacctgggtgacagagcgagactccatctcagggaaaaaaaaaaaaaagaaatgcaatttcttggttctcacgccagacctaggaattgataactctggaggtgtggcccagcaatctatgttttaacaaacacaggtaattcttatttactctggagctcaagagaggtggagacagggagccaggaaacatctattaattgaaacacttggaaagcctcccctgtccctcacacaggtgcctgaaatagcactcaggccccacctggtaggtaggaattctgctttcaagtcccaggtcttatgatcttggacaagtctctccttcagtgactaatgcaatgactctttgacagtgtgctgtggaccaggtt

SEQ ID NO: 222355 - DNA, 460 bp, Homo sapiens
atcccaaaaggaaacatcatgtgtcaccatgcctggctaattttttttctattttttatagagacaggttctcactgcattgcctaggctggccctgaactcctgggctcaagtgatcctgtcacctcagcctcccaaagtgttgggattacaggcgtgagccaccatgcctggccaatggtaggatatttagaagcatccttggccgctacttactagaagccagtagctccacccctcaagttatgacaactaaaaatgcctctagacattgccaaatatccttgggggcccaaattgccccccagttgaaaacaattatgttatcctaaagtagctcactcagtttgcgagtttttgtggaacactgtaaagctcagcctgacctctttgtgccacccagcaagttcccagaggcctgcctcgctctttccctggtacacgcctgcaggaggtacct

SEQ ID NO: 222356 - DNA, 527 bp, Homo sapiens
gcagtggcatggtcttggcttactgcagctttcacctcccgggttcaggtgatcctcctgcctcagcctcccaagtagctgggactacaggcacacgccaccacgcccagctaattttttaaattttttgtagagacgggattttgccctgttggccaggctgggagcacttagaattttatcatgattatgtttcaggtatatttataagtgtgggcggcaaaccacccaggtgccaaggcaagagaccgaggacacgagctgttccaatataataaaatataaaataagaatagttataccagatatagatcttagatatgattatatatgaatatcattaatcattagtttgtagcaattactctttattccaatatcataataatcctcactctataatcataacctaggaaaaaccaggccatacagagataggagctgaggggacatagtgagaagtgaccagaagacaagagtgcgagccttctgttatgcccagacagggccaccaaagggctccttgg

SEQ ID NO: 222357 - DNA, 399 bp, Homo sapiens
tataccacatctggaactcaaaatgctatcaggtttgagaagactctggagtaagaggtccaggctatgatactagccatctgacacaaaccagccactccagtgttgctagtaatgcccatgatggataacaatgctgtgtggaatttctggcatggcacagtaggaaagctaaagtgcaaatctttcaatggtatagccagtaaatctaaatggggtagatccatgccttctacagtaggaaatttctcagtgcttataaatagatactatcatgctccttagccctattagagactgagtagatgacaatgggacactgtgttaggttgttcttgcactgctagaagtataaataaaagaaatacctgagactgggtaatttataaagaaaagagg

SEQ ID NO: 222358 - DNA, 362 bp, Homo sapiens
tggctggaaacgggaaccttcagcgatcaagcgtcaaggactgccctccaaagtctccttcccagttctgctgtctgcctactcagtgcctttcccccgaacactcatgttatataagtctccttagtgtttttccagagacactctatcctagatcttctgtattttttgttgctgctttctaacctactttgttttggagatcatttatatcacttcattaagagcactatcttttataatgattgcatagtagtccattgtataaacaaaccattgtttatttaacatttcccagttggtggacattacagacatgctgcagtgagtgatgctgttcctgtgttattttatacatggtt

SEQ ID NO: 222359 - DNA, 132 bp, Homo sapiens
tacacctgcctctcccccaaccctcatcccctattcccatcaggtactgagtaagggaatgggaggagatagttgaaggagttcaggttgtggctacagagtaggaaagtaccattagaccagtgaagggtc

SEQ ID NO: 222360 - DNA, 347 bp, Homo sapiens
ggagtgatgggaggaagttgaagatggttgtatgttggcaaaggccagtttactgaagctctgtgacaataggcagggtctattgtctgtgacaataggcaaaggagctatgatggcagccagtaggaagcaccttggttgggcatacaaagctatgctgcaagtggcatggccaggcagggaccgcgggagaggacagcaggcaggtgggtgctcagatcagactggccatgttccatgggcaaaactgccttgctctgtccaggtccaacagtcaacaaagaccaaatccacctagaagatcatggtaagccttggagagcaggcatccctggcagtgctccact

SEQ ID NO: 222361 - DNA, 517 bp, Homo sapiens
tttgatgactgcagacatggagaagtagaactagttctaggcaagggctgtttatcctgcttgtctgaggagtgagctgtggggaacctgttaagtggttgtaatgaaagctgagggtgaggagaatgcagtggggaggggcttgaactttacctgcagtgcttctactggcgattgttatgtattttgtttttaagttttaatttatttgagagtgtggatatacttttttaattgaaatataattcacttaacttaaaaggtactgttttaggccaggcacagtggctcatgtgcctgtaatcccagcactttgggaggccaaagcaggaggattgcttgaacccaggagtttaagaccggcctggacaacatagggagaccttgtctctactgaaaaagaaaaagaaaaaaattagctgggcatggtggtgtgtacctgtagtcccacctacttggtaggctgaggtgggaggctcgcttgagcccaggagttcaaggctgcaatgacctacgg

SEQ ID NO: 222362 - DNA, 399 bp, Homo sapiens
ccaagacggaacagtcaggaccgcaggcaaccctgagaagtggagtccagagtcctaaaaacctacaggaaatacggatgtgaccacgaggaccgcgcgccccgcccaccgcgcgagcctgggacacctctgggagtggccacctggcctaggagtacgcaagcgcagatcagacaaatgctggggcccccgacctgaggctaagggtggagtcgctgcgttctcagcgccagtaggaggcgagtctgggtggaacctgactcgggtaaaagaaaagggttaggtaaatggactcaggtcctataggagtgacttaagtcccaccacattcttcaatacattatgttcttcacctttggacacgaatacatatgattaaaaattttatttaaaaacatc

SEQ ID NO: 222363 - DNA, 772 bp, Homo sapiens
ccacgaccccatctgggaggtgtacccaacagctcattgagaacgggccatgatgacaatggcggtgttgtggaatagaaaggcgggaaaggtggggaaaagattgagaaatcggatggttgccgtgtctgtgtagaaagacgtagatatgggagtcttttcattttgttctgtactaagaaaaattcttctgccttgggatcctgttgatctgtgaccttacccccaagattgcaccactgcactccagcctgggcgacagagtgagactcggtctcaaaaaaaaaaaggatacattctgagaaatgcattgttgggcaatttcatcattatggagtgtactgacacaaacctagatggtatagctgactgaacacttaggctacatggtataacctgttgctcctaaactacaaagctatacagtatgttactgtactgaatacagttggaacactgtagggaccagccctacaaggtctgtgggtttttctccctgtgtgcagagactagaggtggtagaaataaagacacaagacaaagagataaaagacacctgggcccgggtgagccactaccaccaagacacagagactgatagtggccccgaatgccaggctgcactgttatttattggatacaagacaaggggggcagggtaaggagtgtgagccatctccaatgataggtaaggtcacgtgggtcacgtgtccactggacagggggcccttccctgtttggcagctgaagcggagagagagagaagacagct

SEQ ID NO: 222364 - DNA, 435 bp, Homo sapiens
acgtgaaggggtatgttaaattccttgaaagcttgtttttagtactcttctccaacagcatccaattagctctatttagccaccataatctataggatgtctctttctaaaaacccctttctactctcagagaaatgcccctgatttctggatccaaaaatgtcaacactgagttgctgtgaagaggaagtaggacaggtcagggagggcttctgatcatcagatgttctggttgcttcagtcctgattcctccttccttcaccttttatacatgctctatttaccaggcagcacttaactgaggcagctgcctcagctggaaagaataaaattgggcaggaacaagcctctatcaggccctgattttagatgttctgggccaaaatctgaaatgcaagtaggagcttttaacctaacaggggaaggatatatgt

SEQ ID NO: 222365 - DNA, 358 bp, Homo sapiens
ggtgtaaagtgcattgaacctatttgggccagttgcgtatgaccctgtttggactattgtagtcaatgcagggaaagctggtggggaagagccacaagcagaacaccctggtttttttggaagtcctcagcatggtctgggtggagctgttgaggcaagcactgagactgcctctcattccaacatctgctgttgagaaaggaagagaatgttcagcagtgagaaacctggccgaggccagccatcagactcctagagagaccccttgggaacctcttcagaggacgatttgctagaaggccagtgatagccagttgattggaaggtgacctttactaaatctcctagatgacagaga

SEQ ID NO: 222366 - DNA, 485 bp, Homo sapiens
gctattattgccactttacttgtattttgttcttattttgagtggctagggtaaagatcttttaactgatttaaaggatgtttagtttttattttatcagccctagttccaatgataggaattcaaaatgtaaaacttagactgtctagatgacttgattatagttgaaggagaaattttaaagcgagcttgaagaatggtgccaaagtgcattttattttctgcagactccgaagaaaggagtgtatcctctgaggggaagttccagactggcaggtctattttggcttcaggtatgcttttctagttattgaagtgataaggtttttttttttttttcctgtctctccattctcccttttcctccttctttataaaaccagattaatattatctattatatgctttagaaataatattaaagaatggagcttaaattgaaacttcaagagctgattgattggatcggcttgccatttttggag

SEQ ID NO: 222367 - DNA, 380 bp, Homo sapiens
cagtggattttggatttttcaagtacatagtaagaaaacatttagagttcttcaatcaagggactaacagtaacagcctcctttttccaaagcgtagttccagcagcagtgtggaggacagggtaaagagctgacaataaaggaggctgggcacagtggctcacgcctgtcatcccaacactttgggaggcagaggcaggtggatcacttgaggtcagggagaccagcctggcccacagggcaaaaccccgtctctactaaaaatacaaaaattagccaggcatggtggtgcacgcctgtaatcccagctacttgggaggctgaggcaggagcatcgcttgaactcgggaggcagaggttgcagtgagccgagatagcgc

SEQ ID NO: 222368 - DNA, 390 bp, Homo sapiens
  misc_feature (294)..(294): n is a, c, g, or t
acggttatggtgagttatgatcatgccactgtactacagcctggacaatagagtgagactctctctaaaacaaaatttggaataaaaactaaatgttttaatgcggtctgagtaataatgtgtttacagaataaaaaagaacatcaagtaggcctgtatttgtttatcatctaactttttatgtaattattccataatgcaaaatagtaaattcttaagtactggtgtaggaccatgctacaggtaatctaaagacataatccactgaatatttattaattgattttgttttanaatctttttatatttatatactaaggttgatagataatgttgatttttttgtgatttcacaacactatcagcaaaaaaaaaagcattgtcattcag

SEQ ID NO: 222369 - DNA, 317 bp, Homo sapiens
gaatttgactattgtagatatcttttataactgtgctgggagggaaagcttttcctctgccatctcaggtccagtagtgtgtgggagctgcaaatgagcaaattaacagattaacagggggaaaaaggtaaccaaacaatggacagattaacaggagaaaagacaagatttctttacatgtgtgtggggcagcatttaaatgagaagctccctgaagaactagagatagggatttatacaccaactttataggggaaagggtgaagggagaaagggtttccatgggaaagataaatggtcttttaggagaataaatg

SEQ ID NO: 222370 - DNA, 277 bp, Homo sapiens
tgtaggctgaaggtggcccttgagttgctagtttgcaaacccaggcttaaactacagcagcggttgaagagaacaaggaggctcagattacagcaatgtgaaggcaacagaatcagcactactctataaaggactgactgtggcaagtgagggagaaagagcgatcaagaataactccgtgaaaaactaatgactctatattaaaataatatatggcttttaggtattttcaaacttgacaaaagtgttttggcaattaaaaatgaaatgaaagagc

SEQ ID NO: 222371 - DNA, 550 bp, Homo sapiens
tggccaagcatacagaaaggcgtggaagtggccacacagtgtaggaacatatgcatcatatcttcatgcaactttgcctggcccacaaagttcctgccaggaaggcaaaatgactggtgacacaaaaaggtcaaggcttgccagatgcaagatgctgaaattcatgtagtgccatagctcatttctgtgtggggttcaaattcctgttcactttctgtgctccatgcttccacttaagcgcattgacaaatacgaagctttcagaaactacactctgcatcagcagggctacgtgttcactgggcaacgtcagcgcccaggcagcctgagcacccgtcttgtctccagatgagtcccagaaggccctctctgcacaaccggacaccctccattgggggttttatatacaacattaagattacatatattgggagaaatacctgtacaaccatgaaaaaggttttagtgatgtaagaatataatctgaattaaaaaagcaggacacaagtgtcatacatgacatgatcccaattatacaaatacgtaaata

SEQ ID NO: 222372 - DNA, 691 bp, Homo sapiens
gagccaccatgtctggcctatttttaatggtcaaataggtatggaaagaaccttagaatgatttttctagattacacattaaggtctatttactttccaatagttgataggagttttatatacacaaggctctgaatcagaaatggagagttgagtggccataataacatattgttatttgttgttgatgacacagtcatcaagggaaacaatgcagtaatgccataaagttgtcatatcctttgattcacgaatacatttgcaggtgtctttcataaagaaaacctcccaaatgaaaaaaggcttttgggataaagtgactttcacattacttataccagaataaaagaagcaatgagcaacagggccgagccaaccttcatcgagtgctagctgtgagctccttcctgtgcttggcactcatttaatcctcataagaatgctgggtgctggtgattatgagctcacggtacacacgggaagacaaggctctaagaggtcacaaactgtatgtgaataattcagaatccaaattcaagcaaacaaaaacaaaagccacgcttttccctttacacagaagatcatacaacctttaaaagaactatgcagatactgagaaaggctcaggagaacaaggaacaagaaactctgttagacttgtaggcactggacatgattctcctactctact

SEQ ID NO: 222373 - DNA, 409 bp, Homo sapiens
  misc_feature (373)..(373): n is a, c, g, or t
  misc_feature (379)..(379): n is a, c, g, or t
  misc_feature (391)..(391): n is a, c, g, or t
  misc_feature (396)..(398): n is a, c, g, or t
gctgcagaatcatgtgattttttttttttcccccaccaagaatccacttctaaagtgtcttctgaagcattttaatgtactgatgatatgagtttattttggtaatgattaattctcttagctccaggaaattttgtatctctggtttcagtagaatgtagacaggttccattttcttgcatgagctaaagataaagagttcccataaaatgaagcctttgggttttgagaacttttaagttaaagggttaagttttagaataattgaaaataagtattccaaaaaaatcatttaaaaaatttcttctcctaatacatttaatcagtttttttgttttgttttgagatggagtctcgctctgcactccagccngcgtcncagagttgtttntgttnnnttttgtttaaa

SEQ ID NO: 222374 - DNA, 245 bp, Homo sapiens
acagctattttaagatctttatatacatatatacatgtaataaattctattctttactataaacatacatgtcagaaattattagtgttatcatccttgtcctcctcattccactttgcagatgaaaatactgaagctgagagagactaggtaacttacctagtatgtacctacatagtgaagccagatttgagccggacctcctgactccagagtccgagcaatctcaccaattctgcccacaa

SEQ ID NO: 222375 - DNA, 555 bp, Homo sapiens
tcctaagtgcccatcgaacaatgcgtggataaagaaaatgtggcatcaaacaatgagtagataaagaaaaaatggtatatatacaccatagaatactactcatccataaaaaaaagaacaaaataacgtctttggcggaaacttgaatggagctgaaggccattattccaagtgaagtaactcaggaatagaaaactaaataccatatgttctcacttataagtggaagcaaagctgtggatacgcaaaggcatacagtgcaatataatggactatgggaactcagaaaggggaggaagaaaaaacgacaaactgggtgcaatgtacaatactcaggtgatgggtacactaaaatctcagacttcaccaccatacaattcatccatgtaaccaaaagccatttgtactccaaaagttattgaaataaaaagatgaaaaacaaaagtaaaatgtgcagaaataaaataaagaaaatattggttgatgccaacaaacacaaaacaaaaacacaataaaacaacaacaaattcacacgtcttgggaagccaacgacag

SEQ ID NO: 222376 - DNA, 656 bp, Homo sapiens
ggcctttctttaaaaacagaggacttgagtatattacccagtggtacttctagtgggatttgtaccacatttacatttgattacaacaggcagatgcttatggtttttaacggggggaagatatatttttcatgcgagtgttctcagtggttagaatagggagtaagtaacttgagcacttttagcctccttgaaatgctagggagaagaggaattaagttaatgtcattaatctctgttgaaaacgtttggacctctttattgaggattctttacaaggcatggatggaatacctatggatttccccatagcttatatacttttattctcattgttactacattagccacacacaacaatatttaattaatgttttcattaggcctcatacaagagggtacctttttctagtatgtgagttgcaatttttttttttttttaaatagagactggggtctcactgtgttgagcagcctggtctcaaacacctggcctcaagctatcctcctgcctcggcctcccaaagtgctaggattacacatgtgagccactgtgcccagcccgaccttttgttttgctggaaaacattcctgtcttttcttatgccattcctcctatatcacaaaacaaaaacagtcttcttctttttcccttg

SEQ ID NO: 222377 - DNA, 127 bp, Homo sapiens
atatatttcagttaccctggtttagttaagtaatactagtcccccagcaacattgcatatgttaactgtaagtgcatgaagtactgctagctctttagtccacatatcactatataacataaataac

SEQ ID NO: 222378 - DNA, 475 bp, Homo sapiens
agcaccttccttcccctggcgatccccactagctccgtctagtgacctgggccaagcgggcgctggaaggggggcggggtaaatgcggccggcgcagaggtggggagcaggtgggaaaggtggaggcgggctcgcctctggagacctacccctgctcccattgtcctccgcctgccagcttcacagacaggcctgaacgcgcagagagttccttggagtgccctgattttgtccccgagagggcccccaacctccgcatcctcttagtggctgtcctggcaggtgcgcgtcctgcggggagttgcgccccgggggctatcgccgagcgggagctgcctcctggaaccctgcccaccgcgaactgggtgcctactccccatttctgcctttcagtgaagaaagtgaagacacaggcagaaagagatcttggcagaaattggtgaactagggtggacttcgagaggaggtgaaacga

SEQ ID NO: 222379 - DNA, 247 bp, Homo sapiens
ccgggcacgcagcctgtccccacccatgggagtcccctggggtgtgcaggctgtcaatgaaatgtcattctgcgactgccacacttcagggcttcttctgacaaacagatggtgacttctgacatcctttgcatggtgtttttgcccgccctggggaaaccagcatttgtttccctctgctctgactcgtcacagagttccttccccctgactttgagaagtaaataaaaaatgctttccttacaaa

SEQ ID NO: 222380 - DNA, 461 bp, Homo sapiens
taaaaaatgaatattaatttttaaaaagacaagaaaaaagtgagtgacctcaatttttaaattaagtggcttgagaaacatagtaatcaaatgaaatgtatatctcccagtctagattctgatttgaacaaatcaatgtaaaaattaagaggaaataatattttaaagtgaaagaaaaggagtacagtttagtttttatgtatatataattttgaaattacacatgtaactgtgtaatgcagatacattgatgattaatacccaaaaatctataaatgttatcatatttcgattgcattataaatgtatttttcatttaagatattttgaatattaatcatcaatgcattcatgagaaacatgattactgtattttacaataatgtgttaggtacaattaggaacatcttaactaaaatttttgcacctatgtttatacaaaataatgtggatctgttgtc

SEQ ID NO: 222381 - DNA, 260 bp, Homo sapiens
gcacgagcacaactcacagtgctttgcagagagacatctggccacagcagcaaatgtagagctaatctacactactgtgctccacttacatcttgactctcttgaagcacggggagccttgtcatggagcactccttctcctttgtgcaccgcttattacagactgactgttggagaagcttatagtcctaaaagaaaacttgagacaaaggagaggacagctacatgaaataaaatgagaggaaagagacgtaaaaatg

SEQ ID NO: 222382 - DNA, 431 bp, Homo sapiens
tgcccctacccctgccccaggtccatggaaaaattgttttccacgaaaccggtacccggtgccaaaaaggttgaggaccgctgacctagtgggcttgtatctgggaagccagaaacataaatgagtctaagaaatatctcttcagctttgaacctagataacgttggaaaaatagtaagctcttcaaagttaaggacttatctataatttgcccatgtggctagcagttgctagtgaaaaatgaattttaatttatagcaaaaaccttattaagagttaatatctttgattgtggctgtccaaaaaatctgaagtagtcataatctgaatttaatcatttatttctccaacaaatatttatagtgtatatactgtggtttttaaacctgatttgtgcataaaaaattcctataaagctttttaaaaatata

SEQ ID NO: 222383 - DNA, 518 bp, Homo sapiens
gacgacgtcagcgcccgccgcatccccgggtgccccccagccgcgggggaccgcgacggctccgtgaccgtcacgtgccggaggccgcggctgctcgcggccagaccttcgcatcgagggacgtgagggacatttgtcctagagggcccaagataagaacgagaggaagaaccgggaggcaactctccgtcatcctctagccccccgcatcctaggaaacgtatggaaaacaatggaaggttaagtgtgtgcacagtgatctggccctgcaggagtgtgccgaccaggtgatatttcctggggcctggtgataaggatttggaaggttacagcacagagacgtgaacgtaaaaaggaaacagaggcagcaagcaaatgaggaaaccgatactctgttctgagaataaagccattttaccgctagacgtcatactctgtagacgttatagtgctggatgtctttggtactattacaagaaattagatatctctatctttaaatatcacttaaggaaatt

SEQ ID NO: 222384 - DNA, 553 bp, Homo sapiens
catattgtaatgccaagtttccattctttccagaacatgctgtagagcctctttctaaagattgcttaagaaatactatgttttaattttatacattggactccagagttcccaatgattatttataactgaattttcaatataccaaaaagaaaaggtatctgaatctcttcacctgctaaccaattggagagaaagagcgagtcaagtacagatcccttttcctaaagtttcattatttcttttaaagatagcctgagataatttatttttatttttaattttttaagactctttaaaatacatttttaaaattcttctttgttggagattatttcattaccacagatattttcacaaatataatactgcatttctggagggcagggatactgtatgagtaatacaacaggcagaaaacctgggatatattatgtaatcaatcattgttggattgagtttaattaaatctacaatatttttggtaaaattatgtttatgtataatagaatctattattttccaatagcaaggtaattatgaaaacatttct

SEQ ID NO: 222385 - DNA, 940 bp, Homo sapiens
  misc_feature (36)..(36): n is a, c, g, or t
  misc_feature (97)..(98): n is a, c, g, or t
gctcgacgtgagattttgcaaatttgaaccataggntatatttgtaagattgttctctcagttattaagagtttgaaattggggttgaactgtgtcnnaagctatggtttatgtgtatgtttagtttatgtagttgctgtgtgcataacatttggcaggggaaaatgtttttactttcaaacaaactgacaagaaattgttccatcttgaatttgtgtaagaacgtttcagaactaaaacaaacttaccaaaactaggtcttgtccattaaatgagataatgcgtgtaatgtgtctagcaagtacttggaaattattattgttaagactgtcttatagtctaacttatcaactacaatgatgcctcttctgaatttcctaatttcttgcctttatcttttttttttttaattatactttaagttctgagatacatgtgcggaatgtgcaggtttgttacataggtatacatgtgccatggtgatttgctgcacccatcaacctgtcatctaggttttaagccccacatgcattaggtatttgtcttaatgctctcttgccttttatcttttttatgatgaggattatatatatacacacacacacacaatgcctcctgtatgctcagtatcacttttagccaataaaattgagattctggccaggcacagttgctcacacctgtaatctcagcattttaggaggccaaggcaggtggattgcttgagctcaggagtttgacactagcctgggcaacatggcaaaaccctgtctctacaaaaaattaactaggcatggtggtgtgtgcctgtagtcccagctacttgggaggctgaggtgggaagatggcttgagcctgggaggcggaggttgcagtgagtcgagccgagatcacacaccactgcactccagcctgggcaacagagccagaccctgtctca

SEQ ID NO: 222386 - DNA, 102 bp, Homo sapiens
ataccttgtgtatcttgtgtatgtccagtgtctccctgctgccccagtatcttcacttcactttttgaatcaagctacaattaaggttcacactatgtgttt

SEQ ID NO: 222387 - DNA, 523 bp, Homo sapiens
acttttaaaaggcaaatgagtttcaagctactagaaatactgtatctagataaaggacaaaatggatctactggaatgtatatactgattagtccaaataggaagaaccatatctagagttccgggattaccacatttaagaaaacacagtatcaaatctgagattatccagagaaggacaaagaggatggaaataaattgagaaagagtttctaacatgaggaatggttgagagtaatctcaataattctgtagcctgaagataagaaaacttaggggaaaggtatgtatttaattaggattaagtttgtgactattaaggcaaaatgaactgtagctcaatgtaataaagaactttccagcatttagaaataatgaaaggggtgtgttaaaatataatgaggaccaagcatggtggcttatgcctgtaattgcagcactttgggagaccaaggcagaaggaccacttgaggccaggagttcaaaaccagtttaggcaacatagtgagaccatgcatccagt

SEQ ID NO: 222388 - DNA, 481 bp, Homo sapiens
tgatcttactgcctggcttcttcctgatgtcagtgcccacttgatctcatagcaaagttgggactgagcctaggcaccatgagtgacagcaggaggcagactgattcctgggcaaaagggggtgggtccccagtgatccccatcttcaggaccggggaaagcctgaaggctggggactaggttgcctgtctgtcccatggaccgaagtgggaacttgtggtgcctcttctgggcccacccatggctgctcacagaccaattaacttgcactttctccctagtgaggcccattaaaactatgggttcagccatagctgagcagatgacaatatgaccagctgcagagaggaactaccttctcagtggagagcttctgagacctgcagagacatcgggacaacaagctgcagagaggagcaacccactctaaggcctcttttcagctaggagctgagcagacatcaggacaaccagctgcaga

SEQ ID NO: 222389 - DNA, 436 bp, Homo sapiens
aacatcatgtttaaatgtattcactatattgtgcagagaaaagaccagaataaaactaaaagtgacagagacaggaacaagatttggagattatacacatttgcctatggttcgtagagtaaatgtcaacgaatactgtgcttagtagcatgaatgcacacgggaatcccccaggagcaacttgttaaaatgcaggtgctgattcctcaggactggggtgggtccaaagcctgcatttccaacaggctcccagacaatgtcttgctgctggtccatggaccacactttgagggcaagaatatacataactgatggttcagatctttctatttctagcataaatgagaaacttctgagttaaatgtaataaacattcatttaactgacacaactcccaataagagtcgacgcggccgcgaatttagtagtagtaggc

SEQ ID NO: 222390 - DNA, 445 bp, Homo sapiens
ctgtaaattctaggatcagtttgttatgttccatgaaaacactgttgttatttttattggaattactttggatttataggttaatctgagaattcacagttttgaaaaatttactcctttcatctgtacacatgtctctctgttcatttagggcttttaatgtccttcagtaatgttttacagttttctcctgagtagtctcttacattttttattagtttatgtctaagtaagttagtttttctttctactatgaatgtgacttttttgttacatttcctcattgactattgtgtgtaggaatgccattggtctttatgttgattcttatatctagcaaccttgttgaactcccttacctagttataatggtttgtccaaagatctgttggaattatattagtggcaaataagaatagttgtttcttcctttccaatctttgta

SEQ ID NO: 222391 - DNA, 438 bp, Homo sapiens
ttaggaatttgatccttcctgccaggtggctcccattttctgggatggctggaagccaattctcccaaaggagggaaggcatccgagtctagaggaagcttgcagggatttccaggaaaaagtggcaggagagaggatcctcagaagggtctggggcagagcaggctcaaaccagacccaagaggccccgaggacagtttgtttggtggctctgggcccccgctcagtgacagtgtggacgtttgtctctcgtaaggagtgagaataaacagaggacagaaatgcagaaagaacattcccgctgcatgcctgggaggatgggtcctgactaccagccccaggtctcccgaagatgtgatgcttgagtgagctttgtttagagaccttttttttttttttttttagtttttaaataaaaatattcatttttatcttaca

SEQ ID NO: 222392 - DNA, 505 bp, Homo sapiens
gaggaacatgaacttgtgttggtagaaatcccattgattgattgagtgatttattgtcttctgataaatatttaattgttcacaaggccagtccagaaacctggagactaatctgtctcttttgattagcaggacagttgtcgaaactcattctgtctttgtaataagcattcgtgattaatttaccaggactgataggatcctgtcactgtgacccctaactgagcaaacaagtcctttctcaaacctgaatgagaacagcctgggtgtttacactcaagactatttattggcaacataatttagcagtgaaagttttctttacaatccttctatcccgtgatagcctcttttcttctctgtgggattccctggtgttcaagaaagtgctctttcaggaagtcaagggacattctctagacttttaactttatttatgtcctatcttaaaccttcccagccctaagttagtaccctgctagtgattagttcaagaatgtgataa

SEQ ID NO: 222393 - DNA, 352 bp, Homo sapiens
ccccaaccctctgggatggaaaagaagaaaatggagagtgtggggcagacgccggccgagccgagggcaggtcagcacagcctcatgtccggcagagggtgtccaggttcttggcatcatgaacaaagaattggacaaaatgcacaaagcaacggaagaaggaagcagcaaaggcagagacgtgtggaacatgaacgcgcactccacagtgcagtgggagccgggctgagcacagggggtcgggagccctgttacagaactgcctggggtctaaatatgctccagaggtttccactggttacttggtatatgccctatgtaaacggagaggttatttcctgttgtagctgat

SEQ ID NO: 222394 - DNA, 419 bp, Homo sapiens
gtacactgtaggatgtttaatagcatccctggcctctacctgctagatgttagtagcacccccttcacccatccatgacaaccaaagacgtctccagattttgccaaacgtccctggggtagaaccttgccccactaactcagacaaagagcaaaatatgccgtgggcatctgtagcataacaccagagacatgtatttgaggacacacatggtggctgatgtcagggcatcttccattcagccgtctcagccaagggacactcatttagttcttccccaaggatggagcagatgggctgccccttgtggcagatgccagtctaggaagaaacaagacggtattactcaaaccatttcatcctccattcgatcacagtagcactgcccaacaagactttgtcttttaaaatgtagttta

SEQ ID NO: 222395 - DNA, 415 bp, Homo sapiens
tctgtgatataaggtctccgtacaagcagttatcatgctctgtcagtctttctatgcaattttatcatgtagattgttttgggaaacatgaaaattaagatttaatttgtcctaggaattggatccaaaatgtaatggaattggttccttaatgcagtgcatagttgtagagtatagtgtaaattaaatcaacttgtgcttcaataatctctttattagttttcaaatattgatttaaataatgatattaaattgtgtatagttgaaaagatggcattgctttcactgcaatagatgaatgtcatgaaaatgttcttctcttgtaatggaatcagatgtagaacatgataaagaacagttctcttcacacctcataatttctgacatagtaagttatgttgaggaaaataggcac

SEQ ID NO: 222396 - DNA, 465 bp, Homo sapiens
ggagcctccatgctgaacatgcctggtccccaggtagccttttcctattggcatagctgccagcattcatccatgcaagcttccagtttgcttatctatgtttgcagctcaacttttcaggccactctttgttagaaaagaaatgattcgggggctgctttttattaaaagggtaaccttgctgaggactctcttaccctcactaactgcctaatttctttctagctcctgtatcaaaagggtccccatccacctgcacaggcatgagagggaagtcccctgtgtataaaccctttaaggaaagtaactttgaaatgaccaagccacttcatgtttcttgatcttgctatccccaggcttttctgcccatccatctgcttggttcttcaaagcaccttttctattttatagataagatgctgcctgattcacaaatcgataataaaagccaactggacctttaaa

SEQ ID NO: 222397 - DNA, 796 bp, Homo sapiens
gggtcttccgtgatccacagaaagcgataaactacggataatccctaacagacactgcagctcatacagccttggagcctagaggagagatgacacgcccagagagaactgtgacataaggcagagagtgctcctccagaaagaaacaaaatactgtggggctaaaagaaagatcaccacagctgagggaaggcttccaggaggcggttccataccctctacggaaccagcagggcttcgccacagccagccaagactgggatggcctttagacagcatcaagccccagccctgtaatacgatgggaaacaaatgtccagagaggggaagtgacgtacccaaggccacacagtgagctggggctagaacccaggtttcctattcccttgctctctctccttccatgtcaaaggaggtgttgaaactaggggatggcagcacagtgcagtggaaagaccaggcacatccccaaataaactatatattcctatgtgtacatatatgcgagaaaggtctggaaacagatgcaccaaaatggtaacagtggttccctctagggagggcctgggatcatggcagtgggaggtagtccagggaaactttcactttgtagcatgtggacatttcataactgtgtattcacagcatgtgattaagagaccagtcgcaggggttagttttcacccagccctgtgtgacctttagtcagtacggactgcagagggcaggcttggtcagacctccctgggaattgttctggactccccatcaagaggctcccggatgggcatgggct

SEQ ID NO: 222398 - DNA, 429 bp, Homo sapiens
aaggcagttccctcaaaaatgagccttgtatcacattgttgctcagagggctcagacagtcataacacaaaatcttccctgctcaggttatgtttatggctttctgaggaaaaaaaaaaaacaacaaaatctgaaaaggcaacctctttagaagtaaaataattagcattttatttgaagaagacatattattacacctagtttttctaacttacctttttgaaccacttagagaactcacagtaatacagtttttttttctccctgtaaattacacggtagactaaatgtggtctatcactcttggcaaaagactaagggcagatcaaaatttttgttcgatgaagaaatagaaatactcattttctttttacacatctgaaatctgagttttaaattataataaatcattgacaaaaatctaaaaat

SEQ ID NO: 222399 - DNA, 520 bp, Homo sapiens
tgccttatggtacaaaggctttttccccacaattcagttatcttaaacttaaggtatgagattgatgtataacaattttctgatgcaagctatattatgcattttagaaataatttatacctacattcaactgctgatcatatgggaaaaatttataaaagtacattctatttgaactacttgtctaatatatcagaatattgtttatctgggaagtatccaaacaacagaggtgttctaagagcactttaaaaaaaggtcgttcgaaaacatcactttattcttataatcgaacatgatttgctctaaatcataatgtgaggtaatgaggtgatatgctgggctgtgagtgtctgttgggattgtcacagaggcacagtccccagcttggagatgtggtggtacaaatggtattggataatggctgatctaagagtgttgtttacaactaattgatcacaactcattacagatttctttgttccttcttcactcccactgctttacttgactagcctta

SEQ ID NO: 222400 - DNA, 250 bp, Homo sapiens
tgtaatcccagcactttgggaggccaaggcagttggatcacttgaggtcaggagtttgagaccagcctggccaacatggtaaaaccccgtctcttccaaaaaatacaaaaattagccgggtgtgttggtgcacgcctgtgtgttggtgcatgcccagctactcaggaggctgaagcacaagaattgcttgaacctgagaagtagaggttgtagtgagatgagattgcactgctgtactccagcctgggcg

SEQ ID NO: 222401 - DNA, 495 bp, Homo sapiens
caatcataagctcctaagcagaaagaaaagaattttgatcgattaaaaggaccttcataaactggaatcttcccaaggtacaaattacactgttcattctgagaacccaggatttgacctaaaaatgttttctttgcatgttcagccatcactgaaccagtaagagcaggacatcctcttatcctgtctgatttccgattgttattcaccagactatactgcgtcctttcctctttcacttcatcacacctattgatgttaacatattttttcttctggattttaagtatgtgtttattaccgtattatttaatctaccccctaattaccgaaatctgtgtaaaactattcatgtcccaattatgttataacatatgtagtctatggacatgatatagttgggatactgttctcctccaaatctcaggttgaaattttgtaaccacatcagagcaatctggttcaattatcatgtaataaagttgtgagttgttt

SEQ ID NO: 222402 - DNA, 603 bp, Homo sapiens
agaataatatttttgttccttttacttttccttattctctggtaaaagttctgtaactgaaaaagtagacccagaataatctagtgatcttaataatgcttaagatttcttcagtgctgtgggcatctgaagcagctgtgggtgatgctctgtcatcccctgtaaaatgcaactttcttagttttattttcctccctcttttttgcagaatgcttatatgtaaacatggtgatacaactgtctactttaaaataatacccttccccattacaccttgctttggggctatttgttagcataggaatcgggttgctagaccaccactactgccccgccacgaccactgggtcaattctgtcatagcatcacgtagagaatttataatgggcaggatgggttgctttccagaacagtcctccttggggtttttattagatccttcaaaatttgaaagtcaatttattctatatgaagatcttaatcacaagtaatgcttaaaaaaatcaaattcatgaatgaaagaaaaaggaattcgaatattttcactgtaggatgattgtatttaaaagttgaagttgattatactaaatacagattgtcaat

SEQ ID NO: 222403 - DNA, 479 bp, Homo sapiens
cactttgttgagatataattcacatataaaatttctgaagtgattgaatatacttacaatatgaggagcagacaatgtaggtgtcctgcccatacctcctatccgacacctttaccatttttgtggacaatggctcctgataaaggctttctactcccagctgctagaaccctgcagtgattaaccaatgactgaagtttacagggtgaggtggagtataactattccagctcccttctctgctgactggaacaacactgtcctccactgtttccagagcttctctgtggaaccaagccataggttcacctccatgggacttcactaatattgcagcctgacttgtcttccttccctttccggtcccattttccatttcctaactgtttttccggaacactttctagttaatcactgtcatgaaagacccttgtctctgggcatgcttgtggggagtccaacctactacgacacatggc

SEQ ID NO: 222404 - DNA, 407 bp, Homo sapiens
cacactgcgtgtcctcatttctgagatactgttcatggtaacacacaccattgatttagtaacagcttttctaggaataaaagacacattgcttgcataatgcgtattaattttgaaaatgctaatgagaaaatatgttatgatttttaatgtgattgcttccccacccccacctgactcccaagtgagcttcctgggggctaggactgcacccttatttgtttttgcaacccaggatttcccccacagagctccaagatgtcaggaaactttgcagaacaaagttttgcaatcattggtgggttgtggcatcaatttagcgaatacactgctggcatttaagaaataaaataggaaagacggactagacagattagaacagaaagatcagagtagactagaacaca

SEQ ID NO: 222405 - DNA, 357 bp, Homo sapiens
gagacgaagtctcacactgtcacccaggctggagtgcaatggcatgatctctgctccctgcaacctccgcctcccaggttcaagcgattctcctgcctcagcctcccgagtagctgggattacaggcgcgtggcaccatgcctggctaatttttgtatttttagtagagatggggtttcactatgttggccaggctggtcgaaactcctgacctcatgatccgcccgcctcggcctcccaaagtgctgggattacaggcgtgagccaccgtgcccggcccaggttttatatttttatcactaaaatctgaataattttctgagagcctgcagcacataatgacattaacgcaaactg

SEQ ID NO: 222406 - DNA, 337 bp, Homo sapiens
ctgtgctttgcgtactggtggctgcctgcaccctctcccagtgtcccagaagtgggctcctgctttctggtgtatggcgctggaggcctacttataaaggatcccactgccttggtgccagtcttggccaggacccacactgggacagtcagcaggagcttgagcggggtaggggccggctgggagtcactccagcactaaaaactcaccaggcgggaatgttactcctttctcatgccggaggaaagcctttgattgtgggtcccgaagaaaaacgacttctcgggtagaaagttggtgatgtagccttcaattaaaatgaggatatctcttacat

SEQ ID NO: 222407 - DNA, 440 bp, Homo sapiens
tgttgctgttagatttcactgtctactgcccctgagtttcaaggggagggtctacaatctctacaacctcagtgcttttcacaataccgggtacatggctgaatgaacaaatgacttccctgctaaagaaaaaaactggctgggcgcagtggcttacacatgtaatcccagcactttgggaggccgaggtggacagatcacaaggtcaggagatcgagaccgtcctggccaatgtggtgaaaccctgtctctactaaaaatacaaaaattagccaggcgtgagccaccacaacaggcgaaaaacactctaataataacaggcccattatcatttaatcataattacaccaacatggttaaaagaaaacttaatagccttaagggtttatcctacaactctagttcaagagttatctgaagatttacattggggatgggaa

SEQ ID NO: 222408 - DNA, 881 bp, Homo sapiens
cgcagagcctgtgaccacactaccaccgggcccgggggacgacgccctccaccagccgccgctgtcgtccaccatggtggtgctccgaggaccccgccgctgccgccactgcccacgccgatgccactacccgctccgggcccctggcaaacccactgcttttcccctcctcccagcgcccgcgctgcccgccctgggcccgctgtcgccggtgcgacggtaccaccatcccagctgtgaggctgccatcaacacccacatcagcctggagctccacgcatcctatgtgtacctgtccatggccttctacttcgaccaggacgacgcggccctggagcactttgaccgctacttcctgcgccagtcgcaggagaaaagggagcacgcccaggagctgatgagcctgcagaacctgcgcggtggccgcatctgccttcatgacatcaggaagccagagggccaaggctgggagagcgggctcaaggccatggagtgcaccttccacctggagaagaacatcaaccagagcctcctggagctgcaccagctggccagggagaacggcgacccccagctctgcgacttcctggagaacgacttcctgaaccagcaggccaagaccatcaaagagctgggtggctacctgagcaacctgcacaagatgggggccccggaagcaggcctggcagagtacctctttaacaagctcaccctgggccgcagccagaaacacaccagagcccagacaggccccacagccacggggtgccttcccctgctcgcgccaccaggcgggacgtccatgttcccttttcagaacattctcttcatttttctcctctcagttttaccgttgttggcaataaagttatctgttctca

SEQ ID NO: 222409 - DNA, 366 bp, Homo sapiens
tattacttagtcctagccaagaggaaacacctttttcattttgataagagcaaagtataaaaagatagatatatctcatttaagtttataagtgcagtgaccagaaattgaactctctctatgtatttttttctaatagtttctaatttctttcttaagaaagaggcaaaatcatgtcctgaaagtgaggagaggtggtaggttaggatattttagcagagtgagatttatttgaaatactttctctggagaatgtgagaaaaagggggtgggaatcaaaggattgctgggcagtattttgaatagggttgagatttcacaacatatgtttgtaagagaaacaattataagcttgcataatttttc

SEQ ID NO: 222410 - DNA, 307 bp, Homo sapiens
gcagttagctttgcttcgcttccctaagtgcgttcccccaggggcccggcagtgtgctaggggcaccctgcttcgtaagtgaggcagacagcccgtgataaatgccaaagtagaagcccctccgaaaaattaaggagccgattgggcgggactaaccctaagggagggcaggggaagcgaccgtcacctccgggcgccggggactcggaacgccgggtcggagctcggcaggcggagaagacggggtctcaccacgttgtccaggagatcgagaccatcctgggtaacacggtgaaaccctgtctct

SEQ ID NO: 222411 - DNA, 556 bp, Homo sapiens
tccacttgattatattgcagccacacaatggacccaacccagccaaggccaggtcccacactctgtggacattcctaggaagatcaccttggagcctgtcagtccccctggcagggcctgccttgctcccagtccactgccccgtcctcaccaactcaccagtcacgcagccgtgccccgccaccatcacagtctggcggtaaaccacccacagccacacttccggtcagccggttccgcaggcagccgtattacggtggagagcgctgctcagcaagtcggaagcccaggtttcagaccccaccgttcgttagtgggtggcattctgagtggaaactgtttcaaattttattttcttcccttgaaaaaaatgaaataacagcacctaccaacagagatgtcctcagcgtcgagtgaatatatttgaaaacgctatgtaaagtacaagatgctataaaacttaaggttttgttttttcagtcgtccagaagtaaagatgtagaattcctattattggaatctaggctctcaataataatttgttaaataatcgtgt

SEQ ID NO: 222412 - DNA, 256 bp, Homo sapiens
cctttaatgataggggtttccctgcattggtttgacctgttgcctttttgatgtgctctgtttgttttcatgtgttgtcttgtctcccctgctaaactgggagctgccaggggtctgggtcttatctccttcctccatggtaccccacacaggccaggatgtggtttggtacccagcaatcagagattggcactccctcatacaggggaaagcaacctggtctagcaaattgaaaataaagatgataaaactctga

SEQ ID NO: 222413 - DNA, 494 bp, Homo sapiens
ttattatgatggaatgttccatatataaatgttggtgatctttacagagctgtataagtttttagaacccatcaaaatatactaaaaatttgtctactttgcataaagtatacctctatacagctaacttgtaaaataataaaagtgagtttagggtccccaatatgttatgagacccagcagattctcaatttactaaatggcttattgacatcactagattattcattccctttcttcccatatggctgtgaccttggaaagtcagttctttaatatgtctcagtctcctcattaccataataatggtaattacctacaatcctttctgaaagaattgtctcagttcatctgtgtctgttccttaatacgtggcacagaataagtgagcagtaggtaataattattaccattatatattttaccagtattattaaaaatcaaagacctgtgttccttaaaagagcctcaagaaagattataactcataaaac

SEQ ID NO: 222414 - DNA, 404 bp, Homo sapiens
cactctttgtgatttttaaaaataattgaagtgttaactaattgcctctaagggtaaggataaaaaccagttcatgtatttgtcatacttcctacactgaagtatttaaaagtgaattataaggccgggtgtggctcatgcctgtaatcccagcaatttgggagaccgaggcggacagatcttctgaggtcgggagttcaagactagcctatcaacatggagaaaccccgtctctactaaaaatacaaaaattagccaggcatagtggcatgctcctgtaatcccagctagtagggaggctgaggcaggagaatcgcttgaacctggaaggtagaggttgcagtgagccgagatcgtgccattgcactccagcctgggccacagagcaagactctgtctcaaaa

SEQ ID NO: 222415 - DNA, 475 bp, Homo sapiens
tggtttgaaccaaagtgacactgaagtcaggaatgtcagctagaatgcaactgcagcaatccaggtacataaatagcatttgtatatcacatttgctttcttacctcatttcatattcatttaaacatatctattgagcatctatcaggtgccgggtggtaggtaaagcactggaggtacattgattagtcaatcagttatggtccctgttctcatggagatcacagtcgagtggggaaacaggcaccagtcaagtaattacaagactgaatgtctaatttcgaattacaagaattaccttgaagaaaaagtaagcagtgttatgggagcacataactaagaggcttgatatcatgtcctggtgggcaaggcttccctgacagaaattgcagcagaaatttgggattgaataaatattgattagaaaggggagtgtggggcagggagggggaaagaacactccaagaaaaaaaaa

SEQ ID NO: 222416 - DNA, 692 bp, Homo sapiens
actgacactactttatgtcggaagtattgaggaaccaatatgaagaggcttccagtggccaaagatgtgacagttagagcatcagtgtggataataacaggaatggattgaaatgcatcgaatatgcttgtctctctgagtccataatactaaaaaattaattggtcacctttgaaggataaatagaagcccatatcattgttttgaaaaattgtaaatagaagatatgagcatttatcctgccttttccatgtactgtatcatgggggatcaagtaatagacggggaggtttttccttatagaagtatcccagctaatgaattaagaagggttgattgaattttaatatcaccacttcgtaacctcaaatgaatgaacagatcaagacattgagtagcagtgctgctgacatcacaaaagaaacacccaggcattattgcctcctgatgggagaatgcactaccttctatgaaattatcttgctaaattaatggaatctgtatctcatgtagcctctacatccaatttacaggagatcagaagacagaagaacatgttaaactacatcatgtgggtacagtcagcaaatttcagacgatgggaaactgcaggtcaaacaacccaggttcttcaacaaataaaatgcaagggaaaaaaaaaagatggaggaggatcctgtagattaagagat

SEQ ID NO: 222417 - DNA, 462 bp, Homo sapiens
gtccacctgtgtgtgccctctcctttgtttccgtgtggctgcaggctggaggaccagggattgtctgtcataaggaaggagttcctacccctgcacatgctaggcaggtaaaggcttgttcccgcttacctgagccagggattcaacaccatgattggaacccagggccttaggtgattgttctttatccagggtttccatcagaaccactgctggatttttttttttttaaatatgggtgcctggcggcctggaaaacatggtgagacattgtctctactgaaaataaaataaaataaattagcaggacgtggtggtacacacctgtggtcccagctgcttggaaggctgaggcaggaggatctcttgagccataaggtcgaggctgcagtgagctgtgattgtgccactgcactacagcctgggtgatagagcaagaccccttctcaagaaaaaaaaaaa

SEQ ID NO: 222418 - DNA, 467 bp, Homo sapiens
gaagagccagataagattcacttccaagtgaagaaataattcccgtacattctaaaaaggtttccccccgtgatttaccacttgagaaatcaacacctctccatcatgaaagtgtatggagcattaaatcggaattggaagatgggattaccttggttttaatcaagcgttcattttcaacttagttttatagcatgaatattaaactccttggtgcgatggaaaagactggactctaacactgatagaaaattaatttgaagcatcaataaagaggccagtagctaaagaggagggaaggaccagtgggggaagacaggtcctgaaaggaatctttcaggtgggggagcaaggagtgacctgtgctaagaaactgacctttcacagacttttaaagtatgttggggttggggaaaatattatagagcacaaaacaaagaaaaggtagggggtgattgttataaaaa

SEQ ID NO: 222419 - DNA, 518 bp, Homo sapiens
ttaaggaagaagaaactcttctctgaaagttaaaagttttaataatgctagctaaaggagaaaatacttggattgatttttttttttttggcaatctaattatattgtaaatcaggtacctaacagttactccttggagcacatttgttcctttacccaaaagatgctgtcagggagcacagttagaagtttgcagaacagaaatctcaatatttttttttattggtgctaaaaacaggtcttacattcagtcagacctgttcaataagttcatcaatatctgataacagcattattttgatgcttaaactttaaacatttatatttaccatttgccacccacaaaggtcaggtttgttatttgttgtttgataattatattaattttcttggaaagatcctcttttcaaggtactggtaaattggtgagtatttttattagtaaagcatgaaatagtatggtaataaatgataagacatgtatttgtggaaagctgtagggtattcagtttaccctg

SEQ ID NO: 222420 - DNA, 487 bp, Homo sapiens
ctctgtgcctgccaggtcactctgaagccccttcctcctacttcattttctgtctcagcctccttcctgtttttctgcaccctctctctttctccctggcctctgattctctgtcttggtcttcatgtagcctgtagcatatgtggccccctcatcaggccttcttctgtcttggtctcagcccctctgcctctaggtgatgagggtggaggccccagctggatagctgggtagctgggtccctaggggaggagctgccaggatttggggaggaaaagtaaaaggtaggccttgcgcgctgccagtctctgcactgcagccccatcctgaatgtgggggtctttcttttcccccagccacccatctcagtcctgcctccagctttgctgtaagccaagtgtcactgagaaattgggtggggggaacacctctcagggacagggagggggcctgctggttgatccatttcaccccccagttgtctggc

SEQ ID NO: 222421 - DNA, 399 bp, Homo sapiens
tgtcattacagaattgatggcttaaggttggaacttataggcaaaaacagatgggtctctcaaaggttgatgttactacaaaggttttcctccaggtgctgtgtcggataaatttttaagagtgtaccttcaactgtacctgaaagctagaaatataaggggaatttatcatatttctgtaaggaatgacaaatacttgctaaaaatagtactcaagtgaaaacagtccattttttaaacatggggctaaatgatggatcttcaagatcttaagcaaaatttttaaaagtattatattcttaatttgctggctgtaaaactcttaagccctgctcattaattattaagaatctggccgggcacggtggctcacgcctgtaatacacagcactttgggag

SEQ ID NO: 222422 - DNA, 1246 bp, Homo sapiens
agcgagaagatgatgcatgtgagccctgcccttgggaagcttccaggttgggaaatgaggaatgagcctgacacccagggcccagagagacccaggacagaggcaggtcaggaggcagacacgcgctgctgggtaatgacgacagcaccagtaatcacggctactccttgttaagtacttactaagtgcaagactccaagctaagcaattaatagaccttttcttgtttaatccttaccacaattccatagggttgagtaggaagtccttcttgaagtctaatctcaagaattcatgccatggattgggccaatgttccacctttattggagtctggggacttaggtggaaaaggcagaactggctggttggaggagccacctccctgcaaggggccaggagggagattacggaggcgccaagcccagagctccaacatgcacctgccacagctccaggggagatcgggggcctgccaatttaccccgccccatgatctcatggctgtgtgcgccaggcactggctcagggagcagcatctcacagagaagatacttggatgggccacaggccaaaactgggccaaaaccctggagagggggacctggctcaaggccacaccacatttccatgtcattttccagtggcaccaactgagctggacagatgttctcacagagctacacatgccacagtcatcactagttgcgagagtctccagtgttcattaagcctattttgctggaagtttagtccctggaggattagtccctgcccttaaggagtgccaaagaagactttggaatctaagtcacatctcccctgctgcaattttttcctcttgataatcaaggaatctcactgataaaactctcaatgaggagcagctctccccatgagcaagttcttgccttcattgccagggaggccccagctaaggttatactgggaaaggaatctctggggagtacctggaagaggtcagcttctcctcaaaggaagcctctccagctggtgtactgcaaagccttccaagaccaagttccctcttcctggcctctggaaccagcctgtgtgccagcgctgtgtccccagtaacacacatgagtctctccctcagaagccacagaaggatgcagagagagaccaacccaggattgattctcagcacttactaattgtgtggacataactgctctggacctcagctttgctatctataaaatgagcaccctttttatagata

SEQ ID NO: 222423 - DNA, 469 bp, Homo sapiens
caaaacaaacaggagttgatgctcatagtcagtggacctacttaagtctgtaaccctagagtaggtattcttaatgagcaccttggtttccttttacaaaacttaaatttgcctctgatagacttacatggttggatttgtgcaaagaaagctaacccccaaaatggctataatatttttatatgggctgggcgcagtggcttatgcctgtaatcccagcacttagggaggccgaggcggatggatcacttgaggtgaggagtttgggaccagcccggccaacatggtgaaaccccgtccctactaaaaatacaaaaattagctgagcatggtggagcatgcctgtagtcccagctacttgggaagcttaggcgggagaattgcttgatcctggaaggcggaggttgcaatgagccaagattgcgccactgcactccagcctgagtaaaagagcgagaccccttctcaa

SEQ ID NO: 222424 - DNA, 170 bp, Homo sapiens
atgagaggcttcgaacatggagaaaaatgtgtttgcaggagggaagcatggagccaatagagagcaaagcatcaaagcatccaagtcaaggtcaggacttaaagtgtctggaccttcctgttaatatgagtcaatgattttcctgttctcctctcgagctatcagcatgc

SEQ ID NO: 222425 - DNA, 445 bp, Homo sapiens
tccactcagagatgaagaagcataggcagcaagttagtgcctatacataatatatatggaaaccaaattcagggttgattctttctttctttctcccttcctttctttctttctttctctttctttctttctttctttctttctttctttctttctttctttctttctttctttctttctctctctttctctcttcctctctctttccctctctctttctgtctttctttcttctcactctgttgcttagtacagtggcgcagtctcggctcactgcaacctccacctcttgggttcgagtgattcttgtgcctcagcctcccaggtagctgggattacaggcatgcgctatgaagcccggctaatttttgtatttttagaaaagatggcgtttcaccgtgttggccaggctggtctcaaactcctaaccacaagtgatctgccc

SEQ ID NO: 222426 - DNA, 436 bp, Homo sapiens
atactctttctcttttcacatccagatgggaggtgctggaactaatactgtaatactgctaggcttttcctaagccaggctttgtgctaagtgatctgatccaacggtgctaaactgttcagccattctgcattgtcccactccaccctcatgttcctcagggtggccctgcaaggcaggtattattgctcccatttcacacaggagaaaactggagcacagagaggttaggtaatttgctcaaggtcacacagctagctcatgggagaggtgggatttgaacccaggtttccaggactcgaaggtccattcgtgctccttatgctgacctctgtggctttcttgtcttatacaaaatctacttcttactcactttattaagttacaggttgcccttttgggaaacacaaaacaaaattttcaaacaacaacaaca

SEQ ID NO: 222427 - DNA, 485 bp, Homo sapiens
ggttgagctgttatgaagctggcactacttcaccattttgacttacagaaatgacagtcttaaatgcctcagtctaatagaacgcacgtcttcttgttcttgggtcagtgctctttgtaaagcatttttaaaagctgactttccagctggcctgtggctctgcagttttagtgtgactgaacatttcaaattattcagtacaagttgttttattcccctcctgggccccctcccatgcctcacatactttgagggccccagtggatcaagtctgtagtaatctttgaagaagcaaaggtagattggcatccccttcccaagcttagacctaggattttctcctttccctcaagtccctacagctctccaggtctcagtttccttgtcttcaaaacaaggagggtatgtgaaagccagcattttcctccttgactctttcctgtgctcctgtacaggttcctcatttagctcatttatttccttct

SEQ ID NO: 222428 - DNA, 297 bp, Homo sapiens
accacaggcatgtgccaccatgcccagctaatttttgtatttttagtagagacagggtttcgccatgttggccaggctggtcttgaacttctggcctccagtgatctgcccaccttggcctcccaaagtactgggattacaggcatgaggcaccgtgccctggcctaattttcaatttataatattaattattttttcacctgtgtaaagttttaatttctcaaattcctaattaaaaacaccttaatgagtgtaggcttttagctctactcattcccaataaaaaagagacttcta

SEQ ID NO: 222429 - DNA, 343 bp, Homo sapiens
cttctgcccccccgaccctgcccctgtcatggcagccggcttgcaaacacagcgttcattggctgccttccagtagaacttcccctccactctagtgtttccagaaccttccaggtaaacagccctgggagaatcccagcaaagacagtactaaaaggccccttcaagcaaagcatcccctctatagggctgccgtggtttctgagtaccagggctgcttacccacctttgagtgatggttatagaggctggtgcgaggctggaagacttcccttcctgggaaggacctcagggtgtgtggctccatccacactgtcctcctggccagccaggcagcaagacc

SEQ ID NO: 222430 - DNA, 444 bp, Homo sapiens
gcacgagaagtcaatactccttaataaactccctttcatatgtatatctatcctattagttctgtctctgcagcaaaccctgactaatccatctatacaggggtcattgggccacatccaggaagaactaccagagaaatcagcccaggctcagtcagctacaagtcccaggactgtggaagccaggggtctccagagacagagcaccccacatctgaaagggctgagacacacagcccttggccgctctaggattcagtgattcccaacgcgtatcctgaaactctgataaaacaatgtgcctctgtctcctgagtgaaaccgtttatggagttaagtttaccagcatctgtttatttggctacactgtgaatgttaaacagtttttagaggttatctgaataactggcacaggtgaaataaaatgaaataaaatgttgtgtt

SEQ ID NO: 222431 - DNA, 471 bp, Homo sapiens
cgagattgtgccattgcattctagcctgggtgacaagagtgaaactctgtctcaaaaaaaaaaaataataataaaataaaataaataaataaataaaaagaagataaaaataaataaataaaatggaagacaatccaatgggttaaaaataaaatgtaaactagctttcatttttacttttcataatcacataaaggaacagaaaatgatggtaacaaaatctttctatatggcttttatgtcttataccactcatttttatttggaaagtatatctttgatgggtttaacatgtggttaaatacaatttctcctgtttcgcagaagtagaagagttgacacatttcactcattttagtgttacaggataatgagacaaacttatttttataaatctctcaaggttgaaatcaacttatattgcaaattctaatacagtagtttctcattgcaccacagaaacagttaaag

SEQ ID NO: 222432 - DNA, 466 bp, Homo sapiens
cagtatataaagatgtaatttgttcacatcaacaactaaaaggagtggtgatggagctgtaaaaaagcagatattttgtatgttattgaatctaagctactataaaatcaaattatagtcttacaactttaggatgttaagtgtaattcctatgggctatggcctgaatgtttgtgtccctcaaagttcatatgccaaaacctaatccctaatgtgacagtattaaaaaagttgggcctttggggaggtgataaaccatgagggcagagccctcatgaatgagattagtgcccttataaaataggcatgagggagcttgttcatccctttcaccatgtgaagatgcagtttgaaggcaccatctagcagacagcgagccctcacaagacaccatatctgttggtgccttgatcttggacttcccagcctctacaaatttaagaaataaatttctgctgttttcata

SEQ ID NO: 222433 - DNA, 455 bp, Homo sapiens
tgagacagagttttgcttagtctcccaggctggagcgcagtggcacgatctcagctcactgcaatctccacctcctgggttcaagcaattctcctgcctcagcctcctgagtagctgggattacaggtgcatgcaactatgcctggcttatcttttgtacttttaatagagatggggttttgccgtgttggccaggctggtctcaaactcctgacctcaagtgatccggtagcctcggcctcccaaagtgctgggtttacaggcatgagccaccgtgcctggccgggttcttttttaatatatagtttctatctttttgttggtattgttattttgttcatatatagtttttctaatttcctttaggtgtggatctgtggtttcctttagctctttgagcatatttaagacaattgatttaaaatctttgcctagtagctgaatcctgtgtttat

SEQ ID NO: 222434 - DNA, 286 bp, Homo sapiens
caggacatcctgtaaatgaatcaccagattctgaaatcagctttgaccaaaatgagaatcacactgtttgtattaaaagcaactggaaagactatcctctcagtgatgatttctatagttcgttactagagaagtttctctaaacatgtagagagcatcagaaaccacaaaaaagaggtgcagcggtctctcctgagtgtgaagctggctcttggtattgcttcttggttcttctcttcctttgggagagtaagaggaagaggatgcagtcttagtagtttccctt

SEQ ID NO: 222435 - DNA, 508 bp, Homo sapiens
cggttgcacatacataactatccttggaaggacaaaagtagaatgaagaaagaggagagagagttgggaatcactgcaaattcttatgtcagcaagcattccgggtattttttagcagcttgttttggtctattgcttgccaaagcactatgaaaaaaatatgtaattgtatttcacaaataattgatataaacatttaaagagtgaatcacaatcataccttgttttatctttttctttctgctttcaagcctctctctttttacagtagctgcatgtttgttctaggctgagtgccagttgtatcaattaaacagtaactaattcaagtacatttgcaatctgtgtttgaaatgccagcccatacagtagttaccaattaagcatgaggcagattaatggatgcattgttctcctgggctaacttcaccacattgtcattaagcatgtaagccccactgaaccaaagacttccatttaaagggaaaggaaaacacatgcttaccaa

SEQ ID NO: 222436 - DNA, 496 bp, Homo sapiens
ataggtaggagtgtctccatttaaaatagagaacataggcagatgtaagatttaaattttgtttacactgaatttgatgtggttgtgtaacatcaacctgagatgaccaagaggcggtggatatatgaatatgcatagagtatggcagagtgatctggactagtgataaatatttgggagtcttcttcatatgaaaactaggagcggggaagaaattactcaaaggataaggtcaaaagagtagcgggccaagtatagatgcttggaagcattgatattaagggaaagtcggaggaggccatgaagaagatgggcaagtgccagaaggatgtgagaccgcagaaatcagaagggtaaagttttaggaagcagggacaaatggataaatgtcgaatgcagttgctttttagtgagaaaagaatgaaaaagtgtcattgatagtctcaattagaagataattaattggtgatttttgctaaagcgaatatgttgagtt

SEQ ID NO: 222437 - DNA, 429 bp, Homo sapiens
atgttaaaaagctccattttgagctgagcaaagagaatttaaattaaaacaaggaaagggagaaaatgcagttttcgaattcccatgccaaatcagggactgcatttaccaagtctaggcctgtaaagggtaaaatgtctgaagcttcaggtactctactactaagcaagtcaaaacctcagaaattctgttgaacacctcacaataatcaattttaaaacttttattgagtgcttactatatgccagcaggctaggggctttaaatgttattccagttgatccttaaagcaaccctctggaggtatattatctctgtctaagaaactgaggcttggaatttcaatatgagctattgttcacatagctaataagtgacaaaacagtatttgaagccaaagtcaatgccactgtcggtacattgtggctg

SEQ ID NO: 222438 - DNA, 168 bp, Homo sapiens
gagagcaaaggaggttaggatgaatcaagaagtttgagatgtctggaaaagatttggaagagggaagaattaaagggatagtcaatctggggcaaataaaatgcctgctgggtaacacaaagaaattaactaggactgaatggcatgaattcttagtggaagtgatca

SEQ ID NO: 222439 - DNA, 487 bp, Homo sapiens
ctccctctaatatctctctctcttttacccccattccccaaccattcttctctccatccctctcctctcctcttcctctctcttctctctctctctctctctctctgtctctaactctcgctctctcttgtatgtgggtgtgtgtgtgtatgagtttccactgtggattatatacacttgctagagaatattcatttcttttttttcttttttcatctgatgtatattcaaacattgttctttataaccatttctacctcattgctacatattgtacatgtagtatttatttgttgtctttttttgaatgtcatgcatttcgtaagaaaaagacttgtccttgaacttgaacagtctacctcagaaagactgtctttacactgaacagtattagcaacctaaatgataagacgcattagtgaagtgtggcagggtagataatgcacgagtacttgggatactgatggacttttaattgtattcataa

SEQ ID NO: 222440 - DNA, 252 bp, Homo sapiens
tattttttttttctgatattttaagctggttcatgtttttacgttaacactttcggttgtattgtgtagcagagagtcccaacaaagtgagaaaacataagtgtgacaattccactattaacccacctatccaactggcaaaagtcacttggcttcagttttcccatctggaagactatgccaatggttgtacttgtggtgaagttgaagtgaaataaagtttttaaagtggctgcaaaaataaatactgca

SEQ ID NO: 222441 - DNA, 557 bp, Homo sapiens
gtgtggtatatacactatgaaatattattcagccataataaaatgaaatcctatcatctgcagcaacacggatgaaactgaaggacactatgttaagggagttatttcacttaacagaaagacaaatattccatgttctcacttagatgtgggagctaaaaaattaatctcatggaggtagtgagtagaataataattaccagaggctgggaagggtaggggacagagcagagggcagcaggttggttagcaaatacaaaaatacagttagacagaaggaataagttctagtgtttgatagcacagtagagtgactacagttaacactagtttattgtatatttcaaaatagctacaggagaagatgtgaaatgttcccaacacaaagaaatgataaacatttgaggtgatggatatcccaactaccctgatttgctcattacacactgtatgcatgtatcgaattatcacagggaacccataattatgcatagctattatgtatcaattcaaaaatcagtgaaacaactgaaacatgaatcttaaaccaacatcac

SEQ ID NO: 222442 - DNA, 395 bp, Homo sapiens
tgcgaaggcaactccacgtgctcagagaacgaggtgtgcgtgaggcctggcgagtgccgctgccgccacggctacttcggtgccaactgcgacaccaagtgcccgcgccagttctggggccccgactgcaaggagctgtgtagctgccacccacacgggcagtgcgaggacgtgacaggccagtgtacttgtcacgcgcggcgctggggcgcgcgctgcgagcatgcgtgccagtgccagcacggcacgtgccacccgcggagcggcgcgtgccgctgtgagcccggctggtggggcgcgcagtgcgccagcgcgtgctactgcagcgccacgtcgcgctgcgacccacagaccggcgcctgcctgtgccacgcaggctggtggggccgcagctg

SEQ ID NO: 222443 - DNA, 467 bp, Homo sapiens
agaggcttagagaggtgtagtgacttgctcagagtcctcgctgtagcatggggtaaagccaggatatgacttcacatagtttaactccagaacttacactgtcatcttgttttgtttttctgcttctcttgtgtgtcaaaagaattcctccttagttgttctcatatggggcaaccattaaattaggcagtgtaaaaaacaagttatgcagaataaagtagcaagagcaatctactctgaaattagtgttttccctcactttagcacctttagctgacccagcttcctaccgcccagacattttacaaaaatctctctctggagttgcctcctgatctggattaggagtcacataagaaaatcagtctcatgagtccatcatttttcctcatttctgaccagaagtattctgccccatttgcttcaccttacttatttctaaatcactctagctcatttaaacaaac

SEQ ID NO: 222444 - DNA, 429 bp, Homo sapiens
gcttgtacgtttattatatttccagacagatgagcccttttatcgttataaaatgtccgtctttatctttagtgagagatcttgtttaaaatctattttgtatggtattagttgtcttatggctgtctttatgcttggtatgggctttttacatcctttagctttcaaccacttaagcttttgaatctaaattgtgtctcttttaggcagctcatattttgaccattttttaataatccattgttcagtatctgccttctgattgaagtgtttcgtacatgtgtgtttaatataattaccactaagagaggatttacacctactgttttctatttgttttccacatgtcttatgtcttttttgttcttttatttctttattattgttttattttgtatcaagtaaatatttttaaaattaccattttaa

SEQ ID NO: 222445 - DNA, 445 bp, Homo sapiens
gaggaacaggaacagaaatgaagctcagttgtctcagggaggaggggctcttcaggaccaagaaagtgcccattctgggtttctgctgcttctctcctccacctgggggggtgtgagtcatggcttgtcaggctggtgggccacacacaggttccaggggtacaccctcctctgaccttggaaatagaagggaagaaagcaatttccctcacagtgctgaaaagagaagttgagtcataaagggaagaaaagcctttcttctgctgagtaaaggagagcattcctgcccagttactgggggtggagagtctctatccattcctgggggccaccccagaagggggccctagctctggggcgggagcagctttgagggctgcactctaaataactatgcagctctagaaaacaaaacaaaacaaaataaaaaaaatgaaataactat

SEQ ID NO: 222446 - DNA, 480 bp, Homo sapiens
gttatttagcaatttcaactttgctggaaggaataaatacattggtacaatcattcctgagatatgttttaaattctaacttacataacttattgatgaagaagagttgattaggaatagacttctatcagatatcgtgtttattatttttacataacatgttatttatttttatttatttttttttgagatagagtcttactctatcacccaggctggagtgcagtggcatgatcttggcacagtgcaacctctgtctcctggattcaaacgattctcatgcctcagcctccccagtagctgggattacaggcatgtgccaccacacttggctttgtgcttttagtagagacggggtttcaccatgttagccaggctggtctcaaactcctgacctcaagtgatccacctgccttggcatcccaaagtgctgggattacaggtgtgagccaccacgcccagctaattttcacataacat

SEQ ID NO: 222447 - DNA, 343 bp, Homo sapiens
aaatatttcatttttgaaaatccaaaagtgaaattaaggatttcatttacaatagcaaaaagaataaaaacagaaatacctttaacagtagttgaagatgtgtacactgaaagtgacaaaacatgactgaaagaaatttttaagaagctaagaaaaaagggtggacagcccatcttcatggattgggaagacttaatactgttaagatggcaatacttctcacattagtctatagattcaatgcaacccacatcccactttcctttactgcagaaattgacaagctgatccaaaaaattgtaaggaaatggcaagggatccataatagacaaaacaattttga

SEQ ID NO: 222448 - DNA, 540 bp, Homo sapiens
tgttgaagagggatcttcaatgtttttctgtaaacagctctaatttattgattcaatttgaattttgtgattatttcaagttatttaaatcaacgtttgaattatatgtttgaagttttcataaaataggttaaatccacaagataattagaagacacaatgttcattttgtttttcatacagtaatatatctttttgatatctttaaaaatttccattttgtaaatgagttagtaacttagactgtcaaatatttcaggtcatattaaactttaaaataaggctggacacagtggttcacaccttaatcccagcactttaggagggtgaggcaagaggatcacttgagcccaggagttcaagactatcctgggcaacatagtgagaccttttctctaaaatttttttttttaaattagcctgacgtgatggcatggctctgtagtctcagctactctggaggctgaggtaggagaatctcttgagccccggagatggaggctggaggctgcagtgagccatgatcatgccactgcactt

SEQ ID NO: 222449 - DNA, 237 bp, Homo sapiens
aaagacagaaacaaaggagagagctctcaaatgagttcatttgaacaatgagcagagtaatgggtgttctcatcaatattctattattttcatcattatcttttttttttttttttggagacggagttttgttctgttgccaggctggagggcgggggggcaatctaagctcactgcattctccacctcgggggttaaagaggttctcctgcctaagcctttaaggctatcagcagg

SEQ ID NO: 222450 - DNA, 482 bp, Homo sapiens
ccgggctggagtgcagtggcacaatcatagcttactgcaacctatgcctcccaggctcaagtgatcctcctcccatctcagcctcttgagtacctgggactacaggcccatgctaccatgtccagctaatttttgtattttttgtaaagatggggcttagccatgttgcccaggctggtctcgaactcctgggaagcaatctgcctgcctgcctcggcctcccaaagtgctgggattacagatgtgagccaccatgcccagtcctgcttccttttatctcaaggaatcagtatttaggaaacagtatttaggaaatactgtttaggaatcagtatttaggaaacatttactaaatgttaaatgtactaactcctcttcatccctttcctaacagctgcttcttatcacctctgagaaatgaaacaaaaaaagatgagatacctccacagcctaagaatcctgtcatgcttgttttctttgca

SEQ ID NO: 222451 - DNA, 552 bp, Homo sapiens
caagagcaaaacgccatctcaagaagaaaaaaaaaaaacggtaattggtttttatttacttaagaaacccgtgtttttgttctagaattccacttagtgctccggcctataaaataatgtgtatccccaccacctcccagcccaccccctactcgtctgcattcacctacacacagttaaacatgcacatatgtttccgtgacacgatcttgctttgcatattgttcactgattggcttttccatataagatttaatttggtgattattgcttatcagtacctataggtctctctcattattatttataattacatcattattccatagggtattttaccacaatttggtcactttttcactgaggaatttttatgtcagtttcagttatttgttattgttaccaatgctgtactgggcatccctgtatatccacctttttgttgcattagttaagtggttttttccttttatgattgatttctaaaaataaaatactgcagcaaatgttaatgtttaatattttcataaaattaaaaatctgtgttccaaa

SEQ ID NO: 222452 - DNA, 567 bp, Homo sapiens
agggtctcagaagactcgtaagaagtgtcagccagtcctggaagaccacaccaagacttggtaagtcatttatactgacatgttaaaaccctgaagatgactaatctattcaaaacttggaaagatacattaattaaaatgtgcatgggtgttttatactacaaataattaacgtctcatttgttaattgtcaagaagctaacatttttggattctgaagtccgttgttcccacagttatatttcagataactttactgtgtttaggtacagttcagtaagagatctacttacgtaaaaggaagttgtttaaaagaaaaatgtgtgttctgtcattgttgagtagaaacagtagactttgtacttcatgtttccaaagcatataaacagaccattgctgttggaggggataggatctaacttttcatttgacgctattattttaaatgaaccagtgttatactgcagcttaacagctacattaaggtcttttactttttttctaagcttcagatcaccaacatagttaaatcaccatagtgatgtaatataccactgccgttattat

SEQ ID NO: 222453 - DNA, 401 bp, Homo sapiens
aaaacaaatagcaagttggtagacttaaatccaactatattagtagttatatgagatacaaatggaccaaagacttcaattaaaagacagagactgtcatactaaattaaaaaaaaaaaaaaacgaacaatcaccagcctgggcaacatggcaaaacctcatctctacaaaaaatatataaaaattagctggacatggtggcatgcacttgtagtcccagcttcttgctggggctgaggtgggaggatcacttgcacccaggaggtcaaggctgcagtgagctgtgttcatgccactgcactccagcctgggtgacgaagtgagaccctgtctcaaaaacaaaattccacagtatgctgtttacaagagacacactttaaatacaagggcacagaaaactt

SEQ ID NO: 222454 - DNA, 288 bp, Homo sapiens
agcccttggatcttttcctcgggctgctaagaataacactcgggggtgggtcaattgacctcacacaatttcccagactttttgttgggaacaacacaacttgttgttgttgttgttgttgttactgccagaaacacgttagaagtgttaaaaagtggctgggcaggtgattcatgcttatattctcagcactttgggaggtcaatgtgggaggatggatggcttgaggtcaggagtttgagaccagcctgggtaatataacaagaccccatctctacaaaaaaataa

SEQ ID NO: 222455 - DNA, 380 bp, Homo sapiens
catggtggctcacgcctgtaatcacagcactatgggagactgaggcaggtggatcacgaggtcaggagattgagaccatcctggctaacatggtgaaaccctgtctctactaaaaatacaaaaaattagccaggcatggtggcaggcacttgtaatcccagttactcaggaggctgaggcaggaaaatggtgtgaacccgggaggcagagcttgcagtgagccgagatcacgccactgcactgcagcctgggcgaaaagagcgagactacttctcaaaaaaaaataaaataataaataaataaatggatatggaaggtaggaaaaagcctttaaaaatgctgtgtaaatcataatcaacgtgctacaggaattgtaagga

SEQ ID NO: 222456 - DNA, 415 bp, Homo sapiens
tgctgcatcagggaagcgacctgccccaggtcacacggcaagtcggtgccagagtccacgctcctgactcggctggggacttgtgcactcattttcctctgtgggtgcccgccccccatgtccagaggtggggaaccgagggggaagccaccctgtccctgttcatcccggcctgtgagcaagccccaggcctgtggaggccagcggggagggtcacagcatcgcatctgcacccctcccccttctccttctacaaagagagaagaaaaactggcagcagctggggcgatccgggcaggaggcaacgtcctcctcagggaggggtcggggagagaactgggacctatcagccaagagcgacaggggcccgctgagacgcaaaaatatttagacaataaatgaagtatcggaaagg

SEQ ID NO: 222457 - DNA, 422 bp, Homo sapiens
gtatagtgacaacaataaaaagcctagaagataagactttgtttcaaaaaattcaagtatttagtttggacagaaaactgctgtgtgcttttgaaattttggtgagacgaagcatggtggctcacttttgtaatcggcatcttgggaggccaaggcaggaggattgcttgagcccaggagtttgagaccagccagggcatcatagtgagaacctgtctttacaaaaatgttttaagaattagctgggagacgtggcacgtgcctgtagtcccagccactctggagcctgaggcaagaggattgcttgagcccagaagttcaaggttgcagtgagctatgaacatgccactgcactccagcctgggtgacatagggagacactgtctcttaaaaaaaaaaaaaaattctgagctaggtgcggt

SEQ ID NO: 222458 - DNA, 622 bp, Homo sapiens
taataaaaagataaaaaagacttgaggacactgaagagcaaccaaaagcaagcagaaaccagacggagtctatacttagaataaaggaatggtattgagtgagtttcccaatttttaaggctttttgcctgaaaacagtccccatcctatgcctagtgaacagcaaaatatcaatagaaatcccacagtcttactgacttatagaaccagaatacccagttcaaggtgaaaacagcagctggaaagtgatgggaaagtttccgcaagagttgagaaaaggaatcctaaatacttaatattaattctacacaaatctctcactgacccatgaagatcgtacacatggggcagcctccaggcagcccagctaaataaaataactgagcagatattcctgctgcccattgtaggagagacagtttggagtttgagtacaatgaagttaatcaacaactgtcttagtcggcttgggatgccacaaccaataccacacagacttggtgggataacaactgaaacaaattttctcacagttctggagactgaaagttcaggatcaagattccaggagggccagtgtctgatgaaggctctcagacagctgcctcctcactgtgtcttc

SEQ ID NO: 222459 - DNA, 250 bp, Homo sapiens
cgaagcaaactcttaacaacaacttcggtcctgactgttggtgtggtcatctagaggccaccatcagaatcactcatttcctaaagacagggacctcagggtggaaagaacttcctgggacaaagctgtgaagaggctgttagagcaataaactcagctcccaaccaaactggttttgcagggctgagtggagagaagcattcactcatgcaccccaaatatatctatggcaccccttctgagtcaggtt

SEQ ID NO: 222460 - DNA, 458 bp, Homo sapiens
ctatgtttgtaactccatatcttgggattttctttttattattttaaatttacttcctgttaactattgtttatattcagttccctttgtttaaataactgatgcactttctctctcttctgtggtttgaaggtttgtgtccccttcaaaattaatgttgaaacttaatcccgggccaggcgcggtggctcacacctgtaatcccagcactttggaaggccgaggtggatggatcacctgaggccaggagtttgagaccagcctggtcaacatggtgagaccctgtctctactaaaaatgaaaaattagccaggtgcggtggcgtgcgcctgtagtcccagctacttgggaggctgaggcaggagaatggctggaacctgagaggcagaggttgcagtgagcagagatcgtgccactgcacaccagcctgggcgacagagcgagactcttgtctcaaa

SEQ ID NO: 222461 - DNA, 640 bp, Homo sapiens
ttactgaggtgtctcttccactaaaatagaagtttcataagaggaaccaaatctctaagcatctggcatggtgcctgcttcatacaaggtgtacaaaatgctcgtcaagaaaaagtcaataggaaataagttgtttcctttcagaagtaaaatgctcaacactgtttgcttagatagtatatctacaaagtgagtccaaataatttgggtccaaataactgctttaaagcaaaaaaaagaaggaggaatgttagtttgaatttaactatgttagtattatgtattcattttctattgctgtatggcaaactaccacaatcttagtgacttgaaacaatgctcatttattagctcacagttctgtaggtcagaagtccagcaggcatgaatagattctctgcttaaggtatcataaggtcaaaatcaaattggtggccaggctggtcttatcaggagtctctggagaagaatctgcttctaagcttattcttttttttttgcagaattcatttccttgggattgtagaactgaggttcctgtttccttgctggccatcagccaagcactgttctcagtttctagaggtcactcgcagtctttgacacatggccccctccatctgcaaagctctcagtgaag

SEQ ID NO: 222462 - DNA, 490 bp, Homo sapiens
cctatgattttggtttacacacggttttggtttggcttagcacgagttctggcttagacttttactaacttttcagttcatgttcctacaatatctgatagatatatcatgttagtctcaccagtcagtatattgactagctttggtttgggtgtacattccagcctaatcagcgatggctgccagattgggggtaaaggtgagatcaaatggggataagcacagttgcctaggcttgcttcttccactggcttggggttagagcatttttcaaagaaaggaactgtggataccccaaaattatctattatagagtggataataaaaatacacaaatatttttgagtgactttcaaataaatcataaaacaacaaggcattgtgactgcctataatcccaacactttgggaggctgagatgagaggatcacttgaatccaggatttcaataccagcctgggcaacatagcaagaccccatctctagtaaa

SEQ ID NO: 222463 - DNA, 578 bp, Homo sapiens
tctagaatgacagcaggagtccagtcaagaggtcctgtcaggccaaggccagaaagaagggaggacaatccctggggccagatgcccagtgtgaggggaggcatgatctgtcccatggctgtggccactgcaggaaggtctgtgaaaaggaggtgacaggccacagtcacctcctcttcacccaagtgattgctccttcaactgctatctgtgaaaatagcctttgttatgaagaaattgactctctctctctttttttttttttggagttgcctaggctggagtgcaatggtacgatctcagctcactgcaacctccacctcccaggttcaattgattctcctgcctcagcctcctgagtagctgggattacaggcatgtgccaccacacccggctaatttttgtatttttattagagacagggtttcaccacgttagccaggctcgtctcgaactcctgtcctcaggtgactacccgtctcggcctcccaaagtgctgggattacaggcatgagccaccacacccggccaaaaatggattctctatgtcataaattaaagaaatctataaatgtat

SEQ ID NO: 222464 - DNA, 543 bp, Homo sapiens
tgcagccactgggcctggaacatccagtccccactggtggacaggcacttatttggaccatgtgcctgtctgcctatgtctgatgtgatctccttcaggggcctatgtttgcctgcagcacggaggccctgcagacgtgggctgaggaggggtaagggaggacccttgaaatctatggctcctgtattcgtcccttctcacaatgctgtaaagaaatgtggggactaacaagagcgatgccatttctctacattggtgactgttttctaccttggtgacggtgttcccagaaacaaagcaggtgtcaaccttgcccatacttttaatagagcataacaaccctaaccacaacagagcctgatggcccttaccacatccttctccagcccccaacagttccaacctgccagcacttacgcaaaccctcccctatagaaactttattataaaaacctcagtttctaagtgacagggtctcagccacattcctgactgggacccctcacaggcttattcttgtaaataaacctgtttggccatcaa

SEQ ID NO: 222465 - DNA, 481 bp, Homo sapiens
agcattttcctgtggagctagcatgaatatccacacagttgttaaacattggcaaccgcatctctttgagcacattaaaatccacaacacctggagtctgaaatgctcacctattgtaagacgcacaagctttttctgtgagggttggccactgtaaaagtacagatcaaagagacgttccattttccagtctgataagagctgcctgtttgtgcaaaaaaggatgctgtaatttccattgatgttgcacagccaaataggtaatttgggagtcttcagcatgctgcccacctggaaaggggaaggggaatgcagataaatatatagattttgccacattgtgacacatgccgatacatgatcgcgaccaaaaagcagctctgaggtttcttgttgcacttgtcgcgtgcagggcactgtacatagagcaagatttgaaatcaaggcttcgtcatgaataaatttgcatttatgaatgatc

SEQ ID NO: 222466 - DNA, 924 bp, Homo sapiens
agttgcaaattaattgccaggctgttttccttaagtaaattcatgtgccgtgtagaaatatgcagatatgcattacacaggcacacacagagagatatttaatatgtggaatatcactctttcatgagctttattccttgattaatttgataaagcctcacagaggattttaagcaatatttaaatgtgttgaggttatgtttggatattcctgctgcctcttttcattcatttcaagtcattcttcagctagctatgggctgccttattgctattcgctcactgcttccatcttctgcccaagtgagaagaatagatgaagaacagaaatttctctgtgaaatgtggatacccgaataatttcataaatcattgattctatgtggtggtttttgtcttcttctgtggtgaatcttcaaaactgtattcaggactcatatttctagagttttaattggggtcctctattgtcaattgtagtagtgaccagagtatcgtggtttttgccatcagataattaaggctctggtgcataatttagactttctaagctcctgcctgaagaataaggtcttccataatatggaagagaaaagttatatttcagtgtaaatccaagagacccatcttctatgagaggcttaccagtgcattagtaataaaacattagcaatttagctagagcactgagattgtataatccttgcatggatgagcagagctcaaagccagttgttcctttaaagcatttaatgcaatggctaatgtttaggattaaagtttttattttatcctataagataattaagtcctaagtcactacaacttaagtagcttaactgtatgttggtacccaaactttttctataatggttaaggaggaggcacttactgagtttattttaaagttatgctagaaatgtt

SEQ ID NO: 222467 - DNA, 141 bp, Homo sapiens
tctgatagtgccaaacaaaaactgagaaggaaagaggatagtttctaaagacaaacaataaaatagtattattccatcacgcctagagatcatatcctaacctgaagctctaatttacagtacctattaaattaaatggta

SEQ ID NO: 222468 - DNA, 473 bp, Homo sapiens
ctctgccctcaaaccactatcgccgtgaggatgacgatgacaatgacgatgctgatgacaatgatggcctgtgtgcaacactctgctggccttcccagaggctctaccaggaatcccccacagcctgggacttctgctcctggaaacagttaaggctttggcaagaggctctcccacaaggcaattcgatctcccctgtctgtctgtgagggttcggggcactgctgtggcacgccagacgcagcagctactttctgtgaacagcctcctcataaatgtcagtcctgttggggggtggggagggggccttgatttattatatagcttttggacagttcctacagaaatattgccaaacagtggaataatcaactctttcactcaagccccctcagactttttttaatgaaagaataaagtacgcaatgagcctgagctaaataaataaaaatgccacacttttgcccaacaga

SEQ ID NO: 222469 - DNA, 558 bp, Homo sapiens
aatgcttagatataatgcttgctactatgaaaacatgttagatggtagaggtacgggagggagaatgaaaaaaaatgacatgtataagaaagaaagaaaatgagttacatatgtgtatacacacatgtatgtatttatattcatatcaaaataaggaagaaatattaatgattatcatttcctttctgcaacttgaaaaattgtcatagctgatacttataatgaccattttccaatataccttttatatcccctatgacctgggtaagcaccttgatgggtgatgcttccttgctttgtagggtgacctaaatctttatttttgaaggtgtagtcattagaactgcggcctctattgagtcattctagtttccactgactttaacgactggacatgggagttctaagcaataccctatgaaatttcctgaattcaggaatactcttccttatccccaatgtgtagtagtaacccaatttttcattgatattcactcaatttttcattgatattcgagatcaatctagcaaatacaataaatctcatttttgcctgtc

SEQ ID NO: 222470 - DNA, 502 bp, Homo sapiens
gacgaatggatttgctttgctgtagaggcagtggtgagagcaagggagggagacctgagcaaccattccctcccagggtggagggaatgagagtgggtgtgcatgagggagggccctggaggaccacctaggccaggctaggtcccttggactggacttgaccttctcctctgaccacccagagcacgtgcccacctcaggccctcccagctgcaggccatgtttaaggggactccgccatcgctccaattgttctgattagagaagcaaaaacaagccaggtgttaccacgaaatggtctaattagcactcactgctgactatttcttttttttttcttttctgttttaaaccctggacattttttattcactaatcatctctcagttcaaccagtgcagagccgcacgcgatttaccttttgatgttcgcagaagagaactcttgaatttcaaagagctggcagggatttagcagaattgaatgcagaagctacagccgt

SEQ ID NO: 222471 - DNA, 2170 bp, Homo sapiens
  misc_feature (2038)..(2038): n is a, c, g, or t
ctacacctggcttaaatgcatttttataattttagtataaacaagacattttagattgaataactttgtaatgtgctaggacagtagtttttaatgcaggtgggatccaacttttgagaaagggaaatgtgaaggttgaagaaacttaaaaatcaactgctgttggctagatctaggtgtgctgacttccttagaaaagaaatgcttcctttccctgcaaaccggagtttgggaaatttagagctaggaaatcatgtggtcgatcttaacgttataaatcactcagacaaatacaggataatgctgttttcggaagtgcttgtgattgtacaggattacatggtgataaagagttttcaatggctcctccagtttctgagggagttctgtgctttgctttcttggtaattccttctgcagaccttagagcctttgaggggggctgggtatgcttccgtgaatttaacagtttaacacactgttgaatagaagagaatctgctattggaactagtgattactaagaaaccacttctatatcatccagcatttgtatctactttaaagtacatattagtattttccttggtttacagatgaggaaaatgagttaggtaccgtgtttaaggtcacccatctgaaaagtggcagagaggggatttaaactcctggtcatctgaatctaaggtctgcttagaagaggagctgtttgcttctagacacatgcgtatttaggttgtgggtccacggactaatagcgtgggcatccctgggatattattagaaatgcagaacttcaggtcccacccacacctgattgcagatctgtgttttaacaaggtctctagatgattgcaaagcactacggcacagggacacttccccagaggaagtgtgatggccgccctccaggatatcatcttccaaggttagggacgtgccaaatatcccaagctttcagatatgcgactcaatcatctctaattatcctgctcaaccaaaaattaaagagcgattcttccaagtggaatcgagggaaacttttctcctggacaattctggagggagtccagctatccttaaggagatgcacagaataggctgttgccgacagcatgcttggaaaacctatcaacccggggtgcctcttccacggctgctgtccatgctatactttctcccattactgatccctctgaactagtctatcaaaccttctcctaaagagggtgagaacagattttgtcaggccagagaggaagaaagagatccagaatggggacgatcaatagcatgaaaatagagaagggcattgaaaagagcccagccttcagaacactccagtcctggcgctggagaactgcaccttaccttttactcctacctggttttccttttagaattcccccaggcatctatgctggagacagtagtgtctttgtctgttgttcccatccctgccttgctcctgccatttccaacgtcctgtgagtatatcttcacaggactcccccttccttttcacagtggccaccctagtttggatgtgcattgtcttacactgggaacattataagcgtttcttaagtggtcttcactcttatcccccggtaattcacagaaatagcatcagcgcaatcatcttctagtaacacggctttgcatctgtcactcttcctcaaaaactctcagttcctactgggaacagtctaaagaccaaaatgcattacggtctaaattaaaccaattactggttgcatttatccaactctattttccagtagtccttctcaaataaattccgtgagggcagcctacatgccttgttcctgctattagctcctagcacagtgcttgtacacagtggattttcactaaatattgattgaatgaacgaatgaacttattctcaggtttatgttttatagtctgcctagaatacactccttggtcaggccatttcctgtgactagatttcccttcccttttttcctgttcatctgaatccttaaaaaaccaagtaaggccgggcgtggtgntggacgcctgtagtcccagctactctggaggctgaggctggagaatggcgtgaacctgggaggcggagcttgcattgagccgagatcgcgccactgcacgccagcctgggtgacagagcgagactccgtctc

SEQ ID NO: 222472 - DNA, 555 bp, Homo sapiens
tttattaggctatttctcaaggaatagattttattttattggttttcacgttaatactgtttttccctaacaattgcattttattagaaaatttttcctgaaaacttaatgtttgaaatgaaatgcacatagagtatggcatgatgtgactaaatattttcctttattctcttaaatttttaattgttttccattgctcattataaactggtccagttaagctactggaggctggtttgacatacctgttggtgttttaacttttttttttttttttggagacacaatcttactgtgttgcccaggttggagtgcagtggcatgatcatggctcactgcagccttgacctcccaggctcaagtgatcctcccacctaggcctctcaaagtgctgggactacaggtgtgagccaccatgcctggactgtgtttaactttttacctttctattttttatgattttttcttgcaggctgacttgaagcaaaattggcagcaagatcctcctgcctcagcctcctgagcagctgggcctacaggtgcatgtccctgggc

SEQ ID NO: 222473 - DNA, 403 bp, Homo sapiens
ttttaagtttttgaagggaaaaagctggatgaggcagtacagaagagggaagaggaaaagagaggagagagaaagagcaagaggagaacgagaaggaataaggaaaagaaagaagatgaggaggagcagctgcaaccacgaccatatgtggcctgccaagcctcaaacatttactatctggtcatttacaaaaaaagtctgttgacttctgctcttgaagatctcattctgcctcattcctttaacatcatcttaagttgatgcctttcaaatggatacttctagttctgacctcaaccatgtacttacacatatccaatctcttagtcaaaaacagactcgattataagagttatctccaacttctggtgttcaaaattaaatctgtgataactcccttata

SEQ ID NO: 222474 - DNA, 454 bp, Homo sapiens
gagaggaaacatagtaacaacaaaacaaaaacccagcttagttcttgagtaaattaattgaattcctcacactagcagcttagtagaaaaagtgatatgtctatttgcagtcacaaatcttagtctctactgttctacataggatgtccaccattcaaccaaaaattacaagatacaagaaaagcaagaaaaacaacccactgtcaagacacaaagccaataacagaatttgattcatatgtgacccaaatgttggaatttaaaattcattaaaaaattccttaagacaactccagtggtaaagatgaaaaatttgcatgaacaggtagagaatttcaacagagacagagaaactataagacagaaccaacgggatggtagaatgtttttttaagcatgaccacagaaatgaataatgtctatggtgggttcctcagtagactccacaactaag

SEQ ID NO: 222475 - DNA, 355 bp, Homo sapiens
ttgtttgaggtccttatatattatttctagttattaatctcttgtcacatggagagtttgcaaatattttctgccattctataggctgtctcttcactttgttgattgtttctattgctgtacagaaggtttttagctgatataatcccatttgtccatttttgctttggttgcctgtgcttttgaggtctgtcttaggaaatctttgcctagactaatgtcttgacatgtttccccagtgttttcttctaggaacttcataattccaggttttagatttgagtctttaatttttatttgagatctgtgtgctgtgtacgaagtaggtatcgataggtatacacgtccctcgtaa

SEQ ID NO: 222476 - DNA, 220 bp, Homo sapiens
cgggtgcagagtagcaggagtgttgaagaaaaaaaaaaaaaagcgctaaggttttgccaggagagtatgatggaaaaaaaagggctcagaagtgccctacactgaaaagctttaatatatagatattatagcttcatatctaccaattaatctgatgactatcatctaccttataaaatagaaaagaagactgggcaaggtggctcatgcttgtaatgcc

SEQ ID NO: 222477 - DNA, 315 bp, Homo sapiens
gcacgagaagagaagaggatcaaagactgagccctgtgacactccatttacaaagctgcagaaaagaagaaaaaccagaaagggagactgagaaagaggaaagaatggagagggaagaaaaccaagaaagtgaggaatcctggaagacaggtgaagaaagtgttcaaggacacagcatggtgttctactgtcaaatgctgctgctaggtcaaataacaattgaccttttacccttgaaaagtcaatgaatccaggagctggattaatttgaaaaaaattaacaaaatagatagaccactggctagactaatacag

SEQ ID NO: 222478 - DNA, 442 bp, Homo sapiens
gcttccattttggaagctctactcattcagggtgaaaccgtattgtaaaatgccctagggaaggtcagtgtggcaaggaactgaagcctcctgccaagagccatgtgaatgagcttgaaaaagatcctccagcccaggccaagtcttcagagaccacagcccacttcaacatcttggctgcaagctcatgagaaaccataagccagaaccacccagctaagcagtttctggagtctcaactctttgaagctgtgaactaacaaatgtttattgttttaacctatggagttttggggtaatttgcaatgcagaaatagaaaactaatacaggtctccctctagttatattgtgctactttcacggttcaaaatcaggctacttcagtactagttttaaaaattattttctaaaaactccctctatcggatctacctgggtaaa

SEQ ID NO: 222479 - DNA, 444 bp, Homo sapiens
cattgttattacttttaaaacatctagactcacataattaatttaaattctgaatgttcaggaaagtattaaaaatctttgtgcctccgccttctcatctatgtaacttataaaagcagtagaaattagagtaaaattcagagcccagggcctgagacggacagatcacgaggtcgggagttcgagaccagcctggccaacatggtgaaacccccatctctactaaaaatacaaaacttagccaggtgtggtggcgcacgcctgtagtcccagctactcgggaggctgaggcaggagaatcacttgaacctgggaggtggagttgcagtgagctgatatcatgccactgcactccagcctcggcaacagagtgagaccactgcactccagcctgggtgacagagtgagactttgtctcaaacaacaacaacaaagacaaaaaat

SEQ ID NO: 222480 - DNA, 574 bp, Homo sapiens
ggttgtggagcttctccccttcagagagtccctgatctccgaaaatttggttgagatgtaaggttgattttgctgtacaactccttttttgaagttttactcatttccaacaaggaaggcaagttttcctgcttccattgacaaaggagagcaggcacctcctttcctgagtttcagcttgcttctgacagggaaggtgagtgtaagtttttccagcttctaagatggcagagaatgatcacccagtctgagccttatttccaggtaagtagctgaattagagttttgtcttaaaatttttgtttaatgactaaaatttaagattacccaccagctgcttttaattcctccttaccattagaacactcagttaatcatatgaattgtgcatttgtttgttttgcttaactctttttgtttatgtttggggttttattgttgtttcacttttctcccatctcttcctgacttggtcaaatccaaaggaatgttccaaattgtggggagcaaggcatctgaattggctaaaactcctgtggctgcaaaacaaaaacaaaaacaaaacaaaaaaaaa

SEQ ID NO: 222481 - DNA, 353 bp, Homo sapiens
aaaaaaaaatcgccagggaaattatcagaataaatttgtcagaagatataggaaaaatgataatgagtgtgttactccttgactactttattttacacatgtatgttgcttgaaaaatacttcaactgtgacatttagtttttaaatgttatccatgattcattgctaaaacgactattcttttactataaaagtgagttcagttcatatattagggttaattttatataatatggcacagagggctactgtgtctgttactcagtgtaaatcttggtattgctttttaaataatgaattcataatgcaaaatatgcaaaaataaaaccagcaatattatttttgtaaaaatt

SEQ ID NO: 222482 - DNA, 613 bp, Homo sapiens
gacacagcctaatcactctaccgtagcttcctgccgagagtgctgccgttctaccacagctggattctatttgctgcacactgacagaatgaaacctaaactagctcctcctaaactgtgtttgaagaaccagtttttaaaattaccaaccccttgcagattgatatttctgtaaagtatgataaaaatgaattactagaaaaatgaaatggggggaaaaggcatgtaaaatacaagcccaaatttttattattcaacttgacagacttcacattacacctttcagtaaattcaatcaaaagataaataatgggccggacaaggtggctcgtgcctataatcccagcactctgggaaaccagggcagttggatcgcttgagcccaggagtttgagaccagcctgggcaacatggtgaaaccctgtttctaaaaaatttaaaaattagccctggtggtgcgtgcctgtggtcccagctactcaggatgctgaggttggggggatcactggagcccaggaggccggggttgcagtgagccaagattgcgccactgaagtccagcctgggtaacagagcgagaccctgtatcaaataataataataatgatagaga

SEQ ID NO: 222483 - DNA, 482 bp, Homo sapiens
aagactgggtagtttataaagaaaagaggtttaatggcctcacagttatgcattgcctgggaggcctaaggaaacttacaatcatggcagaaggcgaaggagaagcaaaggcacgtcttacatggtggcaggagggagagcatgtgtgcaagtgtaggggaactgccctttataaaatcatcagatcttgtgccactcactcactatcacaagaatagcatggggaaaaccatccccatgattcaattatctccatcttgtttctcccttgacatgtggggattatggggattatggggattgcaattcaagatgagatttgggtggggacacaatgcataactatattagcaagtaaagacactcagtgagttggatctctcagcaccagcagggcctacaagcatatatgctctaggagcagtgtagtgtctccttaagtctagtggggcataaaggaaaacaatcccataataattttc

SEQ ID NO: 222484 - DNA, 553 bp, Homo sapiens
agaatggttcaatatattcaaatcaataagtgtgattcattacattaacaaaacgaaggctaaaaactatgatccattcaacagatgcaggaaaagcttttgaaaaaattcaacacacttttgtaagaaaaactttcaacataataggtgtatgtcaaacacaataaaagccatatattggcttttattattaaagccatagtgaaaaatctaaagtgtttcctgtaagaccagggacatcaaaaggatatctactctgatttcttttcaatgcagttctggaagttgtcgctagagaaattaggcaagagaaagaaatagaagacattctaatagaaaaggaagacatgaaattgtctttgtgtgttgacaacatgatcttatagatagaaaaccctaaaaccaacaaaaagctgttagaagagataaacaaattcagtaagtttgcagaatacaaaatcaatatacaaaactcagtagtgtttccatatactaatagtgagctgtctgaaaaggaaattaagaaaacaatccatttacaatagcaacaaaa

SEQ ID NO: 222485 - DNA, 386 bp, Homo sapiens
gaagcaggtagtaaggtaaggtttttcttagactcagctattgactcaggccgtcctgggattcccccaggggttctcctattctcaacagagtgtagttgtgttaagtgtggagtgtgtccggtctgatgtttctcgatccccgcccgcagtggttgcttgtgacttttttggtgtagaaattcacgtcgttttataacctgcccccgtttctccctctgaacagcagctcgagtaagtgtaaccataaagcacttatactttgacaagcagcgtgctctcttacctcttggccttcgcatgtgctgttccctgggcctggaaagcccacacttgcctacccgataagtctgtctcctccttatctgtggaactcagctcaaagg

SEQ ID NO: 222486 - DNA, 388 bp, Homo sapiens
gcagatgggattattttatagcatagttcatttcatttctcatttttaaaagcactttttgctttgtgtgttacatatgtttgcttaaagatttcggacttttggccaggtgcggtggctcacccctgtaatcccagcgctttgggagggcaaggtgggcggatcacctgaggtcaggagttagagaccagcctggccaacatggtgaaaccccgtctctactaaaaatacaaaaattagctgggcgtggtggcatgtgcctgtaatcccagctacctgggaggctgaggcaggagaatcacttgagccctggaggcagaagatgcagtgagcctgggtcatgccactgcactccagcctgggcaacaagagtgagactccatctcca

SEQ ID NO: 222487 - DNA, 227 bp, Homo sapiens
tagccggtcgcatctgatgcttgagaggtggtgaagttcaaatgagcctgttaggctgaggccctaatccaatggaactggtggtcttataagaaagggaaaggccataggagggcacagcgaggaggcggctgtggccatctggaggcaagggagggaggcctcagaagggaccaaacccgaaacaccttgatctcggacttctagccttcaaactgtgagcatgc

SEQ ID NO: 222488 - DNA, 190 bp, Homo sapiens
aaaaaaagagctttcaaaagttcatataacaaccatgagtagtaaaagctgacataatgtttactctgtgccaagccattctaaaattaacctctttggtcctcccaagaaccccatgggatatccatgatccttatccccaggttacaaatgaagaagctgagacccagagaggtggagccacttgtcc

SEQ ID NO: 222489 - DNA, 609 bp, Homo sapiens
catttgaaaatatacacacacattccagagtatgctatcagttaagagatgttattctcttttcacactcagaagagttggtcgtgaaaatctagttagtagcatagattttattatttacacaaatatttactgcttgagagttatgatcacctcacacacgtagtctaaaaactcctatgatcaaaggcacacatgactgatcaaataatctacataatccccaattacaggtaaaatcaagcctttaccaatgtgatgaagttgtgtttgaaatggtacatgctttgttgctggtagagaggcatctgcttttggtgattgttttcacataatgccaggaaggccatatgtccatcgaggcaacttgcttgacatcatgacctgaatatcctagaattttcacaataccttttagaagggagtggaaaggtttaaaagcctatactaagatttttctatacacagtttcctaaacagacttatcaacaaccaatatatgctaatcaagattttaccataagtgtcattacagataaacactgtagactatctgacaaaaaaaaaaaagaaatacaaacctgactttactaggaatattacgataaa

SEQ ID NO: 222490 - DNA, 298 bp, Homo sapiens
aggaaggcatagatggttcttgaggaggctgacctcttatcagtctcaatttttctatatcccctggatcaacagacctggaagtggatggactgtggttgataagagctgacacattgcctggccatcctcctgctaccacttccccagagaaagcacccgttatgtagtcagaggagaaaactgagcccatctcctctttatggtgaacaaagtaaggtttgttcatggcaagtaggggctggaagggagaacttgtgattctacgctgagacttacttacaaaaaaataaaaaac

SEQ ID NO: 222491 - DNA, 395 bp, Homo sapiens
gtattgattgtcactaaatctttaaaaattaagaggaggcagggaagaaagctaacagtttgtatagcattctgctctaaatggtaatcagatgttctagctatgaatcttgaaattgtatccctcaggagagccaaggatgatgcaggtagtatggcatactgatcaaaggtaggataggacaaataagaaataaagcagagtcagtaatgcagttctgtactattttctcctcatagtctatatttgtaaataataagactgaaattttttgtcttattagaatcacacattattatttggatattctaataatccccctcccattctttgtgtttatctgactactatccatatgaataaaaggaatggccatattctttataatactgtga

SEQ ID NO: 222492 - DNA, 320 bp, Homo sapiens
taccctgcggctcccgctatcctggaagaatgcgggggcttctggatgtggccatttgtcatccttgggtggcaggacacaaagatgaagcagtagctgccacagtaactcggtggcctctgaaggtggagctgacgggaaagggccccaggttaccacaaaggtacaggcggtgtccagcaggtgtggtggcatcccgtggcaaacctggctctacataaagtccctaggggagctgtcgagacacaagttgccgtattcataatagccccacagtgccaaccatccagtgcccatcaacagcagtacagagggataga

SEQ ID NO: 222493 - DNA, 407 bp, Homo sapiens
ttcaagaaggtggtcactggcatctttttggcttttagaccagagtgacatcatttgagaaagactgttctagtccaaccctgcagttttatagatggagaaactgaagcccagagacggaaagtgatactgaaagtgatttcaacagctggactcagagttggtctgagactcctggtctgacacctttgaattcggtcaggtgaggaactcgggaaggtctgcaggtggcgctgcttctaaagggccttcgggacacttgggctcaattttctcacttaaccttgggtttctgattgagagtgggaaacgctgcttttcctgatctcaaaggcgaaggttccaccaaagttgttcacacaagtgttataagagaaaaattttaaacaaattaaaatgtggtacat

SEQ ID NO: 222494 - DNA, 558 bp, Homo sapiens
ctcgtgggtggctgaggactttcaccaggcgggccccgggaggaggaagggaccccagagtcctcaggaggggagggcaggcttaggaaaaaaaaaaaaaaaatcctaccatcttcacgtttgttctgtcaaatttaaaagagactttaaaaacgttcatgtaagtttccctggcttctccctgggtacacacgtatcctttttactttccccaactcagttctgtggtgcgtgggaggcgctgcaacagagtctcggtccggactggagccccggcgagggccgaccccgttccccacgcagctttccctcgcgaggtttcgcactttccagcgcggttccttcccgcagccctcccggctcccgcgtgggacgcagagagaggttgggcgccgcgctggcccgggagtggcttacgcctgacgtagccccgctggaggccgtggcacgcccgccctggcgtcaactcccgcgccccgggtgagggtgggtggccgcgcctgggtcccggacgccgcgggcgctgaaggcctcgggagggcgcggggcggcggccgc

SEQ ID NO: 222495 - DNA, 267 bp, Homo sapiens
cacaggacaagagtgctcacccattggctgtatcccttcatgacttgacttgggctcagcctgtttggcaggtggtctctgaggctcccacctgtacaggtagtgaccacactgtacagcacttgacagtcactgtacagtgacgaactgatcagcatttgagccccactttccaaaggtctggctggagctctctgattatcatcactggctgcatggaacatccctacagactattgtttgttactgcacacccctggcttgggc

SEQ ID NO: 222496 - DNA, 347 bp, Homo sapiens
cccccaagcacccccgccccgcacacccttaattgcaatttaagggagaatattctttccgtcctctcttcgcccaagggcatttgcagggacccctccctagaagtcctgtcgtgggcctagcggctagaagggccaccccgcagagcgggtctccgacagccccagcccggtcacctttcaaactgcgccctcctgggccccgcattgggcgcgagcctggggcgcccaagggcccccactgaggaggaaggttgccggaccgagccctcgccaccgcttggcgcccccatcccccatcctcctccctttgttcgcctttccggacgccgacttggagatggcag

SEQ ID NO: 222497 - DNA, 548 bp, Homo sapiens
gaaattcagttttttgccttagagaattcctgttttatattagaagtttcaggtcttgttacaaattttaactctgtgatggatcttgtaagtgcctcaatagccctattatgcatcattatgtggaagataagaccatcatcataataaatacaaaacagcaaacagcattcagatattttcctaatacttggttacacagcttggttccccagaagcctgattctgtttttttgggagctagcacttcccaaaggcctgggctcccttcacagcatgtcttcagatgtcccctgggcccagaattgtctccagtggtgtttggtggagtgccgatggtagcttcttggttcaccagtcctcagaatccagcacatttaaacctgttttttttaagtcaccaggcaaatgtgggggggttcccatgtcaaatatgtctctcaggctaggtggttagtcaggttttcttgttctctgtattaaaagataatcttgccattttgctactttaagaactacatttcccttcataatagaactgccactta

SEQ ID NO: 222498 - DNA, 478 bp, Homo sapiens
gagacagtcttactttgtcacccaggttggagtgccagtgtcgtgatctcagctcactgcaacctccacctacctagtagctaggattataggcgtacgccaccacaccagataatttttatattttttttagagatggggtttccccacgttggccaggctggtttcgaactcctaggcaacagtgggagacagtctctacgaaaaaaaagaaccaaccaaacaaaacaccaccaaacataacatacatagcctcaactaaaaaaaaaaggttacttaaggtattacaacaacaaaaaagataatgactagaacaacaataacaacacaaaatgtcctaagtgcaagaaaagcaaagacaaaaaaacacagcaaaagcctgtatgtttctgtccatgtgtggacacatacatactctaatgagctgtaacacagaacagcagaggaactgacaggaaacccactgacactattacac

SEQ ID NO: 222499 - DNA, 550 bp, Homo sapiens
cagctgtcttttatgaaaatttctcagaagttacacacttccacttccacttcattgatggtgctgaataagatcaaggcataaggaaagagaaagatataggggcagacaaacaacagtctctgtagcagaacatgacgatgacacagcatatcatcttttctgattttaaagcaatcaacttagtatttaaattcaatcactcaagattttcctttgtatctttacttttcctcccttttcttaaagtaaacttaaatttccagagaacttacatattatgctgcaatcagaagaagggtctctgccttagctatagtgttgctgatcacagcaagactttttattgccatcatgaggccggtattactgctgagtctatgctttctctgtggtccttggtcgtgaagttcatacactccaaatcctactcattccaacctcaggtctctttagggccttcaatcttctgccgtttgtaaggttggagattctgcccttgcccatggttaggataggagaggctatgctgcagagaaaagaaaagaaa

SEQ ID NO: 222500 - DNA, 449 bp, Homo sapiens
cagtagatgacaccaagcattcaggcccacagaactccaagtaaaaggggaaggacaaaactcaagttaatttgggcctcttctgctgctctgctcccaaattagagatgctaagtgaacccatgtgagcgcggtgactcacaggcccagacgccaagaagctgccttgtttgatgctcgccgctgcagccttccacactgaagctgcagaagggattctagtgacagtgtttccttccacattgttcacttttacctctccatgagtgcatttggggtgtataagaatcagactttgaacgtggctctctcctaaaccagaacaccatgctgtactcaacctctcaaaacgaagcccacgtcaccacaatttgtgacttcagatgggttgctttctatgacaaatttgaggatctttataaaaataaattttttttcctccgcttgtc

SEQ ID NO: 222501 - DNA, 451 bp, Homo sapiens
gaacctgtactcatcctgcttgggaagtactagcagactagtagaagaactgtggggcatatacaacacattctaatgccaggtagaatgtgggaggtacagacggagcattttagggatttagagaggtacctcttttaggtcggcagggggttttcaaacagagaaatcaaggaaggctgcatggaggaggcagcatttgaattgggtcgcaaagagctgtagttcatgagggaggcccctagaccatggagacacttggcttccagtctctaattagactggtgagcaggaagcttcaatcactcactcaggctatcaggtcaggaagtctacagaaaaaaatcccaccttctttgggtggaagtatgggtggaggacttgtagcccaggcctgcctcccaaaaccacctcctgccacctgaaagagagtccctgtactattcatagg

SEQ ID NO: 222502 - DNA, 429 bp, Homo sapiens
cagcaaaaaaactgatgtcctcattccaaagggcataaagaactgaatgaattctgccaataatcatgagtgagcttggaagcggatccttccccagctgggctgtgagatgactgcagtgccagccaacagctagattacagcctgtgagagaccctgaagcagaggacctatttaagtcatatccagatttctgacctacagaaactgaggtgatacattttttggtaagcccctaagttttccggtaatttgttataccaacagataattaatacaagagttattccaatttttattttcattttgtatccagtttggtaaactgtatttttaaggaatttgtccatttccaagttaagaccttattatagtcttatttattaatttccttcagaggtagacaaagtataccaattcattcactga

SEQ ID NO: 222503 - DNA, 193 bp, Homo sapiens
gtgagtgagagaagttggtttcaaataatttatttaagtgtatttgactgttccatttcattgaaaagaaacggtagtagaaaacagattttaattgttagagaggttcgacaataaaatcagctgtcttataatcagcttataatcccacagatcagcccattaaaaagaggctgaattatttctgccaagc

SEQ ID NO: 222504 - DNA, 500 bp, Homo sapiens
actacactacacttttcttttttgtaatttcatagtagattcattaaaatcttgtcatggaaaagacactaggatttgcaaattactattccagaccagcttttgaaaaccctgaaaatggaaaattcaggagattccccccttaaaaatgaagaaatcaagtaagtctaagcaaaatatctcctactaacttaaggatctttaagcagcaacatctatcatgttacgacttctaaaagttagaaactgccatttaatcagcactataacctcatgaggtgagtattcctgttttacaggtgaggagacaaatttaggtaggttaaatcattttgccaaggtcacctagccataaagtattgcagctgagatttgaacccaagtctgtctgattccaaagcctgtagtcatgttaccactcttgtaaccattatgttatactgtcttagctcttttttatagagtggaatctgacttgtaattcttcatctagtattgcg

SEQ ID NO: 222505 - DNA, 222 bp, Homo sapiens
agtcacatggcctaaggatagatggtcaaggaactttggaaaaattggtccctgggggatgtgcagggcaaatactttttggctgtaaggtgtgtgcagagagtaagaactggatttaaatactgtaagttggttgggctgttagagccttttcctgctcaaccaattaagacccgagtgaggctgaataaaaataacattgtttttagctatctttaagga

SEQ ID NO: 222506 - DNA, 396 bp, Homo sapiens
cgtcattgtgacacatcaatgatctgaagatgacaaatgagtttttaaaaattcattcttaatgataaaagactttcaagatcatagaaactggtagcctaggcattgctaagtctaaagaaaatcttgttttcatagcaaatctcgggtgtcttaacagatgttcttattctttaacattctgtttgcccttgtacattacatgtactttatagcaagaggattaaaagaaatgacaaattaaactatgggtatgctgacacttaatgtaacataaatgattcttcaaagtctgattagacaataaaataattcctcagagctctataggagagatttctatgtaaaggattcttgagacttgtattacatgaataaatcaaaacttgcaaagca

SEQ ID NO: 222507 - DNA, 318 bp, Homo sapiens
gacaaagtacctgaacagacatttctccaaagatacaaaaatgtccaacaggtctatgaaaaggtgctcataccaatcaaagggaaatgcaaattaaaactattatgagatatcacttcacactcgtaaggatggctattatcaaaaagagaagcaataacaaatgttggtgaggatgctgagaaaagggaacccaaatgcacaattggtggaaatgtatgttggtagggccattatggaaaagagaatggatgctcctaaagaaattaaaaatagaaccaccatatgacccagcagcacctcttctgggcatatacc

SEQ ID NO: 222508 - DNA, 306 bp, Homo sapiens
aaaagaggatgaatgtaggagaaatcttggtttggcaaaataaccaatagatattttttagtccacttggctggataataaaatcttaataacagggggaaaaaaagaaagaaaaaggaggaaaagatttaggaaagaaaacaacaactttagtatggaatgtgaagaactggcaggatattcacgttgagctgtgcagtaagtagcttactggacatgtgaggctgaagatacagttgttcatatggaagcaattatttaaatcatgaaagtgaatgagattgccaagggatagagaataatcaa

SEQ ID NO: 222509 - DNA, 403 bp, Homo sapiens
gttttcataggttagatgcaataaaaattataactcagtccagaagtaaacctaaaattaaaattcttttgatgacaggacattttaacaacttatttactatttgcatcccacagaaataatgacagggtgattaatagaaaatattcaagcataaaactgtgttacttttcaatgaattccatggaaaaaaataaaattgaaacgtttgaagggatgaaaaagaaccatgtaaaacttctgaatgttaactccaaattaggtcacaccatttttaaacacagaagatgcagggcggcaaatcagtgttcttagattcaattagctacatttaaaagagggatgtaatagtttatttattttttattttattttactgtttgaggcggagtctcactctgtc

SEQ ID NO: 222510 - DNA, 580 bp, Homo sapiens
gtaccgaaaaaataccatatgggactcgacaactttttgacagtgacctgaaaggagcccaatttcaaccatgagacatgggttatagtcccaggaactctttttaactagtaatgaaaacttagcttctccaagcctcactttcctgatctgtaaaatggaggaaccatatgaccctgccacctcaagtggaaagataaattaaaaatgctttataagccataaagtcctataaaagatgtgattattttcataacaaatctatttaagaaaaaaaaaactttgcgggccccataccttgtgtatatgactttttgtaacttatacaaaagacataatcataataaaagaatcggaatctttctttggttaaaaactgcactagtaagtatattagcaacagaacttgtgctatttaagattaaataactctggcgctgattcagccatgaggcttactgaagaacagctgattctgatagttttaactgaataagcattaacagataaaatcacatgataaaaggcatgcatcttatgagtataaccagtggccttcagaggacatacaacttccagt

SEQ ID NO: 222511 - DNA, 589 bp, Homo sapiens
gtgctcagtattgtgtcttagaagtagtagttactcgggtatctttaaatgtatgggaggatgtcaatgatggtcttcagttaaatgttttacataacaattagaaagtgaaccaaaatgaactctttatctggaaatgttatcacaacctgggaatctgctttaaggaactgtacttagtattagtttattttcctaaactcctttgacttaacccctctgtaacccaaagcttaacatgcgcagaagatttctgcagctacgggttttatcctcctttctgctcagctcaggaatcagtgaggtccttttaaaaacactcaagtggtttctcctgtgcaccccacccacatggaaaatattatagttagtcaatcaaattttcctgaaattcagcatttgtttatcttccctgtacctgctttgctgatacactacaataatacgaatgataaaatgagtggttcatgcagtcttagcttgctgcctcacaatgttttccctctccacaacagacttggctatcaggaaaaaatttttaaatgaacccctcacacaacccacataaaaagactttatccaggcacaa

SEQ ID NO: 222512 - DNA, 153 bp, Homo sapiens
tgggaggtagggtcaagggattttttcttaagggtaagagaaataacaacatgtttccatgccaatggcagtaatcaagtagagaaggcggcgagaagaaatgaagagatcatgggagaattgctgttgtggtgttaatgagcaagagggaat

SEQ ID NO: 222513 - DNA, 215 bp, Homo sapiens
accagcccaggctgtgactagaacctcattctcaattcccaagtcccagggaaataactctgtttgttactgtttgggttaggtgcctgttgtgggttgaattttgacttcttaaaaaagatatgttgaagccctagacccctgcacctcagattgggaccttatttggagatagggtcattgcagaagtaattaattaagatgatgatactgga

SEQ ID NO: 222514 - DNA, 432 bp, Homo sapiens
gcacgagaagattagatgctacttttgaaaactttttgtgacccaaagagaaaattagaactctcataagatgaaaccttttttcattagagtagtaataattgtcatcttttaataatgatttctctctattagtagtcgactttactacaatattggagacttatttgtaatttgaattttcaactacatttttctgttttcatcccttttgaatggagcttataatggaatttcgaaactaaaaggcttaaagttagcttctctaaaagagcagagaatatatgctcttatttagatatttgatttagatgtagttttccctccccatggagaatcaaacatttatacagcattctaccttgaaactaagtgcaatgtttcttgaggtctttgattgtatttccaggtctattatatattaagagtggt

SEQ ID NO: 222515 - DNA, 224 bp, Homo sapiens
tgtctgtcccatctgagttagcttcattgaggatgtctgcatttaagcccagaagtagtgagaaaaggaaacagcatgtcactagggtggaggcagagagataggaggagagagagagaaagaggatgatgatgaaccctatgggggtcacccatcacctgctcaccatgagaaagctgccaccacaactaccccaggaagagaaagcccagagctgcagaagc

SEQ ID NO: 222516 - DNA, 558 bp, Homo sapiens
agaatgagaggaaatatttgcaaaccatttgtcttatacaaattaatacccataatatatagagaactcataaaactaaacaacctgattcaaaatgggcaaaacatttgaatagaaatttctccaaagaagacactcaagtggccaataacaacatgaaaatataatgagtttgacatcattcatcattatggaaatgcaaatcaaaactacagtgagataccaccacacatccattaggatagctaccaccaaaaaaaaaaaagaaaatatcattgtttcggtgagggtgtggagaaattggaacccttgtacactgttgttggaaaagtaaaatgatataacctctgtgggaaacagtatggcactttctcaaaaaagttaaaattagaattaccatatgatccagtaattccttttctgggtatatagtcaaaagaattgaaagtggagtctcaaggagttatttgtacacctacattcatagcaacattattcacaataactaaaatgtagaagccaattaatttacagtgacataggcaagatggcacacta

SEQ ID NO: 222517 - DNA, 339 bp, Homo sapiens
aaaatgtcctgatctatctagcagtctttctgtttttggcatatcctgtccaaatatgagtgaagctactcaacaacaaaaaacaaccacaacaaactgcagaattttgctcactgttttgtaattcgtttgttgataaacgagattttttaaaagttaaatcaatatgtaaagaaagtaatttccattttcttggtgtatattagagatttttaatatattgaatcctctgtgaggttaacagacaaaatggctttcctataagaaaatttgcaatgcaggaacactgccagcaaaaggactgatgaagcagagcaatacattacctttttttttttt

SEQ ID NO: 222518 - DNA, 474 bp, Homo sapiens
gaagaatgaagaaaacaaatgttcgtgtgctgatgtttctgaaaatgttctttaaaataaaaatgctgtgattgacagcctgaaaaggcctttaatcaaggctttcttctctacgcagatgataggaatggtcattgtaatctggagtatcacctgaaccatagtttctagaaattaatgtaaatatacaggccaggcacagtggctcacgcctgtaattccagcactttgggaggccaaggcaggcagaccatttgaggtcaggagttcgagaccagcctggccaacatggcaaattcccatctctactaaaaatacgaaaaataagctgggtgtggtggcactcacctgtaatcccagctactctggaggctgaggcatgagaattgcttgaagctaggaggcagaggttgcagtgagctgagattgtgccactgcactccagccggggtgacagaaagagactctgtctca

SEQ ID NO: 222519 - DNA, 410 bp, Homo sapiens
gataacactccctcggaaagaaaatgactcttattagacatctgaacttgagcaaaacattcatgtcatcgattataatataatggatggctcctactctggcagcaaaatttagctttaatgtaactacagaagcaaagattattcttgggggaataatgacagagtgtatctttctgatcatctgaagcagttcattcacctctgaaactgactgtaaacctcaggaaagaagcttctcagaaatacatgacccactaagctaagagccaactccctagtgaatcaccttccacacccgtgacctcaagtccaggacccgtgtaaagctagtttttaccatgtcttctatgactgctgggggatggtacactatcatcctagatccaattacccacagaaaaaaacaa

SEQ ID NO: 222520 - DNA, 756 bp, Homo sapiens
aagttctgcaagatgctctcagactaaagagaaatccatctggaaatgctgcataccatacccctctcttggagttgaataacaccgttggcatatgagaaattctgcagtaaagagatatcattgactttgttgaactctatagttcccaaacttgaccataggagttttttttggaactagtgttttacggcacacacttcaagcaacagtgaaccaaataattaataacatgtagaattctaaaccatatatctttttcacttattgtttctgataaagttaattggaacttctggggaacagatgggtactacaaggtttgttctaaaactacatatagagtgataaagaacagctattagaccctgatctgagtcaacagtcttaagaggcctaaagaaatgtttgctattttgcctgaaccagatccctctccctagaaaactttcagaaattaaataaagagataaagccatctaccacataagctggagtcttaattttaattcctgttagcggtttgacatgatgacattaagctattctaacccccttctgaaagcagttgccaccactctggtctttctgaaagcaatccatctgttagtttccttccagtagtttgatttctgacaggccaggtgaaggaaaagcaaacatgctacttagtaagcacaatatcatcattagagatccacttctttcttctttgtgtctcttctttaattttcacatgtgactatttcaatttag

SEQ ID NO: 222521 - DNA, 443 bp, Homo sapiens
gtgtagtcagaagtcaggtggaaggaagacttcctggtttcttgttccttttatcttaattcacaaaggaagcatgggaagggatgcatgggatgagaggggaaaaaaatacaggaattgaaaccctaaggcaatcatgacatgtagagacacatcagtggtcatctttgttgattatttccatcatcaggcatgcaattactttctaatggtgaccatcatagcatagaaagtattaaggtcctgggaaaaacaaatgtgaaccaaaaacctatgtagaaaatacacacacattttaaaggggaagttaatcaattaaccaagacagcactaagtagtactacaatggctaactggtttcaacctaactgagctggtggttcctttgctcccaggcatattctttgagctcttaagagatgggccaaggcttaccaaaaaaa

SEQ ID NO: 222522 - DNA, 420 bp, Homo sapiens
ggtcccccttgagcatttagccgagtactgatcaatggatgtatatggacaaactactcaagacaaaggaaagaaccaggcaaaagggttagagaaagcatctctcacacagggccaataagagtgcctgttcccatcacccacattggagaaattcaaaactcactgggcgtgacgtagaggacggaagaagatcttgcctcagtggtaggaaataattagccctacactagcactgctcagacccacctaacaatctaaaaagcaagctctgaaaggatctacgcatttctaaggatctacagtttctaacgcctcccagagcgaaactccaggagatttacaggaatacgaaaatatccattgtcgctttgctttgtatactggttttgaaaatctgacgctagcctaattcatttg

SEQ ID NO: 222523 - DNA, 521 bp, Homo sapiens
aatattccaaaatctaaaatttgtggtcccatttctgataagggatactcaacctgtactaggaggtacccacaaatgatggttcccagtcaacaaatatccatttcccttttattaggggcagtgttacatgactctgtgtgaatactgacagcattcagagagcaatctgacctctgttctccagaagcatgcaatctaggcatcggcacagcaccaaagcagagaaagagcatgatgtgtaattaagcttccaatgcatagtgtggatggtgactccaggggaattgttctttgggttataacttctttagtgggagaaagttcccaccacacatcttggagatcaggctcagagacactaagtgacttgtccaaagccatacaacaggccagcagtggagctcaagttagcttcaaaagggcctctgaaggattctgccagaagaggagctgcttaatatgttagcatgagcttgaaataataataataaagattaatagtaatgctaaaaaaaagt

SEQ ID NO: 222524 - DNA, 576 bp, Homo sapiens
gtagagacagggtctccttatgttgctgagactggtctcaaactcttgggttcaagtgatccacctgcctttgcttcccaaagtgctgggattacaggcatgagctactgcacccaggtgcatttctgctttgatgtctcagacctaacatctttaaagttaaacttaacatttttccaaaactagactcattattttctctcacaaacctccttctcatctagcattattactaaattgcatcactacccttctagctgcctaacagaaacctgcgagtaattctcgacttctccttccccctaaacactcatatccaatccctaagcttgactgattctacttcttgaatattctcagatactgaaatctaccaatttataggacatacagatgataaagaaacatgttgaagtatatcatggggagtcatcagcaaaatctagagtatgggacactctataaaaaaaacatttggaagccaggcatgatggctcaaacctgtaatcccagcaactcaggaggctgaggcaggaggactgcttgagatcagtttgagttcaagaccagcctggg

SEQ ID NO: 222525 - DNA, 351 bp, Homo sapiens
gctcccagcctgcccagatttcaggaaggaaagaagatcttttgcttcttcggtcgctgggtcggctctccagtgtctgatgtttactgaaatcttgatcgtggttagcctcccccaggacttcattgtttggaagatgccttcgccaagcaatctgagctccaggccgggaagccccaaggtcacaaattttaatggagccctgaaactaaacagaaatcatccctcccactagaacaagagcccctagaggccagcgacaccgctaaaataacatgtgtagaccaatgccgtccaggtaacagtgcctggcaaacacggtagaggttcaataaatacattttaactcaa

SEQ ID NO: 222526 - DNA, 357 bp, Homo sapiens
gcttacccgtttttagctctctggcctctacttgctgggtcccttattctaaggtggggacaaggagcctgagaaactggtctgggtttgctttggctccagcttctttgtgtcctacacttgacccaaagttgctgagaacagtgtatgcaaagccacgttaggggtcactcctgggccgaagcgccccagcttgctctgcacttgacctgagactgggtaagatgggatgaaagaaagagaaggatggaaaagagctgtcctgacctgcttgtgtgactcccttcactgtcctttacagagccagctgcttgatgctaacccagatgtacaagaactctatctgggcttctctgc

SEQ ID NO: 222527 - DNA, 1071 bp, Homo sapiens
ttttttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaagcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgtta

SEQ ID NO: 222528 - DNA, 374 bp, Homo sapiens
ttgcaaaattctattgtaaatgaatgtcaaatcagaattcggtatccatttctttggtgatgcccaccaaatgaaaccctgccacttgccctgcattcaaactgaaattggaatttgatcttgggaattactttcttgtctagtatttgactgatcaaatgtaactccttcccttttaggcccctttctttcttccttttaaaaacctttctctattcatgaagcacaaattagcctttggaagactctctatctagctcataaactcgttaccttcttcctcagaggcatgactcattcgcttttgtctctcgacttcttagattattccctttccttacatctcacttttcttttactgtggaaagaaatat

SEQ ID NO: 222529 - DNA, 923 bp, Homo sapiens
caccacgctcggccaataaatttattaatattatattaagatgaactccaataagacctttggcatgtcagtttaacataagtgaaaggtcctttttatgccttttgagccttccttcaccttccatccaacacacacatgtaccagtaaattgcagatgccatttctgggctttgcacactttctctggctttccatgttctgctcctgaccaactctcttgccacctgactcctcccagcctggctgcctgctttcagtagctgggccattgctgggaacactctgttgcctccctgtgctgtcctctgctgtgccattgtgtggaatgccctgcagcctgcctcaacacaatgaagtaatcttaccagtcgatgccctgactcctgacgtcacccttccctgccctgtgtcacctttccctgcatatttggaggataaggcttgattgaggctcgggtaccgagctccctgaaggtgccttgatgctggcacatcgagaaccagatgccaccccgatgataaggaagacagacccgggacttccatatgaattgggtatgatcgtctgacatgcaccctactaactgatggatcctgctgttaccccaaagctccagaaccacactggccagacacaggcatttcctgtcccctgaagagccactgaacccagcacaaaagagatctagagctctccaaacctatggaatggcaaccaaaaccatgcccaggttttgagttaagcctcattagtctcccttttcccttgacaatgtagaactgtgcagccattgctctaagtgaatgagagcagaagcctcaggacagaactgaacccaccagcttgagctgacaacactgccaggggttctatccacagatggaatattcctcaccagacctggaccagcaggtaccga

SEQ ID NO: 222530 - DNA, 375 bp, Homo sapiens
cacatgtcgtgccttgggaattgctcctttgactagattactgttttgaggttgacgctgttgtgtttcttacaagagtagaaaacaagtgcacaaaaatggatttaggtaagtggaaatttaatgcagtcacagcagtgccccacacaaacaaagtgatctacaaatgtagccttgataagggtccctcgctaggccagtcgtcacctactccctctgctggatgacagccctccggtatctgcactcagctcccacgttcctggagcttctcttctcagactgcgcagcgcccagagcttcaggtctctccatatccttcatcaacacctcctgaaagcgtgagaccttggagaggcccatgtcctccaggtg

SEQ ID NO: 222531 - DNA, 508 bp, Homo sapiens
gcagaggaagattaaattttgcatgatgaaaaagcaacacattctatctcaagtatcagaagtgggtttggctttgcttcattctttttatacttcttaatttaacacatagttatagacaatacgtaagcctataacatatattgaatcctgcttttgtcccttaacaacaattttcacagaattttgtatacatatacagaatcatgttacagtagggagccctctgctggcttgaaattaggaaatttaaggcataaacattctcaagaccctgattctacattctagagacttttcagtgggtaaaacacattcttcagtaatggcaaagaaaagagactttttgctaatctttacatagttgtttagtatgtcagaagagcttaatgattccccaaggaatgatacataaatatgtgtatatgctttaatatatgtgaatttataggattagcctaaaaatgagtttaataatagaaatgttaataaataattcccccaaatg

SEQ ID NO: 222532 - DNA, 588 bp, Homo sapiens
atagctgcacttaggacccagaaacaggcattgatgagaacagacagaacattggaccttactctccgtcttccttcctcaccagcagtggactgagaagggagtgtgtggccagggccatcaggctggctgtgccattgatgagctcatccttgtgcaagacaatggctgagcatagaaatattatagtatggcttgagtattaaatctaacactgtatgagaaggtaccaggaagatggtaattggctgtacaaatatcaaattgctactattgatgctggctccccacctactcccaatggaatttaagccctatgagaatggggacttggcagtccaggtattactagaattcaatacttagtgaaggccccaataatactgccacctactccatattgggatactgttcaaagtatggaattggaaatttcaaacccattccaattgcagattgggaccccattctccttctgtggtagtccttattattgactattgaaggtggaaggttgtttcaaaaagcagtggaattctgtggcaaaaggaaatctaaccttcatggattaaagacacctttttaaaa

SEQ ID NO: 222533 - DNA, 818 bp, Homo sapiens
tcaggatttacccctcccctctttttcttagttatgaggtattgggaatcttctcaccctggggccttctcattgtgcagctgatgtcactgagcaggtccagggatttttctttccttttttctttttctttcctttttttaaatttttttaaaaattttatttatttatttttttgagatataccatgggaaatagttcatttttaaattattgcaactaggaagagaaccttgatttttttttctgagaaaaatcatacataaatgggaaaatttgaaaatacagataagtgaagataaaattatatcacttagagataactagtattaacacaacatacattcttttggtcttttttttccatgtgtgttttttttttctcagaaatatgatacagaagtgttacaaactgttttcacctaacatattgaacgacttctactacattttaatgaatgtattccatggtatactggagccagctcagctcagacagggattgttaaatagtcaggatttccagagcagattattaaactattagtagcttgagatcagccatggtgggagtatttataccatggaagttaccagacaccatgaattggggcttcttgttttatttagagggctggtttattagtataccactatatacacattttatcatgtaaatgtgatttgttctgattgaaataatctccctattttaggttatttctgatttttgctgttataaacactatgtaatggcaatcatggatgtcctagtacacatccataattacttccttaggatacattccttgaaatag

SEQ ID NO: 222534 - DNA, 394 bp, Homo sapiens
ttttgttgatttagtgtacttactaatattttaataatctgtacttcagcaaaatataaaatgacttccttgagctggtacactagcgaaaagcttcctttgtttttttgtagcatgctttccatgtgcaagtttaattcttttcctgtatgtgtgagatttaaatttttttttatctgtgccgcttgataagtaagatacattctagttctttatataggttttggaacatctctttttgaatgaatattttagatgaagtatgatgatgtttctttccttcaatttaaaataattaatttcattctctgtcaatgactgtttattttcagaatggtatttaatcagggaaatttctgttttttctaataaagcattgtaattatctgtattc

SEQ ID NO: 222535 - DNA, 1354 bp, Homo sapiens
  misc_feature (1111)..(1111): n is a, c, g, or t
  misc_feature (1166)..(1166): n is a, c, g, or t
  misc_feature (1188)..(1188): n is a, c, g, or t
  misc_feature (1233)..(1233): n is a, c, g, or t
  misc_feature (1303)..(1303): n is a, c, g, or t
ctttcttttctacattactatgtcttaagccctgtcaaaaatgctaacatttgatagatctagatcacatttaaaataaggaagcaaaaaacttcggtcaaatagcttaaagtatcaagagacgtgccatctcccacaagacgggaaatccaaattgactctaggtcaaggtttctgaacatcagcactgccgacgtttggggccaaataattctttgtaagaatcacaggcggagtggtctgcatgcctcagtcccaaccccattcccctggctaaatcccagtcatctttcaggttttgttgaatcatcattttgtctgtctggtcttcccagctgtactgaagtgtggggtccatgtcctctggtgtgctccccatggaccctggatgtcccccactgagcactgtattgtaatcatctgtttacttagatggtgaggcagggaagttagatttaaatgccctgacccatggtctattctatctgttgttgtcacagtctaatccctcattgagtgctgttgtccccctacatcattctcaccaaattgtgacccagcctctatcttcataccttagacaataaagaacctactacctttcaagactgtcatcttattgctgaataattgaaagtgtatcctaatagtaattcccaatctttcttcctttcttggccctggtctgcctttgggggccaccactttcagaatgacaggtaggtgcaagcagctcacatcccaggctgatgtctcctaactactcagtctcttttggattcatatcttcttggccaatgagatgtgcaccttcatagaatatagacctcttcctttctgaatgagaaatgtgtgatgagaaaggcaaatccatgagggaagaataaatctcttccaagcctagcctaggaggttgggtctgggtctaggaccctgccccaactctgcaggaattagggtattaactatgtattaatatctggaatcagaaggcctctgctcctgtctaggttttatgaaagctcccagaaactaagtggaggcaaactctgcatatacctttaagaagtccaggctgggtgtggtggctcacgcctgtaatcccagcacnttgggagactgaggtgggtggatcacggggtcaagagagcgagaccatcctggcnaacacagtgaaaccccatctcnactaaaaatacaaaaaattagccgagcgtagtggtgggcgcctgnagtcccaggtactcgggaggctgaagtaagagaatggcgtaaacccgggaggtggagcttgcagtgagcngagatcacgccactgcaccccagcctgggtgactgagcaagactccatctc

SEQ ID NO: 222536 - DNA, 258 bp, Homo sapiens
aaggaaaaacagatacctggatggaccctggtgtgttgcagaggacatgtgaagcaatcaggatgcagttaagtggcacacaaaatagtttgactaaggtacaggagttacagcggaggcagtagaaatttatacttcaaaatttgaatggaatttctcaactttgcttggattagtgatggcttttatctcctggggatgtgtgatttttataagagtgtggggaatgcagcaaagataaaggggagaaagagttta

SEQ ID NO: 222537 - DNA, 540 bp, Homo sapiens
actgtttacacggatctattccttaggactgagtcattagcacaatcctgtcttcctaggcttattagagaaatcgaagacaggatatttgaattgaaaggtacctacaaatccatcttctttcccattgattgattgaatccctttcatactgtttcttgaggatggtcaatcagtcttgcttaagcacttcccccgggaggaaagtcactatttacagattccccagcctcttgcattgctaacagtttgtatcatgagaaagatctctcccatagagttgctctctcattaatagtcacctcttcttaaagcaacaaggccagttttgaggaatctctttgtgccccttttcagtagtagatcagggtttgcacttcaaaggatatcgtgggtgtctttttatgagtcaaaggcttatcatctttattgcagatcagtaacaaggcaggtttctggaatatgtatatggtttccttataaacagtccccaaactcatgtatcaacctgacaaagtctagactcaagagtttgtttca

SEQ ID NO: 222538 - DNA, 895 bp, Homo sapiens
gtaatgtgaaagcaagtttattaagaaagtaaatgaataaataatggctactccatacgcatagcagcagcttgggatgcttgattgataatacttagttacttcttgattatgtgctaaacaagaggtggactgttcatgagttttccaggaaagaggggggtaattactggaactgagagtcccctccccctttctagaccatataggatgacttctgtaaaacgtcatggcactggcgggagtgtctcttagcatgctaatgcattataatgaagcagcgttatttgtctggggtaataccagaggtttgttgccccacacctggagaaattgaggatgcagacacacacaaggagtgaggttaagagtggaggtttagtaggcaaaagaaagagtaagcatgacggcccagtgcggtggctcatacctgtaataatcccagtgctttgggattacaggcgtgagccactgcacctggccctgacaaattatttttaatttctttgtagagatgaggtcttgctatgttgtccagtctggtctcaaactcctggcttcaagtggtcttcccattgaagtgttgggattacaagtgtgagccaccgcgcccagccctggccttggttctttgctcctacaaagtgctagaaaaaaaaccctgcctggtccctaaacagacctccagggaccatatttgatcaacgaaaactccatacctggggtatactgacaaggcacgttttccgatttgtagagttacttgtttaacaagcaaaacaaaatacatcctgcaaagaaacaagaaaccatcacagctaggtttagatttaatgaattacttttactgaaaagaacaaaactatgtgagaagagtataaaactctagtgtgga

SEQ ID NO: 222539 - DNA, 667 bp, Homo sapiens
gcttgatgattaaggaatggtctcaattctccatagccacatcagaccaaaattccatttctttgcctatgtgaagggtttattattaattaccctattaatttatgtccaaaccagatgtgatttccttcttggagcaatagttcgtgaagaggttggttaacagcagttctgtgcccaggtaaatgagaggcaactgataagaggaactcgttgtgtataaaatcttaggattctagatttaggacctttaaggcagtatttgaattagtgctctggaatgtctatgaagaaagtttgggtctcttcagccagaattcagaccatttcaacattgcattccatgtatcatacacatatctccttttattattattttttctgctctcaaagcagatttctctcattgtaaaattagtagattcttaattcagaagattggagaatattaaaaaaagcttaaagtaaagcactttgaacactttattccaaatcacttcacctcatttgtgaataagtgcatggatataggcttataggactttttcattcaaaacagggttatataacaattgttttgaaatctacttgtttcttctaacaaaatatagtgaacaaattttcatgtcactaaattatgaactgtgtcataatcttttaatggctg

SEQ ID NO: 222540 - DNA, 547 bp, Homo sapiens
tactattatatctgtcggctgtcgacttatttttttttcttttgagacagaatctcgctctatcccccaggctagagtgtatggcgtgatcttggctcactgcaatctccacctcctgggttcaagcgattctcctgcatcaggctccccagcaactgggactacagcagcctgccaccacgcccggctagtttttttatttttagtaaagatggggtttcaccatgttggccaggctggtcttgaactcctgatctcaggtgatctgcccacctcggcctcccaaaatgctgggattacaggcatgagccaccatgcccagacaggtactatattgatgttaagcataaaattagggtaatttaactggctcaggaagagtatctagctcatttgtttcagtttggacaatgctaaatgctattttaggggttctatgcccaactggaaactggcaaacaggatggatgtggggggaaggaataaagataataaaatgcgcagtttaataaatgtaagaactgaaccaagtaatcttgcagatact

SEQ ID NO: 222541 - DNA, 393 bp, Homo sapiens
acagacttttcatagacaaccctgaatagccagaggctgccccacgtagatggaggggaaaaatgcgaggggaaacagttgaactatgagtgcttggtcctttccccaaattcatgaaccaaaatccaggagtgtaaccctaatggaggtttttgtacttggaaacaagaaggttcaccccaacataagagatgcatagagaagcagggtcaaaagacaataccccctggagaagtaggtccagtcagtgttctgacttcccagtttctgctccttgtctctcttatgaagctcagccacacttcccgcccttgagttcttccagatacacattatttataattatgggtacccctttatttaaactctttcagggtgttcttgcaactggta

SEQ ID NO: 222542 - DNA, 126 bp, Homo sapiens
ttagtagagacagcgtttcaccgtgttaaccaggatggtctcgatctcccaacctcgtgatccacccgagattaggcctttcttaagaaagatttcttaaataccctagcctcagttccctattta

SEQ ID NO: 222543 - DNA, 435 bp, Homo sapiens
tgccttcccctttctcaacttcccccaccagaatgggacatttgttacaactgaggaacctacattgacatattatcactcagagtccataacacactacatcctattcttgctgttgtacattctgtggtttttggccaccgtataatgacatgtatccaccattgtattgatgctgctttacatgatgagcttacttcaacagggttatgccctgataaaccatcataaattgaaatgcatttaatacattgaatctactgaacagcatatcttagcctagcctacctttaatttgccagaacacttacacattagcttacagttgggcaaagtaatctaacagaaagtctgtttttataataaagtgttaaatatttcatgtaatttattgattactgaaaatgaaaaataaaatggttgtatgtttacttg

SEQ ID NO: 222544 - DNA, 389 bp, Homo sapiens
tcaggccctgctgcttcctcttggccacagtgtgggtgtgaactcacaggggcagcatccctccagagttcaagggcattccattaaatcagcaatcactgaagagatttctgaatctcttagttaattgccttagggaatttagtatgccatagctgtcaccagattaattaggtgcagtaatagtagtaataggaaactagtcaaaaacaaataggatcaaagggttattagttttgttaaatataattcccatcttagtaagagaaattttccaacaaagctgacattaaagaatcaagtttttactgagaatattttctaggttatttatgtatcattttgttctaaaaaaaataaagcaattgtgcaaaatggggtggtgtcaa

SEQ ID NO: 222545 - DNA, 1222 bp, Homo sapiens
accacaagcacttactttatgaataattcagacatatgaagagctgattaatgactcataatttagaaccccacctactgtcccctgggtgggggggccagggctgctctccaatgcctacctcatgccctgtgcagaacacgtgaggctcacccacctccaaacagatgcagtgcgccctctgcctcaggcagggcactccccaacacatgggcagctgctcacacagagatggtattagggccttttggggatttgggaatcttgaacactcatgggaagattgataggcttctgggatgccttccatggagcggctcgggacaaatttgtgaatgcagcggccaaaagatctgcaatccgtcatgggttgagtagagctacccaatgcgccagcagcatagggaaaatgctgaggaaaatgtgacggcaggtgcccactcttaaagcagccacaagtctttactgaggtcctgccgggtcagatcctatgctggatataatagggaaggcgtgcgtttgaaaggatttctcagccgcagacgcaagccacgcatagcgctcggtgagagactggtgtccaggagcatggaccgaggtgcagtggtggggctggacttgagaatgactttcaactgccaggatctggtgaccaaccggatgtcagggacagagagaaaggcccaggtggggaaaactcaaggcttccagtgtgggaggctgctccactcagctggaccccacagggtcctggggaaagggcctatttgacgggcagcagaatgagctgctcagaaaacaggaaagagaagacatcatttcagacctgaggcagcgccgacctatttggaaagaagaaatacacagatgaagcccctaaaatcatttaagtgaaaggaaaataaaatctcaagacccagttcattctgccaaagggaaaagctaagctgggactgaggcatgcaagcctctgcctttccttctgctccagagcaaattgctgcggaaagcaggccaggggtctccacagggagctgctcttatgctgactttatcttatgcaaagatttactgagcacaagacaaatacatgatggatgattcctgtacccgctcctttccaatgcgatgtgtggactcagacatatgaccacaccccctccccttcccctcctgcctgctttgcccctttcagtattaaagccctcaaaatcctctttgg

SEQ ID NO: 222546 - DNA, 467 bp, Homo sapiens
caatattctattcaaaataatgttcagaggagatgggtagtaatcatttgctgccaagaaaaataaaaataagaattccagaggaacccacaaatggtttcagagtaatctcacttatcagaaaagttattactggtgttgtggaaagaattatattttggtgtctttgccaaaagagcttttcccagaaagaaaaatgaataacattaacagtgtttcgtgagcgcatgctgtatatgaggtgctgactcaaggttgaatagaacatcaccctgtccctcacaaagcctaccatctggcagagaagatggacatgtaaaatgcagtgtggggctgggcttggtggctcacgcctgtaatcctagcagtttgtgaggctgaggcagtaggatcacttgagcttaggagtttgagaccagcctgggcaacatagtgagaccctgtctctattaaaaaaaaaaaaatgc

SEQ ID NO: 222547 - DNA, 401 bp, Homo sapiens
cacttcacggacttctcaagtttctctcttttggcagatgaaaaatcttggctgattttgctcttctgataaatactgcaaaagatagtagaactgaagttctatctagtcttaacactgtacgaacactgtacaaatctttgaattcttatggttatagactgacttggggccaaggaacagattaaaattaggggacttgggcatgtggactttgagaagtagatttttctgttaggtttttcagttttgcttttctgtctgttttgtcttaacttagagtactaccttattcggtactccactgatgctataaatgtagtatttttaaacatcaatgcattgtaatgttgttgaactccaaaatgcccaagcatgttataaaaaggaaaggttatcta

SEQ ID NO: 222548 - DNA, 449 bp, Homo sapiens
acttgcattcttttaagttctgtcaaaggtagtacttctcaaacttaaatatgcatgcaaatcacctgaggaatcacagaagaattcagattctcatgtgaaggtctagagtggggcttgaccctctgcataataagcttccaagtgatgctgatacagcttgtccactttgaataacaaggatttagttgaaagaaaccctgaatcatggacatactttgatttatctctgctctttcttgatttggactcattaaaccaacttcagattacaatttgccttctctgttggtttatctaaatagcagtattgttaatcccaagattgtatcccttatggtgaataaacatgtggacattccagatttatgcatttaggcatttatttctgtgaggttggttaatgtgcatttgtttcagatgaggttaataaaataataatagctaag

SEQ ID NO: 222549 - DNA, 306 bp, Homo sapiens
cctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctg

SEQ ID NO: 222550 - DNA, 454 bp, Homo sapiens
catggacggtgaccgctctggggccagcagggtagagctgccttcctacatctgagaactcaagggcgagagggaggcagggcaggggagagggttggtctcagttcacagggcgaccctctggccctggttctgacggcgactcgctgtgtaagctaaggagtgtctcgctctgtacagcgggcaggtggtgggtctctgcacgtccagcatctccagctttccgtcctctgagctgttttgacatgggaggcgctggcagggagagaggggtcactgatgtgggaagctggtgcagagctggggagtagcttgtgatgctggagaacctggagatgcccctcccattccttgggcctcgactgtctcatctgtggaatgggcgggtcagactggataatctctaaccattgcttcccttcacttctgtcccaataaacacacacggagcttt

SEQ ID NO: 222551 - DNA, 577 bp, Homo sapiens
ttcatagcagaagcacactcaaattaaacctacactgagataccatttctctcccatcggattagcattaagattcaaaagtctgaccactccttctgttgggtgagctgtatggaaaccagcactgatccactgctagagggaattcagaaggttacaactaccatgtaggggaatgtctttaccctctgacccagtaatcccagttctaggaatctaccctgaagacacacctccaacaatacaaaaatatatacgcagaagattattcattacagcatcatctgtaattgtaacataatggaaacaatcttagtgccccaaaactggagactgattgaataaactatggtacacacacatgacagagtactatgcagctgtgaaaaaaagaatgaggaatatctcggtcaactgatgcagagtaatttcctggatacactgttaagtgaaaaaggcaaagtgtaaaatagtacatatagatatactatcttctgtgtaataaaaaggggaaatgaggcgaggcgccaaggttcacctattgccaaggttcagcactttgggaggccaaggcgag

SEQ ID NO: 222552 - DNA, 865 bp, Homo sapiens
  misc_feature (781)..(781): n is a, c, g, or t
taaagaaaagtagttcccttatctccactttccccctttccagcacctcagaggcaactgctttcagctgattactttgacaggcgtgaccttatttccacataattgcttatgtcatgatttttttctttttgagataggttcttgctctggggcccaggagggagcgcagtggcgctcttgtagctcactacaaccttgaactcctggactcagataatcctctggcctcagtctcctgagtagctgggactacaggtacatgctaccatgcctggctaatttattttcacagagacaaggtctcactatgttgcttgggctgatctctaacttctaggctcaagtgatcctcccgcctcggcctcccaaagtgttggaatacaggtattgaaatcaagtttagcctaaagctgcctccttatatatttaagtttggcctaaaggtttgtctgtatatcgtgacaagtggaggtgtaaacagactacacttgtgccaatcactgagttttggccaatcaaatgtagccaactgttcaaaccacgttcagataaggcaaatgccaagctgtagccaagcccagctgtttctgtacctcacttccattttctgtccgcaaaccttccaccgtgtgactgcgctggagtgtccgagcctactctggctgggaaggctgcccaattcttgaactgtttattgctcaattaaactccaaaaaaaaacacacaccacacacacaaacaacaactttttggcgcgcccctcggcccctccgggaanaacgttttttaaagcccactcccgtttggggcgccgcgaggccccccgcagggtaccgcgcacccgggcccacaaacgcgggtc

SEQ ID NO: 222553 - DNA, 210 bp, Homo sapiens
acagcattcaactgtatatagtcatgaaaaactgtagaaaaaggctttattgttttactttctgccagctttttttcctattaataaaatatgaaagttaagagctatagcatttcaaaatgaagagctatggggaaattcaagataccataaaatgatcaaagcaaaaaataaatgtccaatatactgttttgaaaaaaaaaatagatg

SEQ ID NO: 222554 - DNA, 830 bp, Homo sapiens
gatttttcttctatagaaacaaatatattttgaggttataggtttggccaaacatctaatgtataattttttgtggaaaataccacagactacatatttataattaagtacatgtttactctgtaaagctttctaaaactggtatcaattaaatgtagtaatcagccatataaagcacatttcatataacacagtatcatagtgtactgtaattagcttttttcctccagctgtagtatgttcagatgttaagtaacactttaatcagaactgtggcattgaggaggactttgggcgtataattgttatagatatttcttaggtacctgaaaggctgaaagctctgaaggccaggacatagtttttcatttacctctgtctctgtaatgcctggtgtagagcatggcacgtaataagtgctcaaaaaatatttgttgaatgaatactgagggcctttttggggctttcttaactgcttttagaaatacctcttttgggccaggcgcatggctcacgcctgtaatcccagtactttgggaagctgaggtgggcggatcacctgatgtcaggagtttgagaccagactggctaacatggtgaaaccccgtttttactaaaaatacaaaaaattagctgggcatggtgtttcgcatctgtaatcctcgctacttgggaggccgaggcaggagaatctcttgaacctgggaggcagaggttgcagtgagctgagattgcgccattgcactccagcttgggcaacaagatcatcatctttagataatctgttcatctttagaaacttggtctcaaaaaacagaaaacaaacaaaa

SEQ ID NO: 222555 - DNA, 813 bp, Homo sapiens
aaaatatttgttgaatgaatactgagggcctttttggggctttcttaactgcttttagaaatacctcttttgggccaggcgcatggctcccgcctcggcctcccaaagtgagccaccgcacctggctgataatcagtttttcaatcaaccatataaagcacatttcatataacacagtatcatagtgtactgtaattagcttttttcctccagctgtagtatgttcagatgttaagtaacactttaatcagaactgtggcattgaggaggactttgggcgtataattgttatagatatttcttaggtacctgaaaggctgaaagctctgaaggccaggacatagtttttcatttacctctgtctctgtaatgcctggtgtagagcatggcacgtaataagtgctcaaaaaatatttgttgaatgaatactgagggcctttttggggctttcttaactgcttttagaaatacctcttttgggccaggcgcatggctcacgcctgtaatcccagtactttgggaagctgaggtgggcggatcacctgatgtcaggagtttgagaccagactggctaacatggtgaaaccccgtttttactaaaaatacaaaaaattagctgggcatggtgtttcgcatctgtaatcctcgctacttgggaggccgaggcaggagaatctcttgaacctgggaggcagaggttgcagtgagctgagattgcgccattgcactccagcttgggcaacaagatcatcatctttagataatctgttcatctttagaaacttggtctcaaaaaacagaaaacaaacaaaa

SEQ ID NO: 222556 - DNA, 767 bp, Homo sapiens
tgagccactgagcctggcagtgtatccattttaaaaaacaaaaaacctgattttgatattttctgatattctgttacgtttttaaaggacatgcagacttgttgaaaggaagagcagaaagtggagaaagttgaaagacttatcaaagctcagctaggttagtgttatgtcttagaatccatgtttttagagcttaaattgcccaaagtagaaataaattgagttctttctaagacagatagttttcactgaggttacaaattttcctgaggatacaaaatgagaacattataattcccaaaaatgtttatatgctttttttttgcagttaaattttctaccttagctgttaactaaaaatgtccctgaatagaagcactctttcataatcctatctctgctttgttgtggattcagtattttcatagttgatcgtgtgaaatctataacgtctttgatagacaagtatattgtggccgggcgtggtggctcacgccctgtaatcccaacactttgggaggccaaggcaggcgaatcacaaggtcaggagaccaagaccagtctggctaacacagtgaaaccctgtctctactaaaaatacaaaaaattagctaggcgtggtggcatgcacctgtagtcccagctactcgggaggctgaggcaggagaatcacttgaactcgggaggcggagcttgcagtgagccgagatcgtgccactgcactccagcctgggtgacagagcgagactccgtctgaaaaaaaaaaa

SEQ ID NO: 222557 - DNA, 851 bp, Homo sapiens
gagttccctgtcactggaagtcatagagagattgctccaggcatggtgggagaaaagccagtttgacaggcggtggagggataagagggaagacttgagtgacgtggcacaaactgggtcagatctattaaagaggcagccctgggcagctggcaagagatcatgtcaagagacacaatgcaggtgccagcaggaccagaagatcagcttcttagagcgagtgccacctggaagggggaaaccaagggaaggggcacagcaaagggcaaagctgggtggtggaggaagtacccaaacagagggaagagccactctggccacatcaagtgaatactgatgatcgggaaacattcatgggaagttatttcactctctcgagtccagtgtaagtgagaaagtgtaatttaatttaaaagagcctaatttagccttccatcaactgtagatcttttaacgagacctttattcttctaggacagcatttctcaaactttaatgtgcgtaggaatcttattaaaatgcagattctgattcagtacgtctggggtaagggctgagattcagcacttctaaccggctcctagatgcccccggtctgagcactacacttagagcaagcaggtttgaacattgcgacttataacagtggacccatggtgtagacaagtccagaaatgactgctgaatcaacagtttttatgttagcttccgtataccttcagaattcagtgtttgtgtgcattctaattctctaaatgatgtatattagatttccattaacgaaaatatatgtttaagtggaactctccaattccaacttgccaaataaaataaaaaattcctgtcatttt

SEQ ID NO: 222558 - DNA, 500 bp, Homo sapiens
ggagctagaaggagagagttacctgattttcttccattctgtagatgagtaaattgacggtcgtggtctcagatgccaaggccataggagttcttgttccttctatctctcagatagtttttattgttcactcaacagtttaacaaccttttgaacatttgctgtgtgctaggccagagtttttcagtatttctgtacttgaggcgttctttcaaatacttgacattttgcagtacagtaacagaattaaattactacactatagttatggtacattgtcagctgtaatatatttttctctacctcatcttaagcttttgcatactttcatttaattgaggacaaaggcagtctttctttaatgtgatcttggccaaacactactcgtcatgtagttgaatcacattctacatttttgacatcattgtagcaatatacattttcagttattgtaaaaaaataaatatgaaaaataaaatttacgctttggtcatatcttg

SEQ ID NO: 222559 - DNA, 423 bp, Homo sapiens
agtttttattcataaacaaaattagactgtataagacttggtcctgggttatagacatgagataataaaaaggggacggttgattatgattctcctgagtctctaactcaggaaactggataaatgaaagcatcattaattaagatcaggatttcaggaaacagcaaattatggctggagaagtgattgcatgggaagttaaagtgcacagtttcggatataatgcctaggaagtaatcgtgggatatgtaggttgttatgtccagtagccacttggaaatgtggacttaggaaaaggttttaattgcaattttagatttagaagtcattggtaaagaagtggtagataaagtcataaacaacagatgagatcttgcagggaaattatgcagataaagtaaaagactcctagagaataaaaat

SEQ ID NO: 222560 - DNA, 150 bp, Homo sapiens
aagcttcaactgtacatcatgaataaatcctagggatctactgtatactatagtgactatagttagtgatactgtatagcatactggaaatttttctgagagggtaaattttacattaagtgtttttatctgccccaaaaaaaaaagctt

SEQ ID NO: 222561 - DNA, 200 bp, Homo sapiens
ttgatgtactgcatggaaggaaatcaaagttgttatctgaagatggtttaaggaccaaggaccttttatcagctattcaaacagtaaatatttacagagccactactatattgtgatcctgagaaggggaattaaagcagcagaggtttgcagagtacctgccgaggtccccgcagcatgtgtgaatggacactggaggg

SEQ ID NO: 222562 - DNA, 289 bp, Homo sapiens
tgagactcgtaagttcaggtaacttaccagtcattaaaccacaaagacaaagcccacatttttgaccaccactgcatataactgggccacgaatactaaaacaatgagaagcaatcagtcgtccgaaattcttttgtggtaactttcaggatataaattataaacaccatgataggtgctctagatttatactcagttatgaactttgacaagcattacaaagataacaagtatattagtcagcttttactaggttatgcttcagtaacaactacccccaaatatcagt

SEQ ID NO: 222563 - DNA, 258 bp, Homo sapiens
gttctgcctctgatccctcccatccccattacctgagactacaggcgcgcaccaccacaccggctgacttttatgttgtttctcatgttttccgtaggcgtcatctcacgtgtcgaggtgatctcgaacttttaggctccagagatcctcccgcatcggcctcccggagtgctgtgatgacacgcgtgggcacgacggagtttcactcttgtcgcccagggtggagtacgatggcggctctcggctcaccgcaccctc

SEQ ID NO: 222564 - DNA, 333 bp, Homo sapiens
gttctgcctctgatccctcccatccccattacctgagactacaggcgcgcaccaccacaccggctgacttttatgttgtttctcatgttttccgtaggtaggtatgtgtgtgtgtgtgtgtgtgtgtgtgtgtgtgtgtgtgtgtgtgtgtgtgtatctatgtatgtacgtatgtatgtatgtatgtgagtgagatgggtttcggggttctatcatgttgcccacgctggtctcgaactcctgtcctcaagcaatccgcctgcctgcctcggccgcccacactgctgctattacaggcgtgagacgctgcgcctggctccttctacatttgcc

SEQ ID NO: 222565 - DNA, 660 bp, Homo sapiens
ggttcttacagataaagagcaattagaagtcattaacagagattaacctctattataaaaagtaatagacctaatattttctttatgtcagaactttctcttgagctttgtaaattttccaaaaatttttttaaaaaaagatacctcctaattttgggatagcttcattaaaaacaaaaaggaagaagagaagaaaagttgtgatatattgctgaaaataatggtccttctttgtcaataaaggaaatttttctaagatgtgcagaaatacataggttcaagacttcccgtaatctcccagccaccaaagagagaatttctttttgccccattcatgatctccacttctgaattgttctggcaggactaagatatccttcaggagatcaagtagtaaactatttcttcccataggagaagatggattcttttctagggttgagtgctcaggttagttattttcagttctgactttcttggaataggttactgagagtatccactgctgtttagaaaggaacctaaatgtctgtgaaattcttgcaaatccttgaagatgatttatcttggaatgtggcagtcctatatttggtaggcatttttctagcagaagcattatgtattgcttatgtatattatatatgagaagagttttggagg

SEQ ID NO: 222566 - DNA, 444 bp, Homo sapiens
tgaagaagtaaagaggaaggactgaagaaaaggaagtccttcttctgtaagatgaaaaacaaagggtgacataacctacagctttcttaagaattctctcaaagtgatgaagcaagcctggtcctcccacccaaaaaggaggttttaaaaagtgattggccaggtgtgtggctcatgcctgaaatcacagcactttgggagactgaggtgggcggatcacttgagatcaggagttcgagaccagccgggccaacgtggcaaaaccccatgtctactaaacatgaaaaaattagctgagtgtggtgactgacatgtgcctgtaataccagctacttgggaggctgaggcaggaggctcacttgcactcaggaggtggaggttgcagtgaaccaagatcatgtcactgcactccagcctgggcaacagaccaagattccgtctcaa

SEQ ID NO: 222567 - DNA, 470 bp, Homo sapiens
aatcccttgtgaaatacgtgatttgcaaatattttcgcccattctgtgggttgcacttttactatacatagtgtccttagatgcataaaagcttgaaattttgatgatgatcagtctgtctattttttcttttgttgcctgtgtcttgtcatatccaagaagtcattgagaaatccggtttcaggaagctttttgttgtcttctaagagttttataatttgaggtcttatatttaggtttttgatccattttgagttaattttttatatgatattaggtaagggtccatattcattcttttatatgtagatatccagttttcctagtaccatttgttgaaaaaactttttttttttttgagacagtgtttcagtttgtcacccaggctggagtgcagtggtgcaatcatggctcactgcagcctcgacctcctgggctcaggtgatcctcctgcctcagcctctcaagta

SEQ ID NO: 222568 - DNA, 403 bp, Homo sapiens
aaagcaggcgtcaacgccattgttaatgcacggaggaggaacctgactgttagacctgggttttccagggttgcacggcttctgggagacggatgtgaccctgaggacagggcacaggccagtgtaatgccaggatggaatgagctgtgatctgtgctgtatagaggcctaggccaaggtgggactgacggatgaccaggtcagccgggtcactgaaaacactcttgggtcctcacctgccggttcccaggagtccggaactgccaggagagtggtggcaggtcccccatcctcagctgggtgggcctggatagagcagcaaggcgagggcacatttccctggccattccctccaggcacagctgtgacctgttcattccaaatttgtggaagtatttccaca

SEQ ID NO: 222569 - DNA, 315 bp, Homo sapiens
attaactgggatgtagataatcagaactctctacattagacaggcaacttagcagatgagcaaaactcacaaacacacataaaatgacctcctgcagccacacatcccttttataccttcttagcacacacatttcctagctctgtctactgaaacgggctaaaagcaatgacatctcagttgcaatgagcccagatcttggtttctgataccgttctctgctaaaaggaactaaggctcctcagaaaaatggctgattgcaggtctgagggaaggaaactccaagaagatcctggaacatcttattccagaaaa

SEQ ID NO: 222570 - DNA, 194 bp, Homo sapiens
gatgtgcagaaggtagaacccagccacctgagaactggggtcctggagggtaggtgagattgaaggacaaagactgactgcaaaccaatgaatgaggcagagcaccctctgaggcttaggaactcgtggggttcagtagggctctcctcggccagccctgtgcactgcccttgtctacactgctgctggtggtg

SEQ ID NO: 222571 - DNA, 506 bp, Homo sapiens
ggccgataatttgtaatgttcggtacccagttaatgaccttttacatatggacttgagcagactctgtggatacaatatatctcccatatcccagcgggtcgggcctaattgatatcattagagacccagtgcttttgcacatggccttggagatgtccgcgttaccaagaaagctgcttttgatttattttgcttttcttcttcattctttacctcttttctttcttcctttctcaagtcccgctcaaaggccaaacttgtgacggttaaaaattcacaatccaactgcagggttggaacactctggcttgcaaatctgtttctaaagctgggacatctaacgagtcgcccttggcatgtctaacaggtagtgagagagcccttttttttttttttttttttttttttacaaaaaaggggcagtctatgtgtaagatacactgaaacatttcagtcacttctcagatgtttcttgttccctttggaagaatagtgtcttcttggt

SEQ ID NO: 222572 - DNA, 348 bp, Homo sapiens
ataggaactggtccagttgccatttttctgcctttcaaggtaagctgagtcaggttcacagaaccgaaagcctaacaggaatcttcaagggatctgggttttctccgacctgcctttttcaaatcatgggtaactgggctttgagacagacacaaagccctctttcagcaagcctaaggatttctgtccctagcagattttcccagttacacacgcttgtgtgcaatggccgtgtttacgtgggcagccgctatattctctctagctcctgcttatggcagctctctggagttacttatgaatatgcagtcaagttgaggtgtttaaggctgtgtgcctgaggaagca

SEQ ID NO: 222573 - DNA, 486 bp, Homo sapiens
ctcacttagaacctgttttttaagaatacagcttaaagccatgatttgatagaatactcagagatcgtacctccagtacctcactcagtcttcctgagagtcaggtgtgaaacctacccttggttgagtacttttgaacctcagtatccctttgcaagaatttatacctctgccgtatggcataagacttcagtttttaatttttttacctaggtaaacatgaattgggctttaactgcttttgttgccttaactttaaaatttttttaatgttactttgatggttggagtaatactaaagagtaaaatgctgaattacccttgtttgcaaagaagttttactaaatagccctgctgtaactttacactagcaaacaaattctaaactaatggaaccatctctagttataatgaaaaattactagggttcattttagtgttaaaattccaactgtaattaacatttgctttgtttaacaaatgctt

SEQ ID NO: 222574 - DNA, 293 bp, Homo sapiens
ccttccactatgattgtaagttgcctgaggcttcccagtcatgcttcctgttaagcctgtggaactttgagtctattaaacctcttttcttcataaattgcccactgtcaggtagttctttatagcagtgtgacaatgaactaatacaagggtacttacacaaacctaaattatgtaacataagtaggctatatagtaaaacctattgctcctaggctacaaacctgtatagcatgttactgcactcaacattgtaggcaactgtaacacaacgataagtatttgtgtatcta

SEQ ID NO: 222575 - DNA, 451 bp, Homo sapiens
aaagaaagaaaagaaataggatacttcaactattctatagcactagaagcactcagaggattggtgggtaaagggatctgggtgttgcctttaagaaaaagttggtgttacgatgacttattaaatgaatgtcattctttccctgacgctactcattcccaccatctacctactcatataattataacattggaagagaatagtgaattcagatctctatgtatctgaactgggatcaggaaagctcaaaagagtatgatagtgcaaagacttattcctttgggagtgggttttaaagaagtgtgatttgccctagtatattaaaagaccagtggctcatcagaagtattgaagacattaaaggctcaagaatggtccaggtaagagaccttttgtaaatccttaccacagttaatcagaaatagaatgcaaagaattactactcaacaaa

SEQ ID NO: 222576 - DNA, 452 bp, Homo sapiens
cccagttactcaggaggctgaggcaagagaatagcttgagcccagaaggcagaggttgcggtatgccaaaatcgcatcactgcactccagcctgggcgacaaaacaagaccctgtctcaaaaaaataaaaaataaaaaaaaagaatgtaagctccacaagagcagacactacccacttccctcactgctgcagctccaggacctagaccagtgcctggcacgttgtaggcattcaataagtatgtgttggataaactttttaatattatttcccatagttctcactgcagcctccaaaggtaggtatggtgtttatctccttacagaaagagaacctgaagctcagagagactaaatcacttgctcataatcacatagctaataagtggcaatgccaaggtttctaccccagtctaccaccttcctgcattcaccctcgccctcatcctgaa

SEQ ID NO: 222577 - DNA, 593 bp, Homo sapiens
catagggtctagctgttagccacgtgctcagctaagacactggagccctgatattaaagaaggtgaggaatgatgctagtgctcaaccagcagtctctgtcacatcagctttgcagaatcatttgattctttcaactaggtgcatatacaacttcaatacaaatgaaaactaaatataagacatggttcttaaaaatcatcttttgtacaattgaggacacaatcaaaacccagacaccagggtcctgaagcagaatgcaggcatccacagaagaggcggtgctgatggactggaccccagagagtccacacctgcttggtgccataccttgggtccctccagatcaggatgctcccagcaacttttctaggatggttatactgcacatgctgcaaagatgagtgggcatccctgcaagcctatggttttagagtaaatggttccaaaagaaggtatgaagcagacccatagatggggattagtgcataggaggtttattggggagtactcttgggatcaacatctgtgagcaacgagaaagaagcaggattgagcagggaagaaggtgggtgttctggagctgagatcaaac

SEQ ID NO: 222578 - DNA, 449 bp, Homo sapiens
gcataaaggaacatgcaaactgatccaaatgtttataaaccaagtattcctctgggactcagtgccctgactttatgttttttaaaacatagagagtcaagctttgttcatacttgaattatgtacattgcattagccgtgcaatttaactttaacccacaggactgcaaagaaaattagctcagcctgcagaacaacgagaccacgagcaagtaagcacgttaatcaaagtgaaaggctcacccctcacgtctagctccgtccttctccagcctgtgcctgccagattatttcgggttcctcgtgtttgactcgtcaaagtggcagaaacaggctaaaatgttcactgtggaaaagggatttgccttttaaattaatgtttgtgcacatgccccgaggaggctgatgagaagcacgcaatttttttaaatcataagtgaatgcatacc

SEQ ID NO: 222579 - DNA, 645 bp, Homo sapiens
  misc_feature (591)..(591): n is a, c, g, or t
  misc_feature (623)..(623): n is a, c, g, or t
gaatatattttgtcttctactcacagaaaggaagaggcttggaatgtgattgaggaaaaattgctgtttatatatttaatctctattaataacataaaaataccatattagtagaggtttggaaattctaaaacaatgtattccagagataaatctttacccatgttatgaatgagaaatgtaaaaactagaaagataaaaacaaatagttaagatggtttccaagtatttcctgtagacattgtataataggttctatacaggaaaaaaaattccatgagaaaataacttcgtgaaacacatacattatatatctctcttggagatttaaaatacatattaacttgttattgactcaaagaagtcctgtaatcaaaaaatgtacttaaatttttttaaatctagatttttccaaatttgtttaaccatgaagtggaactaatgtcctcagaacatacttcagaaaacccatctctaccaaaaatacaaaaaaattagccaggcatggtggtgggcgcctgtaatcccagctaattgggaagctgaagcaaggagaattgcttgaacctgggaagcggaagttgcggtganccaaaattgcgccactgcactccaaccccggnaacagaacgagactccctctcc

SEQ ID NO: 222580 - DNA, 507 bp, Homo sapiens
ctactactactaaattcgcggccgcgtcgaccatgaaatgatggacttgctcagaacctttcatctctctctctccctgtctcatcaacttttttagagcagttttaggttcacagcagaagcaggcggaaggtgcagaggtacataaacccatgagtacccactgcctctgcacatgcgcagcccccccattgtcagcatccccactagagtggtcaacatgcgtgaacacgttatcatcaccaaaagtctgtagactccaagcctcttgttttcatcttgtctttgcctgatccagtgtagggtggatatgtagggagccagggcagctttcaagaaggaagtatgacctgttgatagcgcacactgcagtgcagcagggaacactgctgggtcctttgctagaaatatcttgttggtttctctgcaacatcttccttgacaccatctgttcttttgcctccaccaaagattgcccttgttacaggtataggtttcaccagatgg

SEQ ID NO: 222581 - DNA, 156 bp, Homo sapiens
gcaaatttatatagtgatttcaattgtccttcacattccctttcctgtgataagtgtctgggtttagggggtcacagtgtgaggttccaccatcttcagctatctgagacatagcttctattaataaatgttcctcttaaatgtttctttctgaga

SEQ ID NO: 222582 - DNA, 506 bp, Homo sapiens
tttttttttttaatgttggtttcttcccccagatgaccaatggtgttagattgtttgctcatatttaagaataagcccctgaaaagaactaactgaaagatctgtgtgggaaaacagggcttaacgactggtagaattcacttaaggtactctcagcagaaagcctatcagtatctgaagatgctgttatcttcagtcttccacaggagaaggataggacaggcttgactgtgcagttctggaaggagagcagaggaagagagctaacacttctatagttcaggcgtaggtttcccttgatctccttgttttttttttttttgttttttttttgtttttttttttttgagacggagtctcgctctgtcgcccaggctggagtgcagtggcgggatctcggctcactgcaagctccgcctcccgggttcacgccattctcctgcctcagcctcccaatgtgctattcttttcccaaaggtgcaatctaaactgtcaaacactgtcag

SEQ ID NO: 222583 - DNA, 538 bp, Homo sapiens
ggatgggtcctgggtgcacagcccaggtcagaaccataggctggctgcatgctactgcctgtgagtctgctgacaaaaaccctcatcaaatgagacccagtgctgggtctaagctgaggacctgatcagaggacatccctgtgaaaatccgagttctgctgaggacatgtaggaccacggggtgggagggtgaaagtggccctgcaggcccctgatgattgatccaaatctccaggctcagctgccccagccctgagccctccctgtagctcgtcacgcaagcattcagtaatctagactgacagctcatgacgacttattcccaggaggtggcctgggtggctgtcagagggactgacgccttggcccgggttgctcccctgggtacagctcactccatggcagccactgtctggacctggctattgcatgctggggcctctggtctccctgtgccccgagcagtgaaccgtcttcctcttgctctgaccccttgagtctcatcgtccacttccggcccgggtgaagctgcggccgc

SEQ ID NO: 222584 - DNA, 441 bp, Homo sapiens
gaataatttggtctctactattaccttaagagaccttcccctgtcttcgatttaaaaaaaaattactgcatacaaagggtaggagctacaagggacatagaataatttggactccactactaccttaagagaccttcccctgacttctcttttaaaaaacctatgggtctctgcacccctgaacttactttctacacctatttctctcttcacccccaaaatccatattagaatgcccctgcaggctataaagcctttcataaaagtaaaatacccagtcttttcaagagaacaataaaataggcagtctcctacctcttgtcttactctaatataaactccatgaagataagtattgtctccatactgttcatgctgcacagcagttgcccttatctgcagggcgacgcatcccaagacccccagtggatgcttgaaact

SEQ ID NO: 222585 - DNA, 443 bp, Homo sapiens
agatggctcttatgcattcttttgtctttaccaccttaattaaatgattctgaaatctcttgatcccttttcctgcacttaaggctcacactcttactaatgggaatattcagctggttgccttgttgtctcctataacttttggtgtgtccaaaatcaaagtcttcatcttagaacaaacttcatggctttccttgatcttgttattggtactggtattattattcatctaggcccattttaataatcattgattctttctcttatcccccttcaatttatttaggcacacagttctagtctaactttgtttaacacagtttgggctgggcacgtggctcatgcctgtaatcccagcactttgtgaggctgaggcggatggattgcttgagcccaggagttttagaccagcttggtcaacatggtgaaaccccatctttact

SEQ ID NO: 222586 - DNA, 539 bp, Homo sapiens
acagccaggggagagagttgacttgcagaccacacaacaggcgctggctgtatctagcatgaggaatcgcagagacatccacgggacttcctgcaggaaggaagaggaagagaagtcgtatttattgggcccctaccctgggaaattccccacgttggtgcttttcacaggttgttgccctgagaggcagatattatcatcccctagtcatgaaagaggaaaccaaggctgcaagcaggaaagtgactcagccaaggtcacacagctagaaagtggtagagatgggactcaacatgacatctcactccagagctggcagctgctacgggcgctgcccctgcttaaccgtgaccttcctgggatgacacgccggcctagtggcttctcggggctggtcttgaggacattcatacgcttcttcagcaaatacttactgagtgctactgtgtgccaggcactattctaggcacatcagatacagctggaaacaagacagacccaaatccctggtgcttatattctagtgggaggagacagag

SEQ ID NO: 222587 - DNA, 725 bp, Homo sapiens
agcattaatcaattccagttctgactcatttcagaggcttagagtcagaactggaattgattaatgcctccaagggcattttgagcattaggtcaaaaatttattgtttattttatttcccatgcaaaccataaccacatcatccaacccagcttaccagagaagatgattcaactagcccaaataggccattatgaatatttgaaaatttaagcttctaaattaaaaaaaactgattatgaaagtaattatatttaaaaaccattactgtatgtagggggtaatattaatgcttttgggtcaggatattatcccaagaacttttggaatgaatgtaacgtaagttgcttcttatataaatggagtaaattcatctgatgagtccactcatggggaaaaaaaaaagccagttttacataagaatgcccttagtgaagcaataaaaatgatgaattttattaaatcttgacctttaagtgcatgtcttttatttatttatttatttgccaagaccagcttgtttggggagaccctaacccagcagcactagaggaattaaagacacacacacagaaatatagaggtgtgaagtggggaaatcaggggtctcacagccttcagagctgagagccccaaacagagatttacccacgtatttattaacagcaagccagtcattagcattgtttctatagatattaaattaactaaaagtattccttacg

SEQ ID NO: 222588 - DNA, 526 bp, Homo sapiens
taatcagccaccaagtgataactgtctgaagggaggcttgctttgccatatggtgctcagctgaccgtttataattgccaaggggccttggtacctcggatttgtggagatgccttttttttttttttttttaacctcctgtgacacagaattacttggagttcagtagccaaatgttacttgggactctggaatgatttttcatccaaattgttctattttatatctttatatcaatagagagaaaaacatcctgagctcttgaaccatttctttgtgttaaatactttttccaagtggcagatcggcgtgggggacacctgatgttattttttgttacactaacgtccgtctcagtaaggtgatgtcagaatcttactcattcacccagcagtgagtcagggtccttgattagtgaatcttgattagtgaattttaggggtctgttattgacgctagagtttctaaatgattaaaccaaaggcttgctttcacaaaataaataacaaattcattttcatataga

SEQ ID NO: 222589 - DNA, 506 bp, Homo sapiens
tggtcttgaactcctgacctcaagtgatctgcccgcctcagtctcccaaagtgctgggattacaggcgtgagccactgcgcctggccttaaggtagcaagtcttggtgacttggcacactggaacacagagccactgcgggctgcatggatgctctgctgtggctatgcacaaacgaataaatcacacatggcaaaactctctgcttagtgattccatcgtaatcaagacaccagccgaattcagggaagcatgagatcaggcgactatgacaacaaagcaaacaagatatgatatttattactcttattatttagaacttgtaatattttcaaccacaattctgtcagacaatgtattccttcaatacacaggaacacactaaggcagtaatacattatcaaaagccaactgttaaaagaccagagtaaaagcagaatttagacaaaacaaatagtctcccagactttttattccttccaaacttgttattttaagttataatgt

SEQ ID NO: 222590 - DNA, 424 bp, Homo sapiens
cagggtagaagactctcatgactacctgcacgccaccatcttccccggcctggcgcaattgccttcaggatatgtacagcatgacccacagggatttcacttcatggaatgcaaaaccaacctgcatgagctttgtttgaaaacaaaacaaaacaaaacgaaaacaaaacaaaacaaaacagagaaatcctatctataaaattactcttaatggaaattctgcctgtataaaattaaagtggcaggtgagaaccattttcagcttgcttatgggtctcttacagattttccttgaagtttcatgtgttctaattccctgatatggagggaagagactacagttgtgtttacctcgaattatcattcaaatagaggtggtgttttcccccagtaaaattactaaggtaaattgcctatttctata

SEQ ID NO: 222591 - DNA, 511 bp, Homo sapiens
agatataatttcatagtgaaaacgttgatagatgctaaacaactacataagcagatgattcgaaaccatccccctgcttagacaaataactttgaagacaaaaataggcatgctaggtaggtagaacaaatcacctaagtatgtttaaagccttagggttccagaaggaggaggagagagaagaggttgtgcaaattggcaagccataccctttaggatcttaaaggttttaacaaaacaccttgggggaatttcattttctgactatttaacttccctatcttgcatttttcatctacatgtgagtatacattccatatattccttccaacatccaaaataatcgttacatagagagtctctatagaatcgttaagtcattcctttatttaaccacccttttgctaacaacatttaaattactagacagttcactcttaacatacactatttctttcaatcctttaaaaaccatgtgagctaagcatgttaataaaagtaacaattgaaa

SEQ ID NO: 222592 - DNA, 544 bp, Homo sapiens
attctcagagaagaaggaaggagaggcagatagcatttcatttttactactaagggatgcctcactgtgtttctattaatgcttatctttttgccttaaattctattttgtttgatagtaatatagttgcaacaattttctggttaatgtacacatgatgttatctgtttctacccattcacttgcaattttttgcctctttatgttttttaactgtacaatgacatacagaagtttattcagtttatacaagtaatttctcagatttataaagtaaaaagctagactgccagaggaaaaattccttacattgatatcaaaatatcttctagtccccataaatcatctgcaatcacttgatagaaaaaatatccacaaccatataggtcatgcagacttttaaaatgctatttgtattcagtttgtttcaaactgagcaaaacagtgcaacttttacttttgtatacatttcaaaattatattaatgttccttctcatttcaactcatcccattaccaataaaacgggagtgagataaaagggg

SEQ ID NO: 222593 - DNA, 320 bp, Homo sapiens
acttgtaattggcctctcatctgtctatttctttggaacatcaaagttgagaagatttgtagaagatgttaataaatctgtggtaatgagagtagaaattgtgttgaagtttaaaggaaagaacaaacatgataagatattggtagtacattattagaatatttctgtttaaattaaaatagtatttcagttattataacatttgaaaattcggttggagaatgttttaaagttattaagactgccatctgctagtaaaaattattgtttcaaacttcctgaggcctccagcttgggtgacagagcaagactctgtctct

SEQ ID NO: 222594 - DNA, 413 bp, Homo sapiens
ctggctgggacttccaagtactatgttgaatagaagtgatgaaaatgggcactattgtcttgttccatttctcagagaaaatgtttccaactttttcctgttcagtttaatgtttgctgtgggtttgtcacagatggtttaaaaaaaaattgaagagattgattctgagccatatatgagtgacaatggcctgtgacacagctctcaggaggttctgagaacatgtgcccaaggtggtcggggcaaagcttgcttttatacattttgtaatgagacatcaatcaaatagttttttgggttttttttttttgtttttttgagatggaatctcactctgttgcccagactggagtgcattggcgcgatctgggctcactgcaacctccgcctcccaggttcaagagattcttctg

SEQ ID NO: 222595 - DNA, 418 bp, Homo sapiens
ccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagacca

SEQ ID NO: 222596 - DNA, 427 bp, Homo sapiens
ctctggcacttgctatcagtacaagaagaatttcctctgggtagtggctgctacttgttgtgagtctgggggaaacactattggaggtgacaagagtccaaactgcaatgatgtgccacattcacccagctgcatctgaactgaagcagggccccagccaagccttgcctgagatcagcagaccctcgatgacccacaaaaattatctgcttaggacacagaagtcaattacacccaaaccctggatggaatcagaatcagaatcagccatgcaatgaggaagaagaaatgtaagttgcggcctgtgattccaacagttctctttctggaatggctaccaagagaaagtgtcctgcaaatcacagtgtccaacagaatcaacactggtaagaataaccaattaaataaaaacttgattctaataata

SEQ ID NO: 222597 - DNA, 507 bp, Homo sapiens
gattaaaaccccggcaacccttgcacggtttctgacttggaaacacacctccggaacttaaggaacagcttccccaggggggtcctgcacctgcctgggcttccattccctgatcctgcctccaccaacacaaagggccagggcagctctgaaggtgatagcggaaataacatctcaggaggctcttcagcgcctgctgcatcccaggacggagccaccacagtgccctctacgtctcccacagcgagcgcttccctagggaggctgcagaagttagcgggtaacacggttttctggcagacacagggcagaaaaatcggcctatggcatacccatttcctgcttttaaatgtggacagcctgtgctggatttttgtctgcttctgtcaagttaagtgttgtggaatttgtgccattaaaaaagttttcttgggccgggtgccgtggctcatgcctgtaatcccagcactttgggagactgagtggggcggatcacctgatgtcagg

SEQ ID NO: 222598 - DNA, 101 bp, Homo sapiens
actcttcactttccaattgttttactacatttactatgacctttgctcttgtggttattgaatctgcatggaagtaacaccatttaatgatatgctactgc

SEQ ID NO: 222599 - DNA, 648 bp, Homo sapiens
actgaattaggcttgtcaggagaaaaaatagaacactagttttcacaatttttacccggtagtagctcatgcatgaggctaagcatgtagtcctcatactatcaccttgaggtaaagtcctgttatccacaatttacatatggggaaaggagattaagtaacttccctaggtcaagcaggtagaaatggctgcacaagactcaagccttttactggttttcttcctaacagacataatttcttaagttctgtgagaaaattacaaagaaatctggaagcatcacattatccaacttcaaactatattataaggccttagtcaccaaaatagcatggtactggtataaaaatagacacatagaccaatggaacagaatagagaacccagaaataaagccacatacagccagctgatcttcgacaaagcaaacaaaagcataaagtggcaaaaggacaccctattcaacagatggtgctgggataattgacaagccacatgtagaagaatgaaactgtatttacttgcccctttcattcctctctgtgagagccatgcaccattgctgcttcttgttggccatcttggcccaaatcctctgtattcttgttgccagagtagaagtggtttcctcttcttacctggaagtt

SEQ ID NO: 222600 - DNA, 902 bp, Homo sapiens
ccaggttcaagctattctcctgcttcagcctcccaagtagctgggactacaggtgcgaaccaccacgaccaggtaatttttgtatttttagtagagatgaggtttcaccacgttggccaggctggtctcaaactgctgacctcaagtgatccacccggctcggcctcccaaagtacaggcatgagccaattcgcccagtgataaatgcttgttttaagcttctgggttttggggtggtgtgttaggcagcctcactggggcagtggctgacgggtacaatcagatgaaccctgaggcccctggaagcttcgagtgtctatgagggacctttcccggcctttcagccaaattggaagacccacttctctggactggatgctgcattgaattgagcaaaggaactgagtgcccggggagctcaaagggaagcagcccagccttccttccggggcagagcagtggtggggacctgtttccagctgcttgtgccccccacttcatggaggagggaccagggatcctcagaggagagggtgatgtttgacagtggctgcctgccctgaaaatcgcccttgtctgtccagcctggcctgaatttcacccacatcaacccacatgggatactttatttatttatttatctatttatttatttatttatttattttagagccagggtctcaccctgtggcccaggctggagtgccgtggtgctatcatagctcactgcagcctcaaactcctgggctcaagtgatcctcccgcctcagcctccagagtagctgggactacaggaacacaccactgtgcctggcttatttttctttttttttttggtagagatgggggtctctctatgttgcccaggctggtctcaaactcctggcctcaagtgatcctcc

SEQ ID NO: 222601 - DNA, 746 bp, Homo sapiens
ccaggttcaagctattctcctgcttcagcctcccaagtagctgggactacaggtgcgaaccaccacgaccaggtaatttttgtatttttagtagagatgaggtttcaccacgttggccaggctggtctcaaactgctgacctcaagtgatccacccggctcggcctcccaaagtacaggcatgagccaattcgcccagtgataaatgcttgttttaagcttctgggttttggggtggtgtgttaggcagcctcactggggcagtggctgacgggtacaatcagatgaaccctgaggcccctggaagcttcgagtgtctatgagggacctttcccggcctttcagccaaattggaagacccacttctctggactggatgctgcattgaattgagcaaaggaactgagtgcccggggagctcaaagggaagcagcccagccttccttccggggcaacatagcgagaccctgtctgtatgaaagaaaaaatgaaatacacaaaactgggttacatagtgactatttgatgcacatgttgtgagcagaggctcacagtaacctagctgtgttttcccctctgaacagtggctcagtgactggccaactctgtgcgtgagggagctttgcgagaacagagctgccgcgaatttacgagaagtgaggagctccttgtggcaagcagggacagcacactccactggctgcccgctcacctccacgcctggaactgtgactgttccctgacatt

SEQ ID NO: 222602 - DNA, 209 bp, Homo sapiens
gagagggagtgggtttgagagccggaacgaagcgagctggcggtgggcgtgcggagtggcagcaacgcgagagggaacgcgctggggctagcgcggaggcccagagcccaggcgggggaaaaggtgccgaccggcttcgaagggaggcgacggccgagacacacggtccggcgcgagccaggcgccccgcgacgtgcaattttattttg

SEQ ID NO: 222603 - DNA, 428 bp, Homo sapiens
tgcctcccaaaatatcttcactacagttatatcaagttgcctaaaattctcagcctagcagtctcttgtttgaggtaaattacaattctctgggagactttatagctgtgaaatatttaacctatgagggaaatacctttgcagctagaaatacaattttcaggtatttgtggattcaatgaaaaagaaataagccacaaaggagagattatcatgaaggaatggtttagagtttgaaagaatgatgtgttcagactctgggctgaatgaggcacagagaggcaacaagctttgaaagtaacagaagcagtaatgggaggtgagggagtggaagacagattttaattctgtgacttttttcctactgctggctttcgttctagcacatacatgattctggaaaataaagcatagtgttctcttttcta

SEQ ID NO: 222604 - DNA, 692 bp, Homo sapiens
catagcatatgtgtatttatataacaaaaaatgaatcaaaagttaattttattttgggcagtgttccctagaaacttataatatggccccatgcacttcaggttgaattttcttagtaaaatcataaagaggtccattttttcaaaaaatcaccaagtcaggctgcaagtttagaggttacttctattgtttcacttctctttcttcccagaagcagaccccagagacctgtgagccaaactccactcaccttttagcttattctaaatgtgtcctgcgggcttctctgtgaataaaaggcagaggctttttgacttcgtgtttgatgatttggcttttttcttttttttaccacctgacgggggatttcaggctcaatgtcccaatcgaaataagaatctttgagtgggttaacattgagtcttaaaaaggagggctgatttgttggagaggcaacaacgaattcatttttcactgtagagcactcaggaggagtctgaagctttgtcactgggcaacagaatgcctttctaagtaaatatggaaaatatgacctttgaaaatctagctgatatgatatatagattcttaggatataatttttaaaaaatatattatttccaagcactaatgatactccagagatactgcccacaaccagatgcagcatgtttatagtgtatctaggccaa

SEQ ID NO: 222605 - DNA, 411 bp, Homo sapiens
aagcatggtggctcattcctgtaatccctgcactttgggaggccgaagtgggcagatcacttgaggtcaggagttcaagaccagcctggccaacatggtgaaaccccatctctactaaaaatacaaaacattagctgggcgtggtggtgcgtgcctgtaatcccagctactcgtgagactgaggcaggacaatcgattgaacccagaaggcagaggttgcagtgagccgagactgcgccactgcgctccagcctgggcaacagagtgagactctgtctctaaataaataaattaattaataaataaatgcctacaactcagagactgaagctgcaacactatatttatgagatgactctttttccataaaggacatgtcttcttttccttgaaaatatacttttcttggta

SEQ ID NO: 222606 - DNA, 418 bp, Homo sapiens
tcccagggggcagctaagtgcaatactatatgttaggaaaacggaaactaatttgtagacagcactaatgatttccacattaggtaaaaaaaattttcattcttgtcttcctaatagcatttaaacagaaacgatttttaaaagttgttttaaacatttagaaacatcatggcatagaaacatttaggactcactctttgtaagtactgacaagcatggtcttgtaatctgtaaagataaggtagaataaatgaactaaaagaaattttagatgactaaaaggactatataatagaaagagggaaatcttggttcttaaaaattcaggcaattgaaacatttctgtataataccaagcattgttgcagtattgtctgaaatggttgcttttctaataaatgaaaatgactaaaatgta

SEQ ID NO: 222607 - DNA, 697 bp, Homo sapiens
attatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttatagaaaacgagaaaaaagaaaaaaatgagaaacaagtaagaaaaaatcctttcctaggcttttccttgatcttcagaggcacacagggtttaatggttccttaggttattattttgaggttttgttctttcttttgccttaagtaatgacagaagatatatatggccagacacatatgtataaacttttcagcagcattttaataataaaatatcacactattttctaatgctttgtacaa

SEQ ID NO: 222608 - DNA, 508 bp, Homo sapiens
tgagccctagatatacttggcttgcatttaggggccatgatgtttagagatgaataatgccttacatgctggagtcaccctcagtttgtcaaagtgttcacactgtgagaggctcacagaaatggaggctgactgaaggaagagcagattcacatctttcatcccttctttatgctcatgcttctaatttttgttcccatgttttcttgcccctcctcttcttagcatttattttgtctgtttctctttcccctcttctggctccctctccatctctcctgagcacagaaatgcggctactgtatttaatccacagtggccccctctggccccctctttgtgtctcctgagcacaggccctggccccctctccatctctcctgacctcctgatccgcccacctcggccagttattgctgttttataaggaaaatgttttctagtaccacacttgtctccctggaagggatagaagaaggagggaaggaagtagggaggcagggaagag

SEQ ID NO: 222609 - DNA, 720 bp, Homo sapiens
tgagccctagatatacttggcttgcatttaggggccatgatgtttagagatgaataatgccttacatgctggagtcaccctcagtttgtcaaagtgttcacactgtgagaggctcacagaaatggaggctgactgaaggaagagcagattcacatctttcatcccttctttatgctcatgcttctaatttttgttcccatgttttcttgcccctcctcttcttagcatttattttgtctgtttctctttcccctcttctggctccctctccatctctcctgagcacagaaatgcggctactgtatttaatccacagtggccccctctggccccctctttgtgtctcctgagcacaggccctggccccctctccatctctcctgaccacagaagtggggctgctgtaaccacttgggctccatagttctcaggatgacagtttcaggcacttaaccagatcctctttgatttggaatggggcggggaccagtgttctagcctgaccaggtttatactgcaacttacagtacctatgtttcaggagtcagtctgggggcaacatgtgtcaccttgaagattagatctgaactaggctcttgggggatccagcctgatctggtgcctataaaatgttcagacctgattaataaattctgagtatatatgggattctagggcttactatgcggctactggagacttgggatacacccagggatc

SEQ ID NO: 222610 - DNA, 1112 bp, Homo sapiens
actgtgggttaccactggaggggtttgagcagagccatggcatatactgatccaagtggaagcagaaaaactgccaggaaaatgtcacagccaccccttactgaacagcagaaacaccagcaaaacaccaactgcaacatggtgtattttgaaggtgagattaaatttacctacacctagagaaataattggagcacatgtctatttgggccaagaggataaaggccagtagaggaatcagatcaaagaacttcctcagggaagtgtgcagagaactggagtggaccttcccctaggaagctgcccaaaacgagagtgctggaaagctggccgcagtgaggcacttcagatcccaagggtatgctggggaagctgccacaggtgggagcacttgctgctggaccctaggcactgttgaaacaactgcaccatctgcaggagcccagcaaggtgccttcagccatgattataagtttcctgaggcctccccagccataagaaactccaaagccaggcatcccatctggagagagagaagactgaagcagaaacacaatgggaaggaagcaaagatggagagacgagtttttggattcaactgaagcccttgctatctgctagagtcagagtcatcacaattggggggtcttcattaagctacactttttaatggaacatcctagtgaggtttgagagtacagcttgatggtctatattacattactaagccgattttatgggttagtctatacgttttacaaatttgttattctaatctccccgaagaaataatttccttattgatccctttctttttcccccattttattttcccatattttgtgatatcctctacttcaactttaaaaaattataaccatagaaagaaatacattttacattatgacccagtgtgtatactcacagaaacatattcatatagaaaacaagtttcacgaaacaatacttcctctgtacagtgcactttggtgttgttattgtgttctattctattcattttcttccatcctactatgttataaaagttgctcttttacaaatctgtaatttgatcttatgacccactgacatgtctcaacataccatttgaa

SEQ ID NO: 222611 - DNA, 680 bp, Homo sapiens
taattcaaaaaaagaactcctagttttactgtgctggatctggttgtctttagtttccattatattcctgttccattattccttcaataactttgttctcccatgactcttctttattgttaccacattttttctgttcttttcagagacgagtttttggattcaactgaagcccttgctatctgctagagtcagagtcatcacaattggggggtcttcattaagctacactttttaatggaacatcctagtgaggtttgagagtacagcttgatggtctatattacattactaagccgattttatgggttagtctatacgttttacaaatttgttattctaatctccccgaagaaataatttccttattgatccctttctttttcccccattttattttcccatattttgtgatatcctctacttcaactttaaaaaattataaccatagaaagaaatacattttacattatgacccagtgtgtatactcacagaaacatattcatatagaaaacaagtttcacgaaacaatacttcctctgtacagtgcactttggtgttgttattgtgttctattctattcattttcttccatcctactatgttataaaagttgctcttttacaaatctgtaatttgatcttatgacccactgacatgtctcaacataccatttgaa

SEQ ID NO: 222612 - DNA, 471 bp, Homo sapiens
actgtgggttaccactggaggggtttgagcagagccatggcatatactgatctacgtgtatgtgtttctaagcaaaacttcttggaagaaaaggaaattcttagaagcaattagagtatcacacccatgctataccctttgattcattagcttgctctgtttttctgttattttgaaattacccaagtggaagcagaaaaactgccaggaaaatgtcacagccaccccttactgaacagcagaaacaccagcaaaacaccaactgcaacatggtgtattttgaaggtagaccaaatagcattttctgataatttggatataaactgtgaaagaaatatataagactcaaggatggttccaaatattttggcttgagagactgaaaatatacatttaccatcatttatgatagggaagcctttagggagaaaaagcttggaatgagataataaagattgtaaatttcagttt

SEQ ID NO: 222613 - DNA, 1243 bp, Homo sapiens
actgtgggttaccactggaggggtttgagcagagccatggcatatactgatctacgtgtatgtgtttctaagcaaaacttcttggaagaaaaggaaattcttagaagcaattagagtatcacacccatgctataccctttgattcattagcttgctctgtttttctgttattttgaaattacccaagtggaagcagaaaaactgccaggaaaatgtcacagccaccccttactgaacagcagaaacaccagcaaaacaccaactgcaacatggtgtattttgaaggtgagattaaatttacctacacctagagaaataattggagcacatgtctatttgggccaagaggataaaggccagtagaggaatcagatcaaagaacttcctcagggaagtgtgcagagaactggagtggaccttcccctaggaagctgcccaaaacgagagtgctggaaagctggccgcagtgaggcacttcagatcccaagggtatgctggggaagctgccacaggtgggagcacttgctgctggaccctaggcactgttgaaacaactgcaccatctgcaggagcccagcaaggtgccttcagccatgattataagtttcctgaggcctccccagccataagaaactccaaagccaggcatcccatctggagagagagaagactgaagcagaaacacaatgggaaggaagcaaagatggagagacgagtttttggattcaactgaagcccttgctatctgctagagtcagagtcatcacaattggggggtcttcattaagctacactttttaatggaacatcctagtgaggtttgagagtacagcttgatggtctatattacattactaagccgattttatgggttagtctatacgttttacaaatttgttattctaatctccccgaagaaataatttccttattgatccctttctttttcccccattttattttcccatattttgtgatatcctctacttcaactttaaaaaattataaccatagaaagaaatacattttacattatgacccagtgtgtatactcacagaaacatattcatatagaaaacaagtttcacgaaacaatacttcctctgtacagtgcactttggtgttgttattgtgttctattctattcattttcttccatcctactatgttataaaagttgctcttttacaaatctgtaatttgatcttatgacccactgacatgtctcaacataccatttgaa

SEQ ID NO: 222614 - DNA, 453 bp, Homo sapiens
aactgttgtaatcagagattgtctatttccatgcagccaaagccaggcatcccatctggagagagagaagactgaagcagaaacacaatgggaaggaagcaaagatggaggtagaatagctgccacgagccctgatagtttcaggccttgactgcatgtccttaggatctcaggcttctctgtttttcctttgggttccatgaaaaaccccgatattttggtaataaacacccttgggttgctttgcctggcttgaagattttgcttacaaactaaagaactgtggacaagatacacttcttgtctcaagagggcctgtatattttaggatttaactgcgtgtacatggaaagaaaggtcaggaacgttggttttacctctcttctcgatgagaacagcactgggctcccaatcactacttaacctttatcctgcaagttctagtttttaaaa

SEQ ID NO: 222615 - DNA, 2871 bp, Homo sapiens
  misc_feature (2)..(2): n is a, c, g, or t
  misc_feature (4)..(4): n is a, c, g, or t
antntttgctcagcccgcctgcgccgcttgggacgcctctgcctttccctccctcccttccccgacggcttctggcggccaagtggatgtggcgggtgatcgagccaccctgcccaggggcgcccagcactggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcaggggcctgttgacatgaagtttcgaagtttcatgttggctttggaatggtagcaaaagcctttcctggctgagatgatgcttaaaacacacctcacttattgtacatgttggaaccaggacatgagagacatagaaaaacagaagtcatgaatgtaaattgaatgagaggcttaacatgcatgaaaatacagatggacctgcaggaaagtgagcaaacatcgctgagtttgttttcttgttcgggagaatggggccggggctggcctggcctcccctggatatactctatagtgcaccaaaaggataaagcatctgtacatgtatttttttattttttatcagaagtgcttagacaagaacagaataagcaggctgtttggatgctacttgtggttgaattgtgttcccccaaaatatatggtgaagtcttaacccccatccccgtgaatgggaccttgtttggaaatagggtctttgcagatatagtcaagatgaggtcacattggattagggtgggccccaaatccaatgactggcatccttaggagaagagagagttttggtaatagacacaaatgcagtgggaagaagaccaggggacaagaggcaagttggagtgatgcagccggaagggaagggacaccaaggatctccggccaccagcagaagccagcagagaggcatgggacaggttccccacaagccttagaaggaagcatggccctgacttcagaattccagactccagaactggaagaataaatgtctgttgttttaagctgctt

SEQ ID NO: 222616 - DNA, 2800 bp, Homo sapiens
cggccgcggcgggtgtccggtgtccggtgtccggtgtccggtgtctggagccgctggctaggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcaggggcctgttgacatgaagtttcgaagtttcatgttggctttggaatggtagcaaaagcctttcctggctgagatgatgcttaaaacacacctcacttattgtacatgttggaaccaggacatgagagacatagaaaaacagaagtcatgaatgtaaattgaatgagaggcttaacatgcatgaaaatacagatggacctgcaggaaagtgagcaaacatcgctgagtttgttttcttgttcgggagaatggggccggggctggcctggcctcccctggatatactctatagtgcaccaaaaggataaagcatctgtacatgtatttttttattttttatcagaagtgcttagacaagaacagaataagcaggctgtttggatgctacttgtggttgaattgtgttcccccaaaatatatggtgaagtcttaacccccatccccgtgaatgggaccttgtttggaaatagggtctttgcagatatagtcaagatgaggtcacattggattagggtgggccccaaatccaatgactggcatccttaggagaagagagagttttggtaatagacacaaatgcagtgggaagaagaccaggggacaagaggcaagttggagtgatgcagccggaagggaagggacaccaaggatctccggccaccagcagaagccagcagagaggcatgggacaggttccccacaagccttagaaggaagcatggccctgacttcagaattccagactccagaactggaagaataaatgtctgttgttttaagctgctt

SEQ ID NO: 222617 - DNA, 1999 bp, Homo sapiens
  misc_feature (2)..(2): n is a, c, g, or t
  misc_feature (4)..(4): n is a, c, g, or t
antntttgctcagcccgcctgcgccgcttgggacgcctctgcctttccctccctcccttccccgacggcttctggcggccaagtggatgtggcgggtgatcgagccaccctgcccaggggcgcccagcactggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatgga

SEQ ID NO: 222618 - DNA, 3296 bp, Homo sapiens
  misc_feature (2)..(2): n is a, c, g, or t
  misc_feature (4)..(4): n is a, c, g, or t
antntttgctcagcccgcctgcgccgcttgggacgcctctgcctttccctccctcccttccccgacggcttctggcggccaagtggatgtggcgggtgatcgagccaccctgcccaggggcgcccagcactggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcaggggcctgttgacatgaagtttcgaagtttcatgttggctttggaatggtagcaaaagcctttcctggctgagatgatgcttaaaacacacctcacttattgtacatgttggaaccaggacatgagagacatagaaaaacagaagtcatgaatgtaaattgaatgagaggcttaacatgcatgaaaatacagatggacctgcaggaaagtgagcaaacatcgctgagtttgttttcttgttcgggagaatggggccggggctggcctggcctcccctggatatactctatagtgcaccaaaaggataaagcatctgtacatgtatttttttattttttatcagaagtgcttagacaagaacagaataagcaggctgtttggatgctacttgtggttgaattgtgttcccccaaaatatatggtgaagtcttaacccccatccccgtgaatgggaccttgtttggaaatagggtctttgcagatatagtcaagatgaggtcacattggattagggtgggccccaaatccaatgactggcatccttaggagaagagagagttttggtaatagacacaaatgcagtgggaagaagaccaggggacaagaggcaagttggagtgatgcagccggaagggaagggacaccaaggatctccggccaccagcagaagccagcagagaggcatgggacaggttccccacaagccttagaaggaagcatggccctgacttcagaattccagactccagaactggaagaataaatgtctgttgttttaagctgcttagttcatgctgagttcatgctgacttgttactatagccccagaaagctaatacagtcgtttatgtaattacataacctgacacacaagatcgacccattcactgctgcccagtccaccattttcataatgaagtagaaatgggaggtaagaaaaacattccagccagttctgtttagccctgggacacatatttgtcccgtcaggaatcttatgccctcctggaacccccgcccacctcagtccagtcccagtcaggcgaacggcctctggacagggactgaggtggctctgagccactggagatcatttttcttggaggatggagattggctagtacctctggcctaactgtgtaggtcaatactcttttacattgccttctaataaaagcagaatgatacagcagtgttgttacaagcttgtt

SEQ ID NO: 222619 - DNA, 3215 bp, Homo sapiens
  misc_feature (2)..(2): n is a, c, g, or t
  misc_feature (4)..(4): n is a, c, g, or t
antntttgctcagcccgcctgcgccgcttgggacgcctctgcctttccctccctcccttccccgacggcttctggcggccaagtggatgtggcgggtgatcgagccaccctgcccaggggcgcccagcactggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgaaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcaggggcctgttgacatgaagtttcgaagtttcatgttggctttggaatggtagcaaaagcctttcctggctgagatgatgcttaaaacacacctcacttattgtacatgttggaaccaggacatgagagacatagaaaaacagaagtcatgaatgtaaattgaatgagaggcttaacatgcatgaaaatacagatggacctgcaggaaagtgagcaaacatcgctgagtttgttttcttgttcgggagaatggggccggggctggcctggcctcccctggatatactctatagtgcaccaaaaggataaagcatctgtacatgtatttttttattttttatcagaagtgcttagacaagaacagaataagcaggctgtttggatgctacttgtggttgaattgtgttcccccaaaatatatggtgaagtcttaacccccatccccgtgaatgggaccttgtttggaaatagggtctttgcagatatagtcaagatgaggtcacattggattagggtgggccccaaatccaatgactggcatccttaggagaagagagagttttggtaatagacacaaatgcagtgggaagaagaccaggggacaagaggcaagttggagtgatgcagccggaagggaagggacaccaaggatctccggccaccagcagaagccagcagagaggcatgggacaggttccccacaagccttagaaggaagcatggccctgacttcagaattccagactccagaactggaagaataaatgtctgttgttttaagctgcttagttcatgctgagttcatgctgacttgttactatagccccagaaagctaatacagtcgtttatgtaattacataacctgacacacaagatcgacccattcactgctgcccagtccaccattttcataatgaagtagaaatgggaggtaagaaaaacattccagccagttctgtttagccctgggacacatatttgtcccgtcaggaatcttatgccctcctggaacccccgcccacctcagtccagtcccagtcaggcgaacggcctctggacagggactgaggtggctctgagccactggagatcatttttcttggaggatggagattggctagtacctctggcctaactgtgtaggtcaatactcttttacattgccttctaataaaagcagaatgatacagcagtgttgttacaagcttgtt

SEQ ID NO: 222620 - DNA, 1563 bp, Homo sapiens
  misc_feature (2)..(2): n is a, c, g, or t
  misc_feature (4)..(4): n is a, c, g, or t
antntttgctcagcccgcctgcgccgcttgggacgcctctgcctttccctccctcccttccccgacggcttctggcggccaagtggatgtggcgggtgatcgagccaccctgcccaggggcgcccagcactggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgaaagaaagaatctatgaagaaaaaacaagatgaagaaataaatcaaatagaagaagagagagttttggtaatagacacaaatgcagtgggaagaagaccaggggacaagaggcaagttggagtgatgcagccggaagggaagggacaccaaggatctccggccaccagcagaagccagcagagaggcatgggacaggttccccacaagccttagaaggaagcatggccctgacttcagaattccagactccagaactggaagaataaatgtctgttgttttaagctgcttagttcatgctgagttcatgctgacttgttactatagccccagaaagctaatacagtcgtttatgtaattacataacctgacacacaagatcgacccattcactgctgcccagtccaccattttcataatgaagtagaaatgggaggtaagaaaaacattccagccagttctgtttagccctgggacacatatttgtcccgtcaggaatcttatgccctcctggaacccccgcccacctcagtccagtcccagtcaggcgaacggcctctggacagggactgaggtggctctgagccactggagatcatttttcttggaggatggagattggctagtacctctggcctaactgtgtaggtcaatactcttttacattgccttctaataaaagcagaatgatacagcagtgttgttacaagcttgtt

SEQ ID NO: 222621 - DNA, 560 bp, Homo sapiens
ataacaagcaaatgatgacattttcctaaatgctccttattggttaaccactgaatatatgaacacatatgaatattgtcattcatgtacttaaattcatttagcaaactatttgaacacttacatgtgcagtgtttggtgaacatgacatgaggaactagtagtaagtaaaatcttccccccaaaattcattgtggcttaaataaatatgaacataatcattactacttaatatactgagagggaatcttaataaacttggaactgggagggaatatttgtatacattgggtaaagggttaggctagatgacatctaaggggtctgagtgaatcatatcataatttttataacacatttcacatactaaacatcagttggccccatacctgattaagttacaaaatttaggagacttaacattaaggacttacaggttgagacagcccgtatttcacaacattattttgacacttgactctattccagagttgttgctatacaaggcatgtggcagaacaaaaaaaaagctggtgttgatataagagctttttacccag

SEQ ID NO: 222622 - DNA, 474 bp, Homo sapiens
tgagtgcctactatgtgccagcctgtgctaggcactgaggacacaggtggaaaagcccgaattgctccctgctctcctggcgctcatcaccccggaggtaggcacagccgccagccggaacttgtacagcgtcgacacctctccagatttcggatccagtcacttttcaaaaagatcaaggagcctgacgccccagccagagaccgcgcccggtcagggagcagggtccacccggaaacgttgcacccaaagggcaaaggacggccctccctcctgggcacaaggacccatcttctcccagtgggtctttccctctcgccaaaataacaagagtatagggtggggggtccctacccagaccagtccaatgaattggtggaatcatcagttgaatttccccctagtcaggggccaatgtaccctccgtctagttcttacagaaaaaaaaaaaattaaacagggaagtttttcttt

SEQ ID NO: 222623 - DNA, 396 bp, Homo sapiens
gttttaatatgtgcattagcttgtatattagtatattattaattataaagttgtacaccttttaataattacatgaattactaaacttttaccatatttttaatagctttattgagatttaattgacatttaataaattgcacatatttaaggtatacaatttgataggctttgacatatataatacccatgaaaccagcacaatcaagatagtgaatgtaatcattacccccaaagtttcttcattataatgtattaataaaccagtactattggccaggcacagtggctcatatctgtaattccagcactttgggaggccaaggtgggaggattgcttgagcccaggagttcaagaccaaactgggaaacatagtgggaccccatctttgcaag

SEQ ID NO: 222624 - DNA, 514 bp, Homo sapiens
gtgggtgtgggcgtgggagaacagggccaggacttagggtgagcagaggctggttgccctacttcctttggtcccagcctgaggctggcacccctacccagcagccttgtgacaccctcatgtcccacctccacatctttgctgagaatccccagggaagggagggccccatctatagtggaagaaaccttctgggcccaaatccagccacatcacaagactggatggcccagccgcgagacgagcatgtcagtggcttccatggccaatgggagaggcttcacccggctcatgttctgctgtggttgtcgggccaaacagatggctggggataaacagggggtggtgctgggtggggtgtgtgttggggtggctttgaatggcctcagcctccctctggatcctagggaaagaggccagtgaggtgaaggcagtgcttgaggaaggggctgtcattggtggccttcaaaacttgtttgtgatgtcttttcagcaataaaactcttgttcaaac

SEQ ID NO: 222625 - DNA, 340 bp, Homo sapiens
tctaaaaaaaaaaaaaaaaaaagtaaatatctgtatttttcaattaatgaaacaggtataaaccaggcttacatgtaaccatattgaagtcaacaggctgatgtgtaaaaacacaggagaagtgtatcatggccgcctcattgttagaatgctatgcagaagaagagtgaacttaaattcttcctatcctgaaagggctctgtattccataaatgatgctgggatagcatgctagccatatgcagaagaatggaattggaacccaacctatcactatctacaaaaattaactcaagatggattaaagatttaaatgtaaaacctcaaactgtaagaatcc

SEQ ID NO: 222626 - DNA, 668 bp, Homo sapiens
ctttctttataaaaatatgtggtttttttgttgaaagttttggtctctttaaattcagattttgtcttaggacagtaaaacccaggttgactgactcaggaaacagttgtctgctagtcactcataaatgtacggtcatatgttcactcttcttaaatatccaccttttataacacaaatgtaaaatagtatcagtctagccaatgatgaactctggaatccacttagtcttcagtaagtatgtgctgttcctctaaactttgccctgaagccagggatcttctcctaatgtatgtgacataaaaatccattttccatgtactcttgccaactgtctgataaggaattttgtgtgtgttctttctgactggagagtggaggacatctaagcttgtgtggcattggtccaatgattgccatgcatgacctgtaacatcaacagctcacagaatcctaaggaatcatgtgagaaacaggccttgggtcttatgagtcttctgggacctaaggtgataaaatggatggcacagaatggcatgtgatcaagcatggaggtgataaggaaacaattgctactctgtgtccatcagtccctgcgatgtctgtaaatgcacagtgtaatgtgaagcactttcagaatatgtttgtgtgtgtctgtatgctgagtg

SEQ ID NO: 222627 - DNA, 570 bp, Homo sapiens
ctatcaaccaatcaaccaataaaacaagacaaaagacatctttgagacaactgggaaaatctgaactgtatacttaaatattatggaattattactttaagtgtgataacggtactatgattatatagaataatgtacttattcttaggggatgaatgctgaagtatttaaggggacattatattaaggaaaaatctgatgtctgcaacttaaacaattaatcctccccaaaaaagtacagaacacacacacacacacacacttacttctttccagctctgatattctagaacatttagagatggcacaaggaacaatagaacaagtgattacatttctggaaataggtcccatgaggcaagtaacgtaaactgtctaggatagagtgaagatgcttttcaattacaatatccaagttttaaaggtattctgtaattctgctaaagaaaatcaagcaagaagggacatattccttgctttgcagtctgttttatatttgtctatttaatcataaattttgatctactaccctttagccagaatacaagattgctgatcccatctgtacat

SEQ ID NO: 222628 - DNA, 231 bp, Homo sapiens
cattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaa

SEQ ID NO: 222629 - DNA, 330 bp, Homo sapiens
ctagctgcttggggaggctgaggtaggaggatcgcttgaacccaggagttcaagaacagtctggataacgtgatgagatctcatctctattaaaaacaaacaaagtactcttactagtgttgatttgaaccctgggctttgatccagagcagtgtttgttttaatcttagttgatttgattagtaattttcagaccttgaacaagacttggcatctctgagctttagcatccccctctgtaaaatggggatagtacctgtttcatggcattgttgggagaagttacctgctatgttctttgcatagtgactttcatagatcaagtagtcc

SEQ ID NO: 222630 - DNA, 311 bp, Homo sapiens
ctctggggtctcaggtatggttctatctcctaaggaatgctcaacaacgcaccagattttattccaatctccatgggacccgattctggtacacagtctcttttggtaatggagtcagaagaacagtttctgggaaacacctcactgtcttgaaacacctcccctttcaggctggctgacaattctaacagctgggcaccggagcctgcttcatgaatgctcatcagctagtctcagggcaccaggcctgaaataaactgtgaaatccctaaggatccaaaaggattcacaggatttctcattcctgccta

SEQ ID NO: 222631 - DNA, 381 bp, Homo sapiens
ttggtgatctgaaatttgtacaggtggcagcagtttttatgggttgtggctctattatttttaatgagctgggatttcaaagttctatctatctctaaagatatttctagaaggatattcaaattgtatttgaatgaagtatatcccataatacagggatatacttaccaggacagagtagtaacctttccaacaggtccatgagcaatcagattcacaattctaattttgtagttgagttctaacaatgtagttaattattgatttttaaaaaaacatttgaccaagcaagaagcaaaatcattattttgccaaaaacagcacgttcctaatttgcctatggaagagtatgtaatgcttttaaatggggatgaaatctac

SEQ ID NO: 222632 - DNA, 350 bp, Homo sapiens
ctgaggctgaggttattgggatccccagtgtggaccatgtgtcagattcagggaggggtttcagtgtagaaaaagatgagatgccacttggaagttgtgtggtttagagcaaatcactcagctgtcctggcctcagtttgcttatctgtaaaatgggtatccattgggaaaaaaattgtcattgagggccaactaaggaccacacacttttctggcacagaaaagtcaaggttctgatcccacggaccttacactccagtgggaggtgatggaccaggaagagtaaatccatgcagttcatttcaggggctgatcatttccataacggcaggaaaactgggcgagaagac

SEQ ID NO: 222633 - DNA, 533 bp, Homo sapiens
caggcagggcccaaacttatttctcttagtaactcactgcagttcctggtgcagatttctgttgcagtgggcacttagtaagtgcttttgagcaagttaatgaatctgagtcattgtggagtaaaataacccattgtatgcagcactaaagagttctccagtgtaatttccggaaggaacaggcacagaacaggattaaaggcattggttctgggtcaggccatctgaacttgagtcctttaccttttacccttttagcctctatacccttatctgtcaaatggagatagtaacatctaccccacagagatgttttgagaatatattgtaagcacctggcccgtggttagttttcagtagacattacgtgttataattattggtgttgttcattgtttttggtgctaggaggttaccacaccctatttgaatggttttgttatgcttataattgtgcctctatcatatataagaacttaggtctcttcgtgcttgcattgcaaaaataaagaaatatcttttaaaaaactact

SEQ ID NO: 222634 - DNA, 569 bp, Homo sapiens
ctggtggtaagagggaccaagaagaactatgggctcacagacaaagtctctgcttttccttagaggaagggtgccctgagatgcagaagggcttcccagaggaggtgggggaggactgcactcagcagatactctacagtctccccaggatcactgacctcaggcctgacttctctgtctcatctcaggaccatgcattctgccggccacagcctatgggggtggggggatggggagttgggcctagcattgttcacggaactttcggtggtccccaaatgcagggatctgttgccagcctcctggacccccgctctcaggctgctgctgaactgaaagagactgtccagtaggtggcgcgcgggcaccgccgagtacccggtccccatgcagagccagcccctgccagtgcacattctcagaacagagcccgggcgactgcaacctaggcctggtctgagtccatttcgtttagtttcagagaaagaattaacagaggcttagtaagtgtatctgctcagaggagagcgttctctgagaaaaaataaacaagactgtgtgaccccaaa

SEQ ID NO: 222635 - DNA, 831 bp, Homo sapiens
ttttttgagacagagtctctctctgtgcccaggctggagtgcagtggtgtgatcttggctcactacaacctccacctcctgagttcaagcgattctctgcctcaacctcccaagtagctgggactataggtgtccaccagcacacctggccaatttttttgtatttttcgtagagatggggttttggcatgttggccaggctggtcttgaactcctggcctcaagtgatctacctgcctcagcctcccaaaatgtcttaatcaaagataaaattccatatcttatgagtgccttgaacccattcacatataatgtggttgatgatagacttactatcttaatgcatgtgttttatttattgtgcttatggttgaaaaccatcttcttcatctctggatcatcagagtcaaccagagggcttggctcaaagcagtaggtattcaacaaatgctcattgaataaaaatgtccttgatcctctaattctgatttgattcgagaaataacttatggcaaagagctcaattgtaatggggttgggactaaaattcaagttaatgttgaaagatgtttcaagaagtatttaggttatattattaaatattagacactttctgtttatatagatttaacatataaagattttaagttttctgtgtatgtgaggtctcgtagtagtttctgctgaaaatgacaggggcgcggggttaagggtgaagacagtatctcaggattggagaaggaaatctaagatattgtctccaccagccatactcctcatgaacatgcacatggaaggacatttcccagccaaagtgaatccctttatttg

SEQ ID NO: 222636 - DNA, 479 bp, Homo sapiens
caatgttgagtgaaagaaactaggtacaaaaagatacaaacaaaacacacccaggtgattgcattaatctaaacgcaaaagcgggtgagaccgatctgtgctcttggaggttgtcctctgggggtatggtgcagctcggctgatgtgggtcacttaggttttcagtgctcagggtgaaagtgaggggtcaggagagagcagaaagctggatcaccccgcacatgctaagaaaccaggatggcaacgtggatgtggcgggttaagcaaattgaaactgtggataatcattagctcaacagatgccataagatcagagtgcccctgaggcctctggtctctggatgatgcccatgtatttatcacttagtcaccggagcacagatcttagaaggaggcccaggagccctggctgcacacgtaattccattgcacgctgattcagtttggtcaagtccacactacccaaatgaccagagtta

SEQ ID NO: 222637 - DNA, 440 bp, Homo sapiens
aatggtcaagggtagttttagttatgaaaatgttaaataactctgatgttaattaaaaattttcctgccactgtcagaaacctactttttgaagtacaggttttatttcttttagctgagtggctgaaaaatatttctctactttgccttgctggtgagtgtactggttatgttttgtactaactgtgcattcctccttctaggaatagctgcagtccacatccgcaatcatatttctactcctctcctgcctcccagtcatagctgaccaaatctggagtatgatcagacacaaggcagtatcttcattggccaagcagattatctcaggattttaaaacgagacatgcagaggatactctgttggtattttcatctttgaaaataagcccttttgcacctccaagtccccaaattcaaaatgaggcttatgattcctg

SEQ ID NO: 222638 - DNA, 353 bp, Homo sapiens
ctttatgcaccacattcagtgacagctgtcagctgtgagcgtaattataagttttcattacaggttttaattcaaaccaatctttatttatttgaaggctaatattaaaatgggcatgtgaaagttgcacgtattacgagcaaaactctgcctaaaaccatacgtatgaacctaaacactcaggcataaacataaaaagccatacacatctggtgcatgcacacacacagaagctttaaattgtctttatccttctcttaatttttttttggctgagcatgtatcattgaattgctataaagtaagtgtttatggagctgtaccacaattcataatctgattactagttgtga

SEQ ID NO: 222639 - DNA, 412 bp, Homo sapiens
aaatagtttggatgataaaatgatgacgaagataaatattctagcacccaagttaagggtgtaaagacagtatcgcactggcctcttctaccttattaggcgacactggagacatctacgtctacagtcacttgagaaattttttacctacgggttgaatttgaatttctgggtgttcgctttggtttatgatattcaacttttattcaggggatttccaaatagatcaggggcggggctgctgacctaaggagaggagaaagttttgagagaagttttagtagatcacagctgtgcatcagtggagtcccactgatactaggggagaaatagacagtgctgggaatggggcaatcctgccaggtgtttttgatgttatgcctacagaaaataaatttgcgttagccatatg

SEQ ID NO: 222640 - DNA, 317 bp, Homo sapiens
acaggtgagtgactttaggcaggtaacttaatctttctaagtttccttctctgtaaaacaaggccatatagttaatacctaatgggttcttatgaagattaaaggcattaatacttgtaaagcaccgggcagcattgtgttttgcatgaagccaatgctcaaaatgttaaattattgtagcactcactatggatataattataataaccagttttgaggcatcctttagaattgtttatgtaatggaattttatttttcttggtattagaatgtaatttactccaaaggaaaaacaaaatacctttggcacaggagg

SEQ ID NO: 222641 - DNA, 519 bp, Homo sapiens
taaagtaaatatattattccatattttcttctaaaagtttaaacattttacactacaatttttgaactatcgctaattgattattttatatggcttgatgtagggatatatttttttcagatggtagcctattatcccagccctattcattgcttaatcccagtgacctgctatgattcattcatacatcaaatgttcatgtatacatagcttgtttcattaacctattgtctattcctgcatgaataccacactttatctattactagagctatataataagttttgctatctggtagggtgtttctcctccctcctttcttttttcaggagtatcttggctattcttgggtcttctgcttgttaagttctttgaaaatattgtggaatttttattggaattgtttgaatctatagaaagaactaacatttaagtcttcatattcaggaacatgtgtacctctttttaactttagatcttctacaatgtattttaataaagttttataattcacacta

SEQ ID NO: 222642 - DNA, 500 bp, Homo sapiens
ggcagaatcacactccaaggtaaagccacagtcttaggtgacagtagacaaggaacttcctcccagaacccagaaccaaatactaaccccaagaaaagtactccacatatggggcaaggccctttgcaatgactggtggcaaaactccatcactaatgaccagcggctgatgcgtattttgtttcttctgttttctgagaaggaatttctactgtgtgtatccagtcccatccaccgatgtttattgaagatatgggtacagggacgagtggaggcaggggaagaatcggggaggggatgggctggtgacttgttcactgggagacacatccagatttggtgcaggtggctgcatattgcccagatattttggactttaagttgggtgcaatagctggataggaccctgggctatcttttttaggggagaggttgaatgtgttctgtgtgagggatagaaagggtatgcacagtacagttatttgagtggattctgtgtg

SEQ ID NO: 222643 - DNA, 295 bp, Homo sapiens
ttctataatcaactgttatttgatagaattgtttgaaaatattactacatgcttgatggcaggacctaaaacagcaggcaaaatatatatgatgccaaaggcatcttctcttatcactagctgatttacaaatgataatttaactgttaatgtctgagaatattttctctttcccatacacaataagaaaaatcactgtgtatactgagtggtgtctaggaatgtgatacgtattattcaaagtatgagttgccttgaaatcaaggtatagggaggaatgatgaggacacatggg

SEQ ID NO: 222644 - DNA, 367 bp, Homo sapiens
gacacagggctaaaggatttttccagacagtagattggtgccttctattgggactagaagtctttgcctccaactctagacattcacagttgtttggaaataagcaaaattctaaatctcagaattttcttctgttccagttaagacttatcaagggctggagcgtctgaactagatacaccaaaaatttttagagtgatgagatgatggagttaaacaaactgtcctgaactgcatatccaaagacaaaagctaggagataacaaaaactgtcctaaaactgcatatccaaagacaaactgtcctgaactgcatatccaaagacaaactgtcctgaactgcatatccaaagacaaaagctagcgta

SEQ ID NO: 222645 - DNA, 390 bp, Homo sapiens
tggccatgaacccaaggcctgaggactggtgcctttctgctaattaattctcgatgtcagacatctggaaacccgccttttctgcctcatctgagttgactaattaattaagctatgtttgtaaacaggcgttttctcctcagcacttctttcatcatctgtttctttagccacaagctggcaaccccatttaatggtagactacctggccaataattctgttcttgcacaggctgtggaggttcctttaggaggccacttagcactgtgcaagcagcccaggctttggagtgaggcaaatcaggatttgaatccagttgagccatttattaattatgtgaccacaggcaagttacctggcatcttaacatgtcagtttccccattttct

SEQ ID NO: 222646 - DNA, 639 bp, Homo sapiens
ttctacaaatgcattagcattggcatttataaagaaaatgacgaagttgagaggttatagttggttactgcagtgacttagagatgctcattttatagttattaaagcacaacgtgaaccaagttggcagagagataacaaggtaaaaatagcataaggatatgtcctaacaaaatgtccttggtgaagacacaggtagagaaaagaagccataataaagaaattagttccctgaccaaaacaacgggaatatcattcatcgttaaattttgttaatgaattcatgtagcagcggcccattggccttcgagtcacaacataactatgtcttaggtaatgtgattaaataaacttaagtatttatacttaagttcatatcttagtcacacgttatttatatcttagtcacacgttattgagtggaccacataatttcccccgctaaacattatcctttacaggttaaactgctgcagttagaaaactttgtctcaaattcttttgagtttggggtattgttaagaaaaaatgcataattaatcaaatgagagaaaggttttttggggggaggtataatttgtataagtaaactttgattaaccaatgtagctgtttaagtttcttcttccttacaattaa

SEQ ID NO: 222647 - DNA, 353 bp, Homo sapiens
gttgattaataagaatgtatgcctcttgctgtacattacttagccggggaaattgtgagaacagtactttatagtactgacagtgcactaaaataaaaatgcaataactagaaggtggagttattagagtgaaatgaactattgcactttgaacaaatgtttcaaattatatttcagttatttggttctttaaaaattcaactgcatttattaaaaagttaattctatatatttaaacaaatatgtattgaaagatattgggtttacaatagcaatgggttatttttaaaaattgggtaataagctactatataatcaaaaataaattgtgaatgttttcctttctttatata

SEQ ID NO: 222648 - DNA, 716 bp, Homo sapiens
agtgactgtaaacacatatttatagtcagcattgaaaccctttctagaaggaggagccaagatggccgaataggaacagctccggtctacagctcccagcgtgagcgacgcagaagacgggtgatttctgcatttccatctgaggtaccgggttcatctcactagggagtgccagacagtgggctcaggtcagtgggtgcgcgcaccgtgcgcgagccgaagcagggcgaggcattgcctcacctgggaagcgcaaggggtcagggagttccctttccgagtcaaagaaaggggtgacgggcgcacctggaaaatcgggtcactcccacccgaatactgcgcttttcagaccggcttaaaaaacggcgcaccacgagactatatcccacacctggctcggagggtcctacgcccacggagtctcgctgattgccagcacagcagtctgagatcaaaccgcaaggcggcagcgaggctgggggaggggcgcccaccattgcccaggcttgctgaggtaaacaaagcagcctggaagctcgaactgggtggagcccaccacagctctaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgaga

SEQ ID NO: 222649 - DNA, 983 bp, Homo sapiens
tcgagatgggcttccccagggacgcgcggacaaggctctggccctcagagggaaccaggcatcgaggctgcgatggactggttgatggagcacgaaggacgaccccgatgtggacgagcctgttagagacctccccttggacatgatcctgggagcgggagcccacttcctcagagcaaggcggccttgcaaggatctggttctgcgtgccgagagataggcagatagccctgctttcgtagctgacaggaggaaagacacggaacaaactaagacggatgttggagctggtggcccagaagcagcgggagcgtgaagaaagagaggaacgggaggcatggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgtacatgcctgactcc

SEQ ID NO: 222650 - DNA, 932 bp, Homo sapiens
gtaagcccaacttctcatttagcaaaaaaggcataaaatccatcttaagttgaaatttagtattattctacagcatataaagtgaattaacatggggatataccaaatagaaatctaaattttgaaatatttgaaattgaagcatttgagtaacttatctgtgaaaggtccaaggagatgctctcctaccaaccctactaaatttgtttcctttctaggcctcactgaaccataagtgttttcatcaaaaaggagcagagtggcaggtccaaactatatacctgataactttaggattaaagggaaagatagtgtaccattgcctccctgcttttattgtcatttaaagtttcgtcttcatggtgagtgattctgtagccaagtttgtgaccacccaatgaactatatagctgctgtatgtcctgcagagctcatccagaatagaatgttcttgatcaaaatgagagtgctagaaagctcatgaggctacaaggctacaaagaaaagtatattccaatttgggatgttattaagataattaggcagcccactctactcccaagagaagaatgaccaatttaatctgttgtcaccaagcggtttacagcttaaggccttttctgtaaaaattaaaatgcactcaaagaataaaaaacagcaaggtcaaatcaaggttttatctagtgttaggaacatttagattactctctgtgtgtgtgtgtatatatatacacttttatttttacattgtagagatagcatgtaaatgaacataggtattaagccatagagaagaattactatgcacctgatgaaaagaatcaggatttgtgtaacacagtaaacacattcttgtggaccagatggcaattacgtatacatacaaggcaagtactgagaagtaccaaaaacatctttgatgccgtcacttt

SEQ ID NO: 222651 - DNA, 733 bp, Homo sapiens
gaagaaaaataaatagaaagtagaaatattaagaaactacgaagtaggtgtaccacctccatttttccaattgcaaaaagaagatagtttttataaaggtgcttcataataccacttaaaagatttgcaaatagaatagtatttaatgagattatcttccaataaagaaaatggaaaggtttctcactgaaggtgaaaacacatatattattttaaaagttctgaagtcttcaaactaaaataatgtactataacaaaaaaacttggtttttcatatttcaagtctttttgtctggatctttgttcattcatggcttttattaggtttgcaaacagttggtggacatgtggtgaagtcacacctcattaacagaatataaattttccatgtggttttgttgcctctttgcagttattttgctctaagacaaacttctgtttcataaaagttgggcctttctgtcttgggaaatctctgcagatacttcatatttgttttaaattacacatcgtctcttaagttttccagtcatgctttatacttcattgtgtgccttaaaaatgttgtattattaggatcctcaccttgaaagattgtttcaaaaaattgttattacattgaaataagtcttttaaagtacaacagtgtcctgttatctagattagatggataactgaggattagaatatgtatggaagatcagtcaccagttaaattggttggttagttata

SEQ ID NO: 222652 - DNA, 524 bp, Homo sapiens
ggaatttccttgtcctgataagcctgggagcgccacgcgagcccagggcttatttcatcccttatcaacgactgtaaaagacagccgtccccaaagcggccaagttgagaaagactatgggaagatttgggtagaagcatgggggccaagctgtggcaacatcccgctgggagatgatagtgatcctgaccgggttcacggtggtggtgagagatggtcagagcctggatacatgttgaagtcagtcagtaggatttcctgacagactggatgtgagctgtgagagaaggcagtggtcaaggttgagtttgattctgattgaattattaagtaattttaaaaaacactactgcctttcccaatcctaccaagtaaaggatgctagataaaagaaatctcaagttaggccaggtgcagtggctcacacctatagttccaacagtttgagaggcagagatgggagtatgttttaaggccatgagtttgagagcagcctgggcaacacagcaagacctcctctctac

SEQ ID NO: 222653 - DNA, 360 bp, Homo sapiens
tctcttctcccatgagtccttctctgctgtggtttgaatgtgtcccctcaaaaattcaggtatttaaactgatagtgataacattaagaggtgggacctttaagaggtgattggtcaaaagggtgctccctcatgaatgggattaaggcccttatgaaagaggctttgtgcagcatttggctctcttgactttcaccatgtgaggacacagggttcctcctctccagagaactcagcaacaaggcgccatcgtggatgcttagagcagcctttgcaagacaccaaacaagccagtggcttgatcttggacttcccagcctccagaagtatgtgaaataaatttatgtccttttaaaatta

SEQ ID NO: 222654 - DNA, 314 bp, Homo sapiens
cacttcacaggacacgtttacatggtactgaaactttagagggactcctgcactatcagacatcacccattactgttcttttttttgtttttttgagatggagtttcacgcttgttgcccaggctggagtacaatggcacgatcttggctcactgcaacctctgcctcctgggttcaagcgattctcctgcctcagccttccaaatagctgggattacaggcatgcgccaccacacccggctaattttgtatttttaatagagatggggtttctccatgcctcaggtgatcccagcctcaggtgatcgacttgc

SEQ ID NO: 222655 - DNA, 419 bp, Homo sapiens
gtgaaataagctgatgccatccgtcagtcacagttgctgtgaggtgacatgagacgccaagtgctcaagacattccacctcagttcagctccttgctgctccaggctttcgtgcatctacatcatttctctttatcctggctccctctgtctctgttttccagcctctgtttgcgtctgtccctgtctgggcaggagggaacagcagaggcagcaaaggctctctcagcacatactgtggggaggagcggccctgggcagaggacagggtgggcctcacctcctccatctgagctggacatttccatctgtgccacaccatgagctcctgtgagccccacatttcctgggcatcctccaccttgcagtcagtcctgataggttctcttcttgacagtgtaaagcacccttccccaaggc

SEQ ID NO: 222656 - DNA, 527 bp, Homo sapiens
gatattaacaatatgaagcaagaaaaagaacacataatcaagaaccagatatttatttaggtcttaagatctgcataactggagagatacaccttgttcatgggtcagaagactcaatatcttaagatcggttttcttcaaattgtctatggattaaatactatctaaatcaaaatcccagcaggcaattttatagaaatggataagctaattctaaatttcatatggaaatgcaaaggacttagcccaaacaactttcaacaagaaaaataaagttgaaatgctaacactacgttatttgaagactttattataaagctatgttaattaagacagtctggtacagtcatgcaccacataaggacatttcagtcagtgacggatcacatatatgacagtggtcccagaagattacaataccatatttttactgtacctttcccatgtttagttatgtttagatacacaaatacttaccaccatattacagttgcctacaggattcagtacaggtttgtaccctagaa

SEQ ID NO: 222657 - DNA, 670 bp, Homo sapiens
gcaatagcattgggatttgtgctcagagtcacagtttacatctgaccacaatttctatatgaattttttaagataaaacagtaagaattttaaagaaggtttctgaaatttaaaaattataataacataattaactttgatattttaattccatgtaatttaaaacatttaacagatatataatgttccactattaatttaactagatgtataaaaataaaacatatataataaaaatattctacttatttttaaattatctatattatactgagtaaaagaaaatttaggaatataaataaatgagcatttttgaacatgtaaaaatattttcttgctgtttttaggagacttttagcaggacaggagcttacctctcatctacctctgcttggacaaaccagtgatgtgatttgcaaataggctgtaacttcaccgaaaacacatcacagtaaagaaaggtagtgactttcagagaatttgacctaacttagaatttgtaaaagagaaaagcattgtccttatgcctaaagtacatgactgtttctttttaagttacatgtatatttacctgaccaatttgttttactctgtattttaagttatcaggtgaaatggttttggaataaattaatgagttgtttcttctgaataaatgtgcatgttacaa

SEQ ID NO: 222658 - DNA, 502 bp, Homo sapiens
aagcaaaggaaagaaaaacccaaatcggtgttacaggtttttgaaggtctccctggattaatgcaggtcattttttatcctagggaaagcacagaggatgccttctatctcaatgtttcccttattttattgattaatctttcactttttcattcacttaacacttaatcattggttagtatgtgccaggcactgaaaagatccactaagaatataaaataaacaaaacaacatttctgctttctagttactcccaaggccactctccagccagttctcctgggaatcagccaaaccacagccctgttaggcaccattgaccttctatttccaatgattgggaaatagtcaagcatgggctgggagcttagttgtataaagcagcaagttgctatgaagagttcaaaggtatgagagtgcaagaatttggtttgggtgaccttgtccatgtaagattgtcaagaccattgtgactgtcagctctggttagaaaccctgctgt

SEQ ID NO: 222659 - DNA, 499 bp, Homo sapiens
atgtattcttctagtataagtatgtcccatgcaatatttgggacatacgtatactaagaaattagttatttatctgaaactcaaatttagtgtcctatattttaatttgctaaatccggccatccaactgcatcacagatggagtatgaagcttacagctccacctaggaagtgctgcgcaaaacaagctggacccaaataatcaagcatttagagctaactccagtttacagaaaatatggagaagaggagacagaacaagtgaaagaacttcatgatgaggcaaacaaatgaatccaggacacgggacctcctccaagatagggagaggggctgaggaacgctccagattagaaaaaactagggacatggccacccaatgctatgtcctgatcccaacaagtcaactgtagaaggacatttttgagacaatcaggtagcttcaaatttggactgcgtacacaacttgttaagtttaaaaatggcactgtggctctgg

SEQ ID NO: 222660 - DNA, 115 bp, Homo sapiens
agggaaactgttgggtgcctgcccttatgtacaagcagagctctgaatttgaggcgggaaagaagacagctcacattccatgttcacacgaacatggctgggagtcagtttctct

SEQ ID NO: 222661 - DNA, 406 bp, Homo sapiens
gcacgagaaaaaaagtcccactgacgaattggaatatatcctgaggaactgaacgggtgataggccgagacacagtctgatgagggtgaatgtctgaaagactcaggggatttggcttggtgaaggaaacccagacagagacatgtggcaattttcaagaactgacaacgctgtcagccggaatacaggtttattctatgttgctccagaggccaaaagtaagaataacgtgtagaattacaaggaggcagatgagatttcatatcaaaaagaaaattaatcgttcacggtacctggaaatgaggtggtccacgctgtgctcgcatcggctctcccccagagttttcaagggcaagccagtggcctcgtgtccagttaggacgggtgcagatggggcatggaacgg

SEQ ID NO: 222662 - DNA, 281 bp, Homo sapiens
ttccctcatgtaattaaataaaatatttaacacgtattcatttcataattatgataatcatgacatacttttttgggaaaattatcttttaacagaataagcaagtaaataatacatcgatggtgtactgtgtgatgcagaaaataaagcagagtattgaggaatgcaggacatgttagtttagaagtgttccaggaaaccagggaggtggaggttgcaatgagccgagatagcaccactgcactccagcctgggcgacagagcgagactccatctgaaaa

SEQ ID NO: 222663 - DNA, 309 bp, Homo sapiens
ttattttcatgtatgtaatgtgctagcttttaagaagcatcatatagacttccagactaggtttaaaatgctaaattgcctgcctatgtgtatcatttttcacagggtgaacaaaggagataatgattcctttgacttctgacccaatgactaccactgtaggcaagaacaacgttaaacatttttgaaattttataaatgttttagtggcattacctgcagaattttattgttgtggttttttttggactactgtcttgaactgtagccatggaaaagtttccttactaaaagaaataatcaggaata

SEQ ID NO: 222664 - DNA, 408 bp, Homo sapiens
gagtcagcctgccattagcctctccctatgaaatttctagcgtggtcattaccgctcacttagcaacgctctggcggggcagaaagttgtcttttgctcccacaaaagcaaacacttttcctggtcaggcgatgcattatagagtcagttctcctgcgcttgggccgatcaataaccaagtcggggcccccggacgcagcccagagcccagccccgcgctcgcgggttcccgggtgcccggcccggcccatccatcacgcggcccccgctgcgcgcaacccgggcgggacgagcccccgcgatccgtcttcgccgtgaactctgcgtcccctcctgacctcgcgctcaacccggacacactgggaggtgcgaagcggcctcccggggctcggcccgctccccgccgca

SEQ ID NO: 222665 - DNA, 434 bp, Homo sapiens
tatcttgctctggaggagggagtgagaactggatcactggttacggtggtgactgggacaacagcacagccacagacaggaacacagaaggcagaggcagccttgatctgcaagggctccagttaaccccaatggggaccctcgatggacaaaggcactctcctaggcttggtgatgaaagtattcctcttacagccaggcaaggcactcagggctctgcagcagagaagttagagctgtagcttttttgcttggtgttttcactaaaacttaatttcttgttgcacttgttggatgggcatgtcccataggggaagtttccactactgtgttctaaactttggactgcttgtaccatcttacttgttccctcattaataatgaactaaataaaacctttagtatatgctaatttcatatctttacgagagtca

SEQ ID NO: 222666 - DNA, 491 bp, Homo sapiens
  misc_feature (3)..(3): n is a, c, g, or t
  misc_feature (16)..(16): n is a, c, g, or t
  misc_feature (24)..(24): n is a, c, g, or t
ccnctcacggtactcnagctaganaagaacagtgttggaatcttactatttttttttatcattaggaaaatacagtgtgattttatttttatgcaaaatctggcaacttagtcacatcatgtaaaggagggagacaagctactggttgcttctgtgttcttctagaagtccatgtcatggcaggccacagagggtggtgagggcagccacagggactgctgggtgctgccactgtggggttgtgtctgtcctacccagctgcaactctgaccatgcagtcaggaaatgataatttgacacaaagaagcatcactatttctctcacattctagacttttggtttctccacatagacttgagaagacactctaagacagcatataaggagaggagcacccttttgattttccttttaacctacggaatcaccactcagttccacattctgtggggtcttccccaccttcctccgtattgaggtaattcgacct

SEQ ID NO: 222667 - DNA, 537 bp, Homo sapiens
ggacagaacacagcaaacttctaggagaaagggcagcataaagaagggttccacgaaggcaggcacatggaaggtggcagataaataatgaacagcctatcttagctgaaaccaagaaaatgcaaacgggaatggacaatgggtggaggtatggaaagatggtgtagtatttccggaaagctaaggtgaagagataatagagacaggaggaatgggtgaataggaccaagtagatggttggtggaggcttttataagaattcattccttcagatgaagagtattgagtacggactatgtactggacattcagtaataaaacagacatgacctctgctctcgaggtgcctactgtcaagtgactgcaaagacttaagaggaagtgaatggtaaggaaagtgaggcagcaggtcttacttacttcaaaataaaatggataaaagaaaggaagagtttttgcaaagaaagcaaaaggttagccttctttaaggatgcaaaaacatgtgtttttctttgtgtgtgtgtgtatattccttaa

SEQ ID NO: 222668 - DNA, 479 bp, Homo sapiens
ttattcttccaaaggcagtctatccaatttttggaccactctgatggtgtcagaggccttctgtagattgagctcaaataactcacttctagttgtcttaggtcaacaatgtgtggccacagagattaagtcaaactcctcttcatctctgtgctgttcctgaatttgccagccttccaggtttctgagttgttgataaacaccgcacaggagacatgaggacagaacccttcagtggagacctgtttggatattgcaggggctttctgtgccccgcctatgcgtgatttcagcgctgtggagcctttaaaacagacgtggcctggacgactgagaaggtttgctttgactctgctgcagagggaaggtccagagtctcgtaggtcccactgtgtgctgagaattccatctgatgccctggataaccctcaagcctttgcaacagccagactaaataaagactcttgagtgattctgaa

SEQ ID NO: 222669 - DNA, 593 bp, Homo sapiens
ttattcttccaaaggcagtctatccaatttttggaccactctgatggtgtcagaggccttctgtagattgagctcaaataactcacttctagttgtcttaggtcaacaatgtgtggccacagagattaagtcaaactcctcttcatctctgtgctgttcctgaatttgccagccttccaggtttctgagttgttgataaacaccgcacaggagacatgaggacagaacccttcagtggagacctgtttggatattgcaggggctttctgtgccccgcctatgcgtgatttcagcgctgtggctggagtgcaatgacacgatctcggctcaatgcaacctctgcctcctgggttcaagcaattcttctgcctcagcctccagagtagctggcattacagcaattaccagctgatgctgagtaacttctgcccccttaaagccaggcacatactaactggttcacctcaatctgcaccactctgctgcccagtgcccagtgtgtggctattcaaggatattgcagtgtttctttggacccgtgtgagaattatgtactatgtggcacaataaatgggaatacattggttttcaag

SEQ ID NO: 222670 - DNA, 432 bp, Homo sapiens
gttttgttgcagcccaggaataagttttataacattggcagttgggctacaagtttagaacttatacatttagaaaattccaaagtgttccaatttccaaaagtaaagttggaatactttctacactggcttcaggtttaccaaatgtacacataagggataaatttgtcctgccaattttgctagtgcctatatatcagcagattcgccagacaataaaaaaggggacaattgattcaaaaaccattacctctcacttctggttccactttgcttcaaaatggcagaacatagaattacacagcgttaggtttggagttgcagttatcttcagcacacttaaatttcttcttttagattttagaaccaaacttccaaatgtgcccatccatggaatacatggaatagctctgggctatcccttcaggggaa

SEQ ID NO: 222671 - DNA, 438 bp, Homo sapiens
  misc_feature (304)..(304): n is a, c, g, or t
attgtccatccactcttcttcctgtacttaccaggacagaacagccgcaacttctcagacagttcattcttcttttcctcacctactaccatctaagaaaggtacttgatgactgtggctttagacaagagtccttttcttaccacagggtgggcagcaccagctcattagaaccatttgtgtgactgactgaagacagctcaccttggaacactgcaggaccctaagaggatggaggtggagtttttctgctcctacacctggataggcaagaccaaccacttaccaggtgcacagtggcagncttggcagaaaagcccattaaggcccaggaaacatacaattgttaaggggaccaagaatgtcaatgaactaaaagtttctggaccggtttattaggcaaaaattaaaaataaaaataaaataagagaccctaaa

SEQ ID NO: 222672 - DNA, 472 bp, Homo sapiens
aatagaataacttttacaaatagagatgcatctgtggtgaggatttcttctactagaagtgagcgtggtcagggctgaagaatgatgagaaaagccactgccgagcgtggagtgggctggggccaaaccagaaagcatcacattctggaagcagggatagaggcaggaatatctgccagcccccagggcatcaggacagtagtgaagactgacagccaggctgcttgtaaatagactgacagccagcctgcttgtaaattaagagtgatctttaaagtctctgtttccaaaagatatctagcagcatccctagttgtattactaaaaacaacatggcagaataatgaaattccattaattctctactgggttataaaccaaaattccaaagtcaataaggttctttgaaaatagacatctttatttaactataaatctaggctaataaattactaaataaaataatcatgaa

SEQ ID NO: 222673 - DNA, 356 bp, Homo sapiens
agggaaagagagctctggtggctcttcctctccttataaggacagcagccctgttgaattagggcctacctaatgacctcatttaacctttatcatctcctcacaggccctatctccaaatatagtcacattgagggttagggttacaaaatctgaattttgacaaaacacagtcagtccataacacatatcaccaggtggtatataatttggtttgtttcactactggcctttattgcaggtggtgtctgtcaagtttctccaatgtaaagttcctcattttccttttgtaattagtaactgttttgttgggggacacttggaaactatgtaaatattccactcctcaaaaaata

SEQ ID NO: 222674 - DNA, 545 bp, Homo sapiens
tgacgtgcacaggatatgaaaatgtctgatagtgttgtggctgcagtgagacctgggagtggcagtttctttcactgcagttgtctgtccaaagcgaagtgaactagcaagtctcttacaaaagggcaagctctgaactgcgcacagtgtgagcacagacacagtggggctaatctacaggggcagtgttagcagcaatgggttgtccaagatttctgagaggattagcacctagaaaataatcttattttgctttgtggtgtcagacaaaggaactgaatgagaaaattattgaagggcatattgtagctgatatgcagatccaaggctgactttcttcctctcccttgaatccacttatcacaaaaatatggaatgagcagaacttatgggcataaccataaaccaattttcctttgtttcctactgtctctttaaagttttctcagtgggagaaatcttctgtgtccttggatgaagacttactcagtaaattactttatgatcactgataggtaataaaagatcctatggtcatttaaaaa

SEQ ID NO: 222675 - DNA, 570 bp, Homo sapiens
ttttcaacacaaatattactccatagccaatattaaatcctgtaattctccaatcatgatattctctatcacacctccctgcctttgctcctacaatatttctgttgacctttctttattcattcacctggaaaactcctactcttctttccagacacaagtcaaatgttacctttcctgtgtagccatttccaaccactccacgaaaataatgtggtcctttctctgcacttccacagctcatttcttatgctctcaatacaatgtattgtaactatttgttcacttatgtatcttctccactagatctccactggattcactagagcacttttaaaggaatattgttcatttttctttctatcctcagcatttggcacaggtcatagaacataatgaagctccaacaaatgttgaatgaaataatgaatgtgcgaatatttttaaagttcctagaagtaaatatggattttagatttttataagatcttgcatcacaaaaaaagcattgagtactttgcctttctggttttatttttacaagctaaccttcctttaaagcttaaaaaa

SEQ ID NO: 222676 - DNA, 319 bp, Homo sapiens
ggcacatgcctgtagtcctagctacttgggaggctgagatgagaggatcccttgagctccaggagttcaaggtggcagtgagctatgatcatgccatcacactccagcctcagtgaccctgtctcaaaaaaaaaaaaaaaaattggcttctacatttagtatctctatattcattttaattattttctcacatagcgtgactttcctgcctctcccccttccactcctgtcaccccagaatctctcagtggtaggagacagaaagggaacattcctctttgttatttcacccatctttccttctcatgcaccctacagc

SEQ ID NO: 222677 - DNA, 496 bp, Homo sapiens
aactcctgacctcaggtgatccgcccgcctcagcctcccaaagtgctgggattacaggcataagccaccatgcccggctagatacgattcttgttcagtaacttagaataactttttttttaaaaagggtgtttgtgggtgaattatgtttgagagacagagtcttacttgttatccaggctgttctccaactcctggactcaggtgattctcctgccgcagcctcctgagtagctgggattacaggtatgagtcaccatgcccagtcaggtgaaaggttttaatgggcgaaagcattggaataaatgtgactactacataccctcagttatgtgttgctattaagtctggattggtgccaatcttgtctccttcctttgccttcgcatctttataataaacttttagcaactgcctgttaatacaggtggggtagggctgaggggaaacttttttgtcttttatctcagaagcagtagaatggactaataaataa

SEQ ID NO: 222678 - DNA, 391 bp, Homo sapiens
tggaatctgaaattactttcagatttttttttaaataatgcaagtagatcaaatgttgatcacaagcatttcaatctttcaaaatgtattggaaaattaaatgaaaagtggagtttggtacaaacaatgccccagggcaaaaaacaactaacactagattttccagtccagccataacacaaatcaatttgagcacacttctatggccagactgccagattgttatgactgctaattcactcaatcaaagagtgcattagcacacccggcacaaatagccttaacaatagagtgcatttctcaacaattccaagatatatcacaatggagaggtaaagaggaagatcatttttatatctacatatttactaatggacctgtttccttagga

SEQ ID NO: 222679 - DNA, 816 bp, Homo sapiens
accaagtatggcagccaagagagtgctggcattaacccttccctaaccccagacagcacagctcaaagctgcaaaagagacttcttccttctgcttgaggagaagagagggaagagtagggaggactttgtcctgcatcttggttactggctcagccacaacaaggtatctctacaacgctgcatgaatcacagcattcctgggcttggggtgccccctaaagcagaaactgcttagttcacaacacccaagttctttcaaatatctagaaagttttcccaagaagaacagctacaaataatatgaggcggtaaagactacgataaatacctaactcttcaatatccagacactgaagaacatctactagaattaacatcatccatgaaacatgacctcaccaaatctactaaataaggcaccaaggaccaatcctggagaaacagagatatgtgacctttcagacagagaattcaaaatagttgtgttgaggaaagttgaagacattcaagacaacacagagaagaaattcagaattctatccgataaattaaacgaagatattgaaataattaaaaagaatgaagcagcaattctgaaccagtgtatttgaaaatatactgtcagaggaaacaaacaaacaaaaaagacaaaaaaaagtacatctgtacgatctagaaaatagcctcaaaaggtaaaaatctaagagttattgaaggtctttaatagtatatatggaaagatacagggatagaaaatttattcagaggaataagagaacttctgaaacttagagaaaaatatcaatatccaatt

SEQ ID NO: 222680 - DNA, 228 bp, Homo sapiens
ggactatgtctgatatgagtggcagtatgtatgatatgagttggagaaacaaacaaaaaagacaaaaaaaagtacatctgtacgatctagaaaatagcctcaaaaggtaaaaatctaagagttattgaaggtctttaatagtatatatggaaagatacagggatagaaaatttattcagaggaataagagaacttctgaaacttagagaaaaatatcaatatccaatt

SEQ ID NO: 222681 - DNA, 357 bp, Homo sapiens
caatcctcacactcaaacctcccaagtagctaggatcacaggtgtatgccaccaagcctggccaattttctttgttttttgtaaaaacagggtctccctatgttgcccagactggtctcaatctcctgggctcaagtgatcctcctgccttggcctcccaaaatgctgggattacaggcatgcttcatttcttcattgtgcttttctcaaactgaaatcaccccgtttactttgttattgtctgtatgcccaatacctccaaaagtgtttggcacagagaaggcactcaatgcactttcccagaatgaaggagtggccctaaaagcattttttgtttgtttgtttttctttgagaca

SEQ ID NO: 222682 - DNA, 483 bp, Homo sapiens
caatcctcacactcaaacctcccaagtagctaggatcacaggtgtatgccaccaagcctggccaattttctttgttttttgtaaaaacagggtctccctatgttgcccagactggtctcaatctcctgggctcaagtgatcctcctgccttggcctcccaaaatgctgggattacaggcatgcttcatttcttcattgtgcttttctcaaactgaaatcaccccgtttactttgttattgtctgtatgcccaatacctccaaaagtgtttggcacagagaaggcatcactgcaacttccgcctcccgagttcaagcaattctcctgcctcagtctcctgagtagctgggattacaggcatgagccaccgcgtccggcctaaatgtcacttagtacctttgatataaagagaaaatgtgtgaaagatttagtttttagttttttggtttgtttgtttgtttgtttgttttgagtgtgattctgg

SEQ ID NO: 222683 - DNA, 1883 bp, Homo sapiens
  misc_feature (1329)..(1329): n is a, c, g, or t
ttcattctgtcatcagatacctccaaatttagaacaatatctatccgtagccattggttttcggatatgctttaccctgggaacgtgcgtaaaatacatttccgtgtttggctatttctttcccagctgcatagagggtgtcaccattattttagataatagccatggccggtgcccactttaatcacttttccaatcacttttcactgattgcttctaaggcacttgatttcagatgtcactttttgctgaaatacctggataactgtttcagggggccttgtggactaccgagaagtttgcctccaggggttggtaaacttctaaaagtgccaagtcatgaatattttatgctttgcaggcccaagaagcaaaagtaagactattatgtagatacccataaaacgatttaaagtgaaatcatttaaaaatatgaaaaccattcttcacttgcaggctacgaacaagcagcctcctgtttgactggggttgctcagcgagccttctggcttctccggcacacacacattcaggtctccatctatgcaaatggagacctccttcttcttctcaccactgtaataaggagaaaacagacagtggaaggtttgtagaacctcatgattgactatagaggctttcagcatttttcctttactattaaatgggacactgtactaaaaaaaattctattgtttctatatttgttcatttattgattggatgttcattcatccaacaaatgtttattgaacaggtcctgtgtctccactgttccaggcacgggggatacctaatgaggaaaataagacatctctgccctctggagtttttagtttacatatgaacaagtataatatgtaggcttttggatgacaggtatcatatagaggagccagggaaggggacaggatggacaggggaagagggttgttagttttacatgtgatggaaagggagagtgatcagaaataaggagcagaatcctgtgtgttgcagatgtctgggcaggcgcgctccggaaaaggaagaggtggcgcagaggccctgacctgggaatgtgtgactagggcggaggctggagacccatggcagatgaagccaggccttgagatgactgtaaggacttggaagggagagccagtgggatttactgaggggttgagtatggggtgaaagagagaaagagtagtctaggacgaccccagtggttttctcctgagcatcggaaggttgactttcgaagcaggagagcttcagtggcacagattgtgggggatgattggggctgtgtgggtacagagtgagtttgaggtgcctgtcagaganctacaaggaggtggccattaggccattaaaatctggagtataaaaatctggagttcagaaaagaagtgtaggcttttttgagagttgttgacataaagatggtgtttaaagctatgagactgggtgagataccagcaagtaagtcagagaagagcaggggccaaagcctgagccccagagcactccagcattaggaggtggaggagatgagggagcaccagcagaaacctcgaaagaccttccaggaaggtagggggaaagcaggagactggtgttcagaagccaactgcagaaagtgttcctgaggaggaggcagagagggggcttcggtgacacatgatgctgactgggtcaaatcccttgaggaccaagacttggccttggcattcagtaacatagtggtcactggagaccttgacaagaggtgtcagtggggccaggcgcagtgcctcatgcctgtaatcccagcactttgggaggccgaggcgggcggatcacctaaggtcgggagtttgagaccagcttgaccaacatggagaaaccctgtctttagt

SEQ ID NO: 222684 - DNA, 1738 bp, Homo sapiens
ttatatacagaatagagctttattcctatgtgcccatctctgagaaatgtgttagcattcccaagtattttacactggcaatctggctacttaagacaaacaaattcaaacaacatttttatattttgactgacaccctcagctcctaaatttaagagaaataatggtacttaactattttcaactatagtcttcagtgattgaaaatgccttcattttaattctgtgactcctgatataaattaagaaaaacaatgcagttgcaagggcctgcacaacactgaaaataaaccaaaaattaaaaatggcacttcccaaaggaattaacaaacgtggagtcatggtgcttgcaagttccataactgaaagcattttgtttctgatttccctttataacatgtatttgtttattgaagcaattgtacaactaatggcacattgaattactttgtatgaagtgttttatattatactatttattttagcattcgttctttttcttcaccagctctatattacagtagcaaaagaacacttagttttaaaaaatgctgaaaggggttcaccacccacccaatcgatgaatggacttttgaagttgcttgtcagcaaattgtggatattttacaaaagcaaatgaactgtgacaatccacaactcccacagatgtgaattcagaaatgcatctgaaactccggtatgcctgacaatctattctttaagtttcattaacaaagtggcatccaatcctttcacttacaattccttgcaggaatgtattgtctagaggctgtctagtagtgattaagagagggtttttgttttgttttatttgtttactgtattaggtgaggaatgccatatttcttgtcagccaacagtacttgtctgagacagaaatttaaaaaaagaaaaagaaacctaactaattaaaatttctgtgcactttgcttccctgaccatattgattttatttgcttaaattgaaacaatacgctggatttgaccagattttgaccccttgaaagaagaaaagccctatatagtacatgtttctttgggttattctagtactgtttccttatttgttctgcaaatttcaaatcattttttgtgtgcattattttacatctgctgaaactaaatgtgttattattgcactcattaaaaatgaaacaatccatttctcttggaaaaaaatgacaagctttagatgatgaaagcttaaattatccatcacttgcaaaatgaattcatataatttgtgaacattattaatgtaaatgagacatttctgcttagattttttttattttgatgggatcattatatggttgatcatatgtgtgtaggaagctgctgtacaattaacttggagatctgaaaatgctttttgtcctcattgttgcagtttcaattgtaatccattgcatctcattttcttgggtgttggcactgtaatatattaaaaaaaaattcagtgctcagtattgtaacaactgtccctactgaatattccttttcataaatacttgctaccacagggaaattaagttttcatatagaataactagtttcagtagtaaccattgaagaattaaaaatgtggttcaaggcagatatttttatgaaaagttttctctattgtaaaatttgttgtatatggctatgctactatcatggaataagaaaagaacaagcatacctcaaataaaaaaaaattctgagttaaaaaaat

SEQ ID NO: 222685 - DNA, 812 bp, Homo sapiens
gtggtgctcatgcctgtaatcctagcactttgggaggccgaggtgggtggatcacctgaggtcaggatttcaagaccagcctgaccaacatggtgaaaccctgtctctactaaaatacaaaaactagctgggcatgggcgcaggtgcctgtaatcccagctactcaggaggctgaggcaggagaacccaggagttggaggttgcagtgagctaagatcacaccattgcactccagcctgggcaacaagagcaaaactccatctcaaaaaaagaaaagaaaaaaaattagccaagcgtggtgccacatgcctatagtcccagctacttgggaggctgaggtggaaggatcacttgagcccaggaggtcaaggctacagagctatgattgccactgcactcaagcctgggtgacagagtgtgacgctgtgtcacacacacacacacaaatcacttgaagtaattgtgtggttgtgtcaccaattttatatacacttagattcacttttattgctttttttcttaatggtttaattgtattttaattatataacacatttacatggttccgacatcaaaactataaataaagacagagaagtgtgtccatttctgccctctcctccactctctccccatcccctaggcgtagtcatttctttattagtccttactttatttttcaaagttacgtaataaatgtctatgtttctaagctatctttagatttgtaaaagggctaaaatgttacttttaaacatgtttggtttattcaaatttgtttataaatctctcctttgtacccctggctacca

SEQ ID NO: 222686 - DNA, 257 bp, Homo sapiens
agggctggagccaacagctctttgggcccagggcagttctttctgtggctgcggcaccttcccgctccctgctccccgctaagatgaggccgccccattgtttctccggggcagtctcccttccgtctgccctatgccagagactgagcgctggcgaccgtgaactgtgtgtggtgccgctgcacgccctcctgggtccttcagggccagtccactcaccaggcaccgtgtggcagggaaggagccgagggcgacac

SEQ ID NO: 222687 - DNA, 864 bp, Homo sapiens
cagtggtgcaatctgggctcactgcaacctctgcctcccgggttcaagcgattctcctgcctcagcctcctgactagctggggctacaggcatgtgccaccacggctggataattttttgtatttttagtagagacggggtttcaccatgttagccaggatggtctcaatctcctgacctcgtgatctgtccgcctcgccctcccaaagtgctgggattacaggcatgagccaccgcgcctggccaagaaactcttaaattgcagatgtacactaggtgtgtgctgtgtcctgggtaatctcagactaagaaggtggacgccagattggaaggtctggaagaggccacgctgcagggaacccggtgtgcaatgagttaaaactggttttccaagacctctgagaatggggaagtaagtgatggcataaagccgcagggcctgttcatttgtcgggggtgggtagagaggggggactatcaccatctccagggcggcctgctgtgctgggcagcctgtgtgcagttccctgggtttaccagcactgctccagggcttggcctcaggctactggcctctgttaagcagagtttcccggagtaaactgaacctggggactctggctcagcagagctctgctacggcctaagagatgctagctctgttttcccaacttaatgaaagggcacttgacaagacagagcccaaagacagccctctcaagacccaggaggctcccacccaagagagctcagccctgctgatcaagactgggagactggtcagaccaatccatactggttggatccagattccaaatgaactgatgggaaggtgctactgggtgtgtcacaaaccatagtccc

SEQ ID NO: 222688 - DNA, 551 bp, Homo sapiens
gtgccgtggctatgtgaagagtgagaaaaatcaatttccactgtccacggaaggttgtttgatttattactgttggaagaagaaattctttatctcccaccccctgttggagagcactgttttacagtctgctgttagagaggctctataaaagcagctatatttgtgcaaattttggtattttgataaccttccttgactattcagaggacattgaacattcccaatttttataaccctcatttgtttttgattaagcaattataggcactaaaagacagtctgcaagagagtgtggccagcgtacctgcaggattatttcatgccataggaagcatcagacggctttaatatttcatgaccactggcaggaggaaggaggggtttgctaggaaagagcagaggatgcgatctggagtcagacggggattgggatcccaactgccattggagaacaggtcggtgtccatgagcctcagtttccttatctgaacaatgagccaccacaatgtcctctcttgactttagctttgtgacttgccttggcaaat

SEQ ID NO: 222689 - DNA, 551 bp, Homo sapiens
gtgccgtggctatgtgaagagtgagaaaaatcaatttccactgtccacggaaggttgtttgatttattactgttggaagaagaaattctttatctcccaccccctgttggagagcactgttttacagtctgctgttagagaggctctataaaagcagctatatttgtgcaaattttggtattttgataaccttccttgactattcagaggacattgaacattcccaatttttataaccctcatttgtttttgattaagcaattataggcactaaaagacagtctgcaagagagtgtggccagcgtacctgcaggattatttcatgccataggaagcatcagacggctttaatatttcatgaccactggcaggaggaaggaggggtttgctaggaaagagcagaggatgcgatctggagtcagacggggattgggatcccaactgccattggagaacaggtcggtgtccatgagcctcagtttccttatctgaacaatgagtatgtgtagcagacaataccgtccagatcctcttagatcccttcaagcctt

SEQ ID NO: 222690 - DNA, 407 bp, Homo sapiens
aactgattccatcattgcttttgccataagggcccaagcaagtcaggctcccaaacctgctgaggctattgttaatgtcagcagaatcgcgttggagatgccaccctcccatacccctggggcagtggcctatctcctgttttaccttggagcccagccctgtccctacccctgaaaagaaactttcccctttcccgttttccctgcaaggcatagctcataaataatcatttcctgctgcataaccattcgaaatggaatccctatgcttgactatagtggggaaaatttgtttagcaaggggttttcattatataatatgtatgtgacatctggtaataggaactgcattatatttattgttttatctctaagaaaacattgaaataaaaggaaaatgatcaggg

SEQ ID NO: 222691 - DNA, 464 bp, Homo sapiens
atttgtttccctcatagttaaaatgcggccaaaattttctctcctgcttgcattatatagttgttaggataaaatgtgatcatgtatacggatttgaatattaacaccacttcttgcaagccatgtaacttttggtaaggttaagtttctttttgcctgcttcctcatccttaaaatgggataatactggtagctacctcaggggttttgtgaaagcaaatgagttaattcacaaaaattgtttttcagaaacattagtctcttattacttcataaactttaagtagtaacagaccaatgtttctaaaaaacagatgccaagatgaaaactagaaataaagacactgttctaatacatagaacaatgcctgacagtcctgatatattaactttttaggtgaatgtttgaaggttctgtgacttagtatatttttagtatactgtattttcgaaatagcatattt

SEQ ID NO: 222692 - DNA, 438 bp, Homo sapiens
gcacgagcatatgtgcataaacgatctctctgtagagtaaataagacttattgggcaataagaattttaactggcaaagcacatttccccccagtttttcaactaaagaccattttattgcactttttttacatagtattttagagaagaggagggggactcaaattttaaggatggttcaacaacaacaaaaaacagatggttctgaagtctcctgtgttctggtgaagccggtggtatagagtggactggtgcgggaacacgtggccccggtgccaccagctggtcacagtggggtcacagtgtggtcactagctgtctgacgcatgaccactggggcgtgccctggatggagtcaccctgaggatgagatgggatgacttacagggaagcgtttggaaaactgcagtggattgaattaaaatgaatgagagcatg

SEQ ID NO: 222693 - DNA, 447 bp, Homo sapiens
agtttggatgggaaacaagttagactttaaatttatcatatttctaattcacaccaccaagtaataaatacatcaatcttcattatgtgatgggaaaaaagtagagtcagagttcttttcaaaattccttaaattgttcagaagtacaaacaatattttacttttttgctagaagccagaaaaatccttacaatcattcagacattcttttaacgtgtatgtcctatttcagactttatcagcttcattgggatgaaggattcccagtgaagctgtacatatgatgtgaatctgctctgtgccatctagttccaaaatgcgtggtgtactctggcacacctaagacaaaagaagcctattggccagaatgatcacattggctgctctgcctatggagaagccatttattcctttactttcttaataaagttgctttcactttactct

SEQ ID NO: 222694 - DNA, 511 bp, Homo sapiens
aatatttcacataataagcatcaggaatgagaatggcttcagatatctcaacaacatcatcacaatctatatgtagccaaattattacttgagtttatgggtgaaataaagacattttacacatgcaatttctcacaaaatttatctcttatgtaccctttctcaggttgtgttccaccagaacaaaaggataaatcaagcgaaagacagacatgggatacaggaaataagagatctaacatgggagagaagcaacaggaatacagggatgacagaactggagatcccaggaatgacaactttgaagggcaaccagtctagtgggaataggactgaaggtttcaggagagaccgtcagaaaaatgacactggtagaataccaatacacctgaatgtcctaagaggaaatttagatggctggtgaaacattcaaggatgaataactgataaatacagagaaagttaaataaacagaacactacaagaaaacaaagagttgcacagaaaaaga

SEQ ID NO: 222695 - DNA, 602 bp, Homo sapiens
tgctaatcatttgatatacatgtttggtaaatttctcattaagtaacgtggagattataaataatacttgttggtaattagtttgtaagctcaacaactatggttatacacatgcaaagcatgattcatcactaagttgaatttttgtacataactcattcgttcaacagtagttcagtgtgtcactggtatgttagagtcctaggcttggtgctttggacatctagaaacagtagatgaaacaaataggtaaagtgccaggactgggaaaatacaaggcacttggtcaagtacgatttatgatttttacttatgccaaaatgaagcttgtagtttacaggcgaagatatttttcaatttcagaaatatgaacaaaaatggaagagatgacatttcagctgagaaggctataaaatatgagtagaattcagatacagacaaaggagataaaaatagcattccaaaggctgggcacagtggctcatgcctattatcccagcactttgggaagccaagaccggtggatcacttggggccaggagtttgagaacagcctggccaacatgactaaaacccatctctactacaaatacaaacatttt

SEQ ID NO: 222696 - DNA, 490 bp, Homo sapiens
ctgctccatttcaggaagcgtagctaacaagaatgctggtttatgaatttacacggagaggttgttcatggtcctttatttgagaatagtagtaagtggacgtcagagagtcatcttgccccaggggtacgcccctgtattttgatgggaatatttcagtagctcctaactggtccactcatgttgcctggatgttccatgctccttcacaaagctgtccttgctaagttgctaactagaaaacccttcctgcctaccagctagtcaacaaactcctacttccccatcaaaacccagctaatatgtcccttctgttttcttttcaacaacaccatttatagatcctccaactgagcctttttaataacactagtaatgttatcatttattgagctcccattatctgctaggcaattttaagtattgatatacttgtaccttttaatgttcatggtaattatgcaatacaagtataactatttacatttct

SEQ ID NO: 222697 - DNA, 412 bp, Homo sapiens
atttttctttaggtaattggggtcttattggtccacaggcagccctttattcacttctaaggcataaacgtttttccattatcattaaaaatgtcaaacacgctgaggcaggagaatggcatgaacccgggaggcggagcttgcagtgagccaatatcgcgccactgcactccagcctgggcgacagagcaagactccgtctcaaaaaaaaaaaaaaaaatgtcaaacatggccgggcacagtggctcacacctgtaaccccaactgagatagggtatggtggcacacacctgtaatcccagctacttgggaggctgaagcaggagaatcgcttgaacctgggagcagaagttatagtgagctgaaattatgccgctgcactccaacctcagcgacagagtgagactatctc

SEQ ID NO: 222698 - DNA, 376 bp, Homo sapiens
tgtatcataaaatgtatccatcataattgtataatgtgatgacttttactgaaaagaattgtacaactgtgatcacagtcaaggctatgaaattctggtgacacccaaaattccttcatgaacctttacaggcataccctatatctaccatgagacccaagtgaccactgatgttctttgtgtctttatattgttgcctttgctactaataccatgtaaatggaatgaaataaaatgtagaattttacatctggctattttcacttagcataacaaatttgaggtccatctgtgttgcagcatgtatcaatagtttgtttcttttcattgctgaatagtgttgcgttgtacggatattccacgttttgtttatcct

SEQ ID NO: 222699 - DNA, 328 bp, Homo sapiens
tacatggctgtaatactgccacacacctcaagcaatctgcacaaagactttctgtgcttcgtaaacataccggttcaatgacatcccttttcacactactcacataagaaatatctccaagaaaatgtcaagtggttataatgtctgccccttttggtcatgctactctgattttattttaaaaaacagctctatcgcattatgaagaaacattaaagcacatctgcaggttatatatttcggcttgtattttcatttagaatcatcatatccacgtaattccagaatggtaaaaataatgacaactataattcctttcatttggcaa

SEQ ID NO: 222700 - DNA, 713 bp, Homo sapiens
ccaggtgaagtgttgggtatttggtgtgcggaagaccggaaagaactggatccagcagaggagaaatacttcaagaggatgctctgggctgggactcagctgggttggagccctggccccaatatatagagcaggacattggttactcatgtcaaggatggactcagtcttcatctgtaaaacaagggggctaggcaaggccttcccaaagcagtctcaagggatgtgaagagttgtgaaaagactaaagtttaagcagagttaagtaaatttctcaccgcctgctgggacttgtcagtgtgtttcaaaagctgacgtgcattgtgaatctctgagaggagaattgctgggcagcaatttcctgagctgagtgaatcacagatctcagaactcttcagcctgctctcattgcaaagttgtgtcctccatctgctgttctgtagaatgtttgggaaaggctgctctgtagttttccttccagctctgacattctaaaattctaagttggtaaaaaggctacaaaagcctggaaagccagagatgtcaaagagaggtcagagatctggttgtcgtacttgtctaacaaggttgcacgtggtgaggatttagaatgatgctctacttctaggtctaggggaacagatggaacagaagagtgggagaaaaatcaaaacaaaataagtataaagttaagtcgatgaaggggaagagaa

SEQ ID NO: 222701 - DNA, 433 bp, Homo sapiens
gacatcttcatgttctcttcctgccttttcagctccctaataacaactttatacttgtttaacaattcttcgtattaaattttttccattccagtaactcatgtgacatctatctcttgattatacactgactgatgccaggaggagaaaatagtatttcagtttgacttgaaggaagggtagaatttcagtaagtggcaggaaatttcacataggatgagtgtcagcatgagtaaaggtagcaaagatgaggaagtatggtgtatatttgggaaacattttgtgttctaggcttttttgaagcacaaagtacatgttacaaaaaaagactatagagaggttggggtagacactaatttggaagaccttgaactctaggctaggaaatttggatttgattgataacaaatgattttttttaaaaaaatgaaat

SEQ ID NO: 222702 - DNA, 600 bp, Homo sapiens
catattcagggggctaggcgcagtggctcacgcctataatcttagctctttgggaagctgaggcaggcagatcacctgaggtcaggagtttgagaccagtctggccaacacagtgaaaccctgtctctatgaaaaatacaaaaattatctgggtgtggtggtgcacacctgtaaatccagctactcgggaagctgaggcatgagaatcacatgaacctggctgggaggcggacgttgcagcgagccgagattgcgccattgtactccaaactgggagacagaatgagactgtctcaaaaaaaaaaaaaaagacccctcatattcaaataaagtactgaggtactggggttaggactccaacagatgaattctggggggacataattaaacctttaacatcacctgatcccatggaatatatttagagttgatgtgtttgtctccccactagagtgtaagccccatgaggaagagaccactgctctattccccgtgccaagaatagtttctggtacagagaatatgctcagaaaatactttttttttttttgagacagttccgctcttgttgcccaggctggatcttggctcactgcaacc

SEQ ID NO: 222703 - DNA, 379 bp, Homo sapiens
gaacatctcttaggaagagtccagttaacctttcctcctgatataaagagcacaatgtgaaagagacagctctttacccctctccatctctgaaggaatttgtgggacgccactgtcccaagattaggaaagcaaacacaccaaagtttgagataatctgctagaaaactgttcagatttctggccgcctggtaatgcagaatactccggcaagaggataacacttgtccttgttaatgggaaatacctggagacagtgagttttttttttaatttgagggaaagtgttgtcatttttgccacctgctactcagagatgggattttgtcagattttggttaagtaataaaaatcttaagttttctatgacagttacata

SEQ ID NO: 222704 - DNA, 498 bp, Homo sapiens
accctggctggtcacgccactacacgccatcagaacacaggagccatactggccgccctgctcagcctcagcctctgcattcagccacctggtcctgtgggtcctaccacgtggacgctctctgacacctgcccttctgcattcctgctgcccctgcctatgtgcaaacattcatctcttttctgttttattgctacagttgcccaacagctctttctacctacgttctcaccttccccctcctccctattctactccattgccagagttacatggctggagaaagaacctcaaatgtagagtggcatgaatctcactcctcagttcatgactgccatcatcatcatcaccatcatcaaacgtgtcctttgattttttttacctgatttcctctatcattctaaccacccttccttcccacacacataagctatagccacttcaatgtgtttaataaatgtccttagatatggatggatccgcgaagaacatgcagca

SEQ ID NO: 222705 - DNA, 430 bp, Homo sapiens
gcacgaggtggagagaggtcagggatactgctaaacacctacagtgaacaagacaaccccaaagaattatctgcccaaaatatcagtagtgctgaggatgagaaactctgatctagagatcgagaatcagaaaagaaggtagaggcccggcgaggtggcttatgcctgtaatcccagcactttgggaggcagaggtgggtggatcaccctgagttcaggagttggagaccagcctggtcaacatggtgagaccctgtctcacctaaaaatacaaaaattagccgggcatggggtggcacacacttgtaatcccagctattcaggaggctgatgcgggagaatcatttgaacccaggaggcggaggtagcagtgagctgagatcgtgccactgcattccagcctgggcttcagagtgagactcttgtctca

SEQ ID NO: 222706 - DNA, 333 bp, Homo sapiens
ccaaatcatcttcaattaatacatcgcttattttttccaagttgctcaaaattctgagcacattctcatttacatctgtatcgagttagtgttaggcatcatcatctccactttgcagatgggtgcctaaggcggggatgaatggacttttgtaagtgcagagctggagcaaagtttaggtcacagctttgccaagtcattgttttgttttcctgggagtaaaccggagatttagtatggacctggctggtttaattattgttttgggaaaaaaatctaaaactcattccaacatgtcttgaaatgaattataatgttgactctaaagtctca

SEQ ID NO: 222707 - DNA, 336 bp, Homo sapiens
acatgacataattgctttttaaaaactgaaaacctttggtctgtaattacttctttgatttccttatcattgacgtaattgttagcatttctgaattgattttgttcttttcagaagtttctgagcatttctaatttgatgtttaagaaggcatttgtagataaatcttggaaggtacaggcaaaatgtgcaaagctctagctgtgggtgagtgacccggaacaaagcctggagtcagaatttgaatgagaaggaaactacttactggagagttttcaatcctggggtaaattatgtctatttctggtgttgtttatcctgttaactcagtagaaa

SEQ ID NO: 222708 - DNA, 616 bp, Homo sapiens
ctagatcgatttctttacattcccttattatctgccctcaccctttgccagggtaagaacagctgccttcagctcattcttccctgaagctttgcaaaacctcctggccttccaagaaggtttgcctttttccctacaatttttataacttttcctaccagcctgactgatctcctacatctcccccttttctgatttttgcatcaggttttgttgattgaagagtatagatgtgtgcagcaacaggtttgtcaggtgccacggttataactcatgttctggctttgcatcctagaattagtaaataacataagacaaacatgagtataatcagtaacattcttttctaatcaaggagtgacatgtagtattacttggcacctcagttcaatgtgtgccgttactaaggaaccccccactaggggtatgttaacccctttcagctaagcagttatgttattagagactgcccaagtaacagggtggaagaaaggcagatctaagagatgagcctaatagagtgtagcaggtgcaggttgcaggcagagcgagagcataaaaaggataaataccctatgagagttgtgatgtacaacagagagtatagccaagggac

SEQ ID NO: 222709 - DNA, 550 bp, Homo sapiens
atggctttggaggcagttaaatctgaataggacttgaagctcacttcttccacttaacatatgaccttaggaaagtttcttctcctatctgagcccaagtttactcacttgcagaatggaatgggaacacacataggtaaatcacagggctatcacaaacatgtaaacattttatgtgttaagttccattctgtgggtcagatcgcatctagagcaaataccctttaggatggatggccacaaactagagcatatccaaaagagagcaagtacaactatgaaggtttgagacctctgaactgtgatgggtagaaagaactgaaagcatctgatgaggaaaaaaaagaaaacttgggaggatatgatagctgtcttcacatcaaataaccagttccaatcagtgtatcttcaaggataagagcctttagttgagcatacagaaaagcatggcttataaacagacctgtctaaaacagaatgagttgccctatgaaagagctgttcattgtttaactagatgtagttatgcaatgtttggtaatactgatca

SEQ ID NO: 222710 - DNA, 505 bp, Homo sapiens
cagggagctgagtgcgaggagacccgggacaccgctgcactggccccgcacgcgcgtctcagtggcgggtgtgctcctgcggtgttgggacgcatggagcccgtgctgtacgaaacagtcgtagaaaactacaaacaggctacacgagggggaggcctcgagctgcaaagtggtggctgtggaccacgttaaaccgtctctacccggcctgtgcgcttggcctggcagcctgagctcacaatcgtccgaccacgtccactggacgccctcggtgactgctgggcacatacgggggtcatcctatcaaaagttacggtgaagtcagggtgggtggcgagtccctgcaaggtcgcccctctgtgccaacacagcctgatggcttcttgtttcaggaaacatccagaattacaactggccattgagttattacatatcaattgaacaaggtagttttaaaatgaaagaaaatcttgcaacatgaataaagagatagactctttgaatc

SEQ ID NO: 222711 - DNA, 497 bp, Homo sapiens
gtttttttttttgctccaaagttcaatctgggataccatattatatttagtcattgtgtctccttagtctcctcctacctaggatggtttcttggcctttcctcatttttcaaggccttaaagagtaccagtcaggtattttgtagaatgtccctcaatttcagcttgtctgatatttttctcataattcaactggggttaaggatttgggggaagatacaacagaggtgacaagcttttctcattgcatcatatcaaggggtacatgatagcagcatgactcactactgctaatactaaccttgatcacttcaagtggtgtccgccaggtttctccactgtagagctactgttttccccttcccatcctctgtaaggagcaagtcactacatccagaccacactcaagggaaaatgatagaagtaccacctcctggccaggcgcggtggatatgcattgtataatgctttgtgtattcaaggaaacttgtgcacca

SEQ ID NO: 222712 - DNA, 451 bp, Homo sapiens
agccagcgcgcccggccccctttaatatttttagacctcaggttaactaaaacctcagaaaacaaaaccacggataagaggggatgattgtaatgtcacgggttatttggggttgcctctctactgtatgggtggcctccaaactgggctgaccatcaggaccacagggcagcttatcttatttttcatagtagctttaaagctaactaaatatggccttagaaggactccgtacttctttatttgagtcctcgtggacgaactgcaacctagcttaatagatagacaagattgaaaacctaatttaggagtatgcacctgtaacaatagctaagtcaggaccacagggcagtttatcttatttttcttagtcgcgttaaagcgaactaaatatggccttagaaagactctgtacttctttatttgagtcctcgtggacgaactgcaacct

SEQ ID NO: 222713 - DNA, 254 bp, Homo sapiens
  misc_feature (224)..(224): n is a, c, g, or t
acatcaattatacctcaataaaacttaaaaagaaaaactagacaggaaaaaactaaaacttttttttccaagtaaaagattaggaaaaacttggagcccacaattaaaattataagacatcacattatttcggatttccagaattgttttttttttttttttttttttataaacagatttctctctgtgtttgcccaggcgtggagttgctagtggttcgactntcagcttcacctccaacctctccaccctcc

SEQ ID NO: 222714 - DNA, 525 bp, Homo sapiens
attacccacattttaatttcattctaatgactagttcggttctgtcacaacaaactaactctcagctgttattctcaactaaaccttctttcaagattaagaatcaaatattcaagaagcagtaattttactcaatcctcaacttcttaatgatatgaaagagtttcaaagacatactgcatggtgaaactttccctaataagggaaatatttttggtgaacttattgagtttctgcctcccctatcagattataaactccccaagatgaaatcttgtatctagagcaaaagccctggccccacctcctcttctttctaccactctgtcaacgatcttctaaatctgttgaagctgacatgtaaagctatatatcattttagcagctctgaggtaaggcatttgtttagtgtagtgggcagaacacaaatcgggcagttaagttcacctctctgtacctcagttttttttgtaagctaaatggggataataaaatgtacctgacagagcggatatgccagggagg

SEQ ID NO: 222715 - DNA, 466 bp, Homo sapiens
cctttcacccattttgttttaccaaattgtaaataaatcataacctggtaccatcacctagacagaaattttgtggaatatctacactataaataatggaacccctgtaaagtagtaactatttcaaagttaggatctcttggctttggcaaattttatttttgtgaaaattaaagttgggcattggcaacccaataccttttagtgttccactagaacaaaattaaatattaggccagtaatttgacgcagtggtatccaaacttttccatttcatgccctaaaaattagacactcacaacccccatcataggcatattcacttatttgtgtgttcatttttacgttgtaggtattactagactaacacatgtgttcatcataaatgattgtataatatatatattttaaatgataaaatataaataatgagaaagaataaagatgaaaatgatgttttattttg

SEQ ID NO: 222716 - DNA, 421 bp, Homo sapiens
atactctccggtgtcccttcactgccctctggcgtcccctcaccttctggtgtcctgtcaccaccctctgatgtcccttcattactctctggtgtcccctcattaccctctggtgtcccttcatctgctccatgtcctctactctttctgctagcaaagaccagcgactgcagcacgggggccacacctgggatggaccctggaggggcaagcatgtggttcctttgacactccacacagaaggcccatgcaaggccatgttcaaccagagggatggaagggggacactgaaccttctggcacagggtgggctctggtagggggcaagagcccaggagactgtgtggtttgtcctcagcctctcctgatgcttccagggcatgtccattttcatgtaaacttaagagacagtgtcaacagt

SEQ ID NO: 222717 - DNA, 416 bp, Homo sapiens
tgttttacttagtataaaacccaaactccttgtgtggccttagccctgaagttttttggcctctgcttccttctcatgccagcttcctgcttgcccattagtctccaaccacactggcatccttttggctctgtgagtgtgccaagctcatacctgctatagagccttaacactagctgttcgctctccaggaataacttttccccatcctgccatgactggctttttcttgtattcaggtctcagctcaaatgtcagttcatcagagagacctccaactaccaacttaagtggccccttcagtcactatctataacaggggtatccaatctttggcttccctgagccacatcggaagaagaattatcttgggccacacataaaatatactaacactaatgatagctgatgagctt

SEQ ID NO: 222718 - DNA, 363 bp, Homo sapiens
atgaggtaacaaaaatattaaggtaacttatccaatgtcacgcagctaataaatgttgagtcaggatttgaatggagcagtcgactttcagagtctctgctcatcacacagctctgtactttgtaagttgtgtatcaccatttttatttagactagaacagcactgcacagtaccactttctgtgatgatctgcacagtgcagtagcgtagccactagccacatttggctcttgaaatgtgcctggtgtaatggggagattgacttttttatttaattcagttttgattaacttggatctaaatatgaatcactgcatgtgttagtgtattatatgtgtaacaacagcttttttatcttaata

SEQ ID NO: 222719 - DNA, 717 bp, Homo sapiens
ctgtgttcttaatgaagacacctcttatataagaggcgtctggtgttgttctgttgtcaagatgaagtcaggtgtccagtaaccactgtttgcaaacttgtatcaggacatcttgaactaatttgctgttgccatgaatccttctccaatgtttgagccacccagtgggaataggaatgtcctggaacactctgtctccactttggtcatcttcagaaaagttatctttcctttagagaaactttgggggttgctgtgcacgccatgcaattttagagtagaaggcagccaggagggcgagactagtgaagggggcttcgtgagaaagtcgtgactttcctggcccttgaggacttggcaagtgggtggaaagagggaggacagtctagcaagaggggccccatcattcgaggtatggtgtccagcttggtacccatgcatgactgtgaggagacaggtctctggagtggagaacgggggtagaagcaatgggagaaagaaggttggtgcgggtcatgaggtcaggtgaggatttgattctggaggagggctcagtgggaaaattttggaggtcagaaatcttatggggagaaaagtatttgagggagcctagcctgtcatggtggatgtggaagggaggtcagtttagaaaggcagtggttggagcaatctaccccaatgagcttattggcattggcatgcaaaggcttttcagga

SEQ ID NO: 222720 - DNA, 477 bp, Homo sapiens
  misc_feature (468)..(468): n is a, c, g, or t
  misc_feature (471)..(471): n is a, c, g, or t
ctaattaaataggactctctggaaatgcatgttattaagtatacacgcaataaggtaatcgatttttgaatgttctaagtttcatatctgtattagtccattctcccactgctttaaagaactatctaaaactgggtaatttatgaataatagaggtttaatagactcagttccacaggcttaacaagaagcatgactgggagggctcaggaaacttacaatcatgacagaaggcaaagggcaagcaagcacatcttacatcttatcctagcggagtaggagagtgagagagagcacaaagggggaagtgccacgcactttcaaaccatcagatctcctgaaaactcactatcttattatttttttttaattttttgagacaagagtcttgctgtgtcgccaggctggagtgcagtgagctgagattgcaccattgcactccagcctgtgcaacaagagtgaaactcnatntcaaga

SEQ ID NO: 222721 - DNA, 382 bp, Homo sapiens
gtatgtaaaagcaaagcagcaatgctaagaggaaatgaaaaatgaaatgtgtttttcccttcataaccatataaaacaatttaaaaagcagttagctgcctagttaattatggaatgataaatttcagagtcaaatatggttctagaatttgccaattgtaattttcttccatttatgatgacatccaattagcattttataacatgtatagaaataaattacttaattttatgtaaaaaggtgtagtcttgagaagttgcttcctgatctatctcttctattttaattaagcactctccacctttaagatcctgggacttagattaagaaccaggagatatctctgctatagcatgaacattgtcatcaaacacaagccaa

SEQ ID NO: 222722 - DNA, 477 bp, Homo sapiens
ggtggagattactgaaaaagtatgggagaaaattatacattttgatagaaaatcgtaagagttgaatggtgtttgcccaaaaggtttgtccacccagaatctcacagtctgacctcaatcgtaataagcatctttgaagatgtaataaggtaataaagtgtgctcatcctctattacaataaattctaaatctaatgagtgtccttataagagatagaataacagaaagacacagaaaaagcggggaggcatgtgaagacagagtcagagagactggaaagacaaaaaccgctaagaattgctgacagcatggaatgggttttttctgggtctccagtggaaaccaatactgccaacacattcatttgtcttctggcctccagacctgtgagagaatcaatttctgttgctttaagtcatcaagtttgttgtaatttgttatgacaaccctggaaacctaatacaacaatgtgatgc

SEQ ID NO: 222723 - DNA, 449 bp, Homo sapiens
gccccagataccagccaaggaggctggaaggccaaccaagctccaaccactgggcgtcccatcgcagcgtggctttactgctaacgttggcattgctgtttgtgccaggggttctgttcaaaaccaagctcttagaagaatttggaggaaattatgactgcaaccatgtctttaagcagctaaccctggagagagaatggaccaagctaaacattaaccattgctgctggtaggcctctgacagcacaaggtggtgagcctgtctttcagaaaccagctagctgggttcaaaaccaagcccatcatgtagaagctatgtgaccttgaagaagttaattagactctctgaacctttggttctttatccaccaataaaaataatctcacctaccacccagggttgtaggtccaagtgtataatgtacaaatgaataaattaagacagtctc

SEQ ID NO: 222724 - DNA, 383 bp, Homo sapiens
agaagtctttatcaaccacagcagaatccacagttatatggcttctgggaatttccaggttttcaggtgctaagtgagggaggaagagggtatgaagcctcctggcacagagttgctggcaatgctctgccctgctggccctgctgccttcaccatcagccactcaggtatagaaaatgcagctacctcttaggagtccagagaggaggtctaacttaggactcaggccagtggctctaccatctaccagaacctgtgatcttggacaagtgattgaattctgtggatcctccatttcttcaaaatcgataaaatggggcaataatggtatttctctcttagagttgttatgagggttaaataaagtaatccatataaactat

SEQ ID NO: 222725 - DNA, 625 bp, Homo sapiens
gcacgagctgacatataaacacgttacttatggatcactttgagagaggaaacactattcagaagatttaaatcccagaatttaatccattgctttattgcaagtttacagaagacttgtcttcagttttatctgcagtagttgatctattgactttaaatgttgaaaacttatactaatgttgcttactgtccaaaattattcctgggagataaacattcagattttctacaataaccactgactggccccttagcagccattttaaatgtaaatttgatgatattgcccaaacatccccagtccagttcaactttcagatcctcaagcctaccatagtcctttgtgtttgatatttctttcttatccttaaatgtggtagctccatgagcacagggacctgtgttttgattcactgtctgcatacttcactttgcagaacatttttaaggtccatgcatgttgtagcatgtatcagaactagactccttttatggctaaatattccattgcctgcgtatagcatatttatccattcagttttcaatggacacttggggtgtttccaccttttggctcttacgaataatgctgcaataaatattgtcatataagtatctgttca

SEQ ID NO: 222726 - DNA, 540 bp, Homo sapiens
cactgagcacataatgctttttctaatgaaccatttgagagtgagatgctcctttactgttgattactttggtgcatttttgtagcattgacatgctcttatgtaaaaagagtataactattaaagcaagatattaatagtgatatatcaatcactaccatctgatcatcagaccccattcagattttgccaattctttcgataatgtctttcattgcaaaattctaacccaggatctgtgcatttgattgtcagggctctttactctcttcatgtggaatggcttcatagtctttccttttatggcttttatgcttttaaagattacatgccagttattttgtagagcatcccataattagagtttgtctaatgtttcttcctgattagatgtaggttatacatttttggcagcaatgtcacaaaagtgatgttttgttcttattgtattctgaattgatactcaattttggtttattccattattactgatgttaactttgatcacctgaaggtagtgactactagttttctccactg

SEQ ID NO: 222727 - DNA, 591 bp, Homo sapiens
ccagtgagtctgagtgctggcttgcctgcctataaaaggggacaacaattccttggaagattgttgtgtggcaccatagcagtggctaaagagccagacacacttggttgtgaatcctggttcttcccccttagttgtacaaccttgggtaggttacatcacctctttgaaccttagttttgccacctgtttaatggggataagtgttgttatgtgattgaagtcatacatgtgaaaaaatcttataaacagaaatactggcaaaacagaaggcagtatttccacagtcagtaaggagaacaggctgtgccgttgaagctctggcctgacctctgtttggatccctccttctctgggccagcatcaagttttttttctttttcttttttttacattttagagacggggtctcactatgttgccctggctggtttcaaactcctggccccaaactcctcccagctcagcctcctgagcagctgggattacaggtgtgagccaccatgcccagctccaacgtcaagttttgaagagttctttttatctcaggccctgatcccagggatcgaagtagcactggagagagaggaa

SEQ ID NO: 222728 - DNA, 368 bp, Homo sapiens
aaatgatatataatatataatattatatatataatggatatataatatataagatataagatataatatatatgtaatagatatacaatgttatatatataatagatctataatattatataatagatatataatatatgtacaatagatatataatatataatagatatataatatatatataatagatatataatattatatatataatagatatataatattatatatataatagatatataatattatatatataatagatatataatatataactttccatgtgattttcctcttaatttttttctagctgatccatatgaattcctcttattaagaaaaataaagcatccaggattcaatga

SEQ ID NO: 222729 - DNA, 469 bp, Homo sapiens
atatcatacagtaaaactctcaccaatgacagcgatgatgtagggtgaataattgagcatttgttaaacttctaccattgtgaaagtaacctattattttcctggttgtgcactgaaatgcctcaatcaccaacagaacaagtcagtaaaaaatgatacagttcattttgtattgctgtttttccgtggggacggtgtggtgtatcacatctctcaccccttgaactctactttaccaatactgtgctcaaaatctcttccctcattcattttgtaaaatgttttatatcttggtggcgattttttttttctggctgttaaaattaagcctgatatcatgacatggttttctgatttaggattactctatagaaaagaacagtatctggcaaaaagtatcatgtcaaaacaaaacaaaacaaaaaaaaagaaattggtagcagctgccctgaaatacatttctgtctct

SEQ ID NO: 222730 - DNA, 523 bp, Homo sapiens
cacacagttttgttagaaggattaaataaaataatcaatgttaagtgtttcccaccatgcctaggcacacagtaaacctgattatgttatgatcactggcaagagaagaaagaataggaatcctgactctgccacgaagtaatcttagccaagttatataatatttcttggtcccctactgctctatttatagtatggataatgtattcgctatcccccaatactattttaaagattagatgagaaaatttaaagcaaagaacttttaaacagtaaagaacaatactaatgtaaagttaaagtattttaagggctctctactttttaaaatactgatttttaactcaacatggtatttccacacaatggaataatatgcacccattaaagatggtgtgtatcagccaccgtgttggctcattcctgtaatctcagcactttaggaggccgaggcaggagcatcacttgaggccagaagtttcagaccagtgtgaacaacataatgagactccgtctctacaaa

SEQ ID NO: 222731 - DNA, 685 bp, Homo sapiens
cttaaacataaataaggtaaaacgaaatttaaaaaagaatctcagatgtgtgtaaaagttcagctactagaatgctcatccctattatttatgataaaagaaattggtctaaaagatgacagtattttcaaacaagtggaaaggaaagagacacattagactttaaggaggccatgccatccagaaagatttgtttagacaaggaacatcctttgtgtgtttgactcggggccaggaacagaaactgaaaatccatagcagagaagagatactcctgaaacagatttgggggaagagagatagctaggaccacaggaaagactatcaagcaccttggtctaggagtgcaggagtttctggtataaaaatgcactgcagttccactgtgaggcttattttttggaactagcctgggaaccaaaccacctcttgcaacattgttactggagggggaaagcgcttttaatactaaagacttggaagtgaatttttagtatgcagtcaccacataaattcagttgcctacaaagctgagcctcctggaataccaactgagcaggatggacttttttggaagacactttatcccctgtgttcttcacccctacctctctttctctgccttcctctccctcctcctttttctcctcctcctttcttctctgccttcttcccttctctccat

SEQ ID NO: 222732 - DNA, 358 bp, Homo sapiens
gggaacaggcagtttaaaacttctacttctgtggaggcttgggtggcgctctgtggaaagacagtaaagtgcctttagaggcttgggtctgcattcaccctgctatgccatccctgagaacttgaagctgaaattcttcattttatcgtggaaatttgtagctgtacagaaaagtaggagtagaataagaagctcccatatagccctcaccagtttttaataacgatcaacactttgcatttaaactttttgattatgcagcctagtagtaaaaagagttttatatccccaatttgggtatgttctttgttttttaaattatgtacatataacactgtattgttaatattaagtatac

SEQ ID NO: 222733 - DNA, 315 bp, Homo sapiens
cgctacggcctgggcaacgagcgaaacgctgtctctgggaaaaaaaaaaaaaaaaaaaaaaaaagattagtcaggcatggcatggtggtgcaccagtttccagttactcagaaggctaaggtgactgggttgcttgaagctaggaggttgagggtacaatgagctatgatcacgtcaccacactccagcctgggcaatgagtgagaccctgtctcttaaaaatcaaaaagcgaaatgacagcttttgccttttaattgttatgttagatcatttactttcccttctgcttgctcttccccttctgtcgtcttctc

SEQ ID NO: 222734 - DNA, 207 bp, Homo sapiens
cattcattcactcactcattcactcattcattcattgctgtatagatccactgcctgagacaaaacctattcactaacatagttagccattagtggtaacaaccactcatttgttcctttacccagtcactctccctttaaggaggatgacacattcatttacttattcttccatccatttcctaggatcacaccttcattcattcc

SEQ ID NO: 222735 - DNA, 471 bp, Homo sapiens
tacaggcgaacgccaccacacctggctaatttgtttttgtgtttttagtagagacgggggtttcaccgtgttagccaggatggtctcgatctcctgacgtcatgatccacctgcctcggcctcccaaagtgctgggattacaggcgtaagccaccatgcctggccaagtgaacttttttttattggatgaattgagccctccatgccaagcctgtccatagtgaccagcaggacgtcatctttgccgcaaggagcgcctggcatttggaaaagatgtgacataatcagataattacaagacgccactaaaagtgcagtaacaacgcataagctaagtgctgtgggagcccagtgagcaagtgccagctcttcccgggtcatttgggtttcccaagccactggtatttgaaaggagaactggtgagtaggtgttgccagaggagaagagatattcttaggcaaaatgttgtg

SEQ ID NO: 222736 - DNA, 627 bp, Homo sapiens
gtcaagagctcctggactacaagtgttgggtgaagtagtttattcttcactgtacatttccagactaacaggcttctcataaatgggccctggtggaatagtcattgccacatggattttgttgttctctcctgtttaaccccgtgataacccttagagggagaaatcaccactgacatttcggaacaagaaaacggaggttcagaaatagaaactaactgttcctgtgtgacacaagtagagaagctacagaagaccagtgtggcagacaccctctaacacctgtgtacctaatcttggaatctgaacatgaaaaggacccagttcacagttggaggaggctcatgtccccgacagtagcctcctacacagccaagccttgtccattccattgtctcagccctacctgcagttgcagaaggcaatgtgtctttctcctaaatgtagggtaaagactctgaactgtctgtactcacagttgtccttcttgagaaaatataatccataatttaagaataattattcattgagcagttaaagacatgtcatgggttgcttttcagaatcttttttaaaaattcattttgtttttttgactctaaggaatatcctgggctcagaattaaa

SEQ ID NO: 222737 - DNA, 561 bp, Homo sapiens
agttttagattactgtgagctatgatcgcaccactgcactgtggcctgggcgaaagagtgagaccctgtctctaaaaaaataaataaataagaaaagaaaatcaagcctttggtgactctcactccaaatctctttctaagacaggctgctcttcagcctgctgactccagcctccagcacagttcaggtgagctaagtgcatacagcctaggagctttcttaccaacttgcaaaacttacttgcctctatgaggcaagtgatcatgtggtctccgttttacagagggagctcagattaaaggtgcttctctgtggtcattaaaggggtgtccagggcttgtgaatcccaatctctaagtcttttcctattttgagtatttgtacatatatgccctttgtgtgtgtacgcacacacgcaggcacgtggggtgttacccaagagttcgtgctgtgcacgtgtgtgcacaggtgtataagtctggagctatgctcttgggctgtgtttagaatgggctgaaggcgttatatggattttttgaaacttggggcaatggaggtaa

SEQ ID NO: 222738 - DNA, 288 bp, Homo sapiens
atgtcaagtatcttctctgaccaaaatggagtaaaactagaaattaacaagtggaactttggaaactgaacaaatatattgaaattaaacaacatgcttctgagtgacccctgggtcaaaggcaaaattaaggagaaaataaaaaaatttcttaaatgaaaattgatacataataccagaacctatggaatatagcaaaagtattgtgaatagagaagtttatagcaataaatgcctacatcagaaaagaaagatttcaaataaattatgtaaaaatggacttcaagg

SEQ ID NO: 222739 - DNA, 549 bp, Homo sapiens
cagtacactgacccctagaggcaagggctggtgtcagccccacctgaaccatgttggttcaggaagtcaggtaggcttagcgccccaaggaaaatctgaggtctcttactggaaaagtgggtaaatggatgctgggttatcaaaacagtggatgacttctcttttactcctaattctctgtatttgctgaaaatacttatggagaagactatatattttagaaggtcatgcctttagattcaaaaaagggaaatgacgaatactagcacagtgtctattgctggatacttgcataataactagagcgtatattataaaagttgctgtgtcttgctgtgtctcccaggctggagtgcagtggcacaattatggctcactgcacccttgacctcctgggctcaagagaccctcctgccaactacttgggaggctgaggcagaagaatcacttgaacccgggaggcggaggttgcagtgagctgagatcatgctactgcactccagcctgggtgacagagagagagtctgtctcaaaaaaacaaaaaacaaa

SEQ ID NO: 222740 - DNA, 516 bp, Homo sapiens
aaatgttctttcaaccatcgggggaagctgatttagtttaagtttaccttatccgaagcatgtagttagggttaggtgttgcgggaattgttgagttacttgagaaaccaggtattcaaagttcacagttacaatggaatgttattttagtcatacctctaatatcaagtgagataatatgcaaaactgcgtttgtatatcctccactctttttaagataaacttttatgataataaaaattaccaattagataaatcaattaatatttttccctctgaaatatgacaaacatacaggaaaggacagaaaacatatatgtagagattaatgaataatgataaaagttaagtaaagatagatattaccacaccccagagtgtttcctgcattgatcctccttattacaatgcttcctcctagaattaatcattcttctgattttcttgcttcttatgcacatattcttagtagcttttttgcttattttaattatatttgtgtgaatagaatgaaac

SEQ ID NO: 222741 - DNA, 542 bp, Homo sapiens
ggaccaggggccccatgggtgtttggaatccctgatctgggtcaggcactggcagcaggattccagcctggcctggactctggtgtgtcccgtttgaagaaaccccgccctgtgaaagttcaagtttagcatccaatgacccatttaagaggtttgctgagccacgtcacaggagggtctgggtgcaaacggaggtggcaacacacagagcgagccttgagcacccaggttacccccaggacctccagtctggctggggggctcctgctgtcctgtggagcagccccctgggatcagggacggggctgagctggagagtgtgcaggattgattaatgatgtctgccacggtcaggccaactgctgtgtttctggggcccacaagctaaaaatggttggaaaaaaatcaaaacattaatatttgtgacatatgagaatgctatgaaagtcaactttgctatccataaatatttgtgacatatgagaatgctatgaaagtcaactttgctatccataaataaagttttattgacataaaaaaaa

SEQ ID NO: 222742 - DNA, 617 bp, Homo sapiens
gacctcccctccccaccgccgcccctgcggtgagatcctgcctgccggggcgcaggggcccgcggttgggctccgggagacggaagaggccccacagctcgggccccacgcagtggacgctgccacttaattttggcgtaattgatgtcaaggcgggtgcccgggcccccagtgaaatgcctcatgaactcgctgcgaggaacggcgctccacgcggtgcacggtggccaatcagagctgccgcttctgatggaggctgagccggctggggaggcgtcttggccaagaaccagccccagcctcgctcagggccccaacccgcagaccatgtaattaagctgcgttctgcagccagggcaagagtctcagctctgaacatcttcccgcacctctgaggagccaggcctggaaaccctctaaaatagatttttctgcctcaagacagaagatgggcgttccaggcagagaagagctgcccagtcacgtgctctgctccacctggtcagagacccttgacctttagaagactggacctgagggcgtggctggtggacctgagggcgtggatggtggacctggccacccagctgtagctttttgggttcctgtggtcccat

SEQ ID NO: 222743 - DNA, 839 bp, Homo sapiens
gatgtccctgcccctccgttccctccagagtctcagctctgaacatcttcccgcacctctgaggagccaggcctggaaaccctctaaaatagatttttctgcctcaagacagaagatgggcgttccaggcagagaagagctgcccagtcacgtgctctgctccacctggtcagagacccttgacctttagaagactggacctgagggcgtggctggtggacctgagggcgtggatggtggacctggccacccagctgtagctttttgggttcctgtggtcccatttcttgggtcaatctcacacctggcagctcccaggaagacacccccaggcccctcacactcctgggggcagctggaattggcttcagggcgggaccaggggccccatgggtgtttggaatccctgatctgggtcaggcactggcagcaggattccagcctggcctggactctggtgtgtcccgtttgaagaaaccccgccctgtgaaagttcaagtttagcatccaatgacccatttaagaggtttgctgagccacgtcacaggagggtctgggtgcaaacggaggtggcaacacacagagcgagccttgagcacccaggttacccccaggacctccagtctggctggggggctcctgctgtcctgtggagcagccccctgggatcagggacggggctgagctggagagtgtgcaggattgattaatgatgtctgccacggtcaggccaactgctgtgtttctggggcccacaagctaaaaatggttggaaaaaaatcaaaacattaatatttgtgacatatgagaatgctatgaaagtcaactttgctatccat

SEQ ID NO: 222744 - DNA, 275 bp, Homo sapiens
ttttcagccaggacatctgtcttctgctcttggacatcagtgctcctgattcccaggccttaggacttgagtcaggacttttatcattggccctccattcagttcttggattgcaagtataccagcagcttttctaagcctctagcttgcagacaacagaccatgtgacttctcagcctccagaagaatgtgagccaatccctcattaaaaaatctttttgtatatatcgctctatatatgtcctaacaattctgtttctctggagaaccgtagc

SEQ ID NO: 222745 - DNA, 235 bp, Homo sapiens
tgttattaactttttactgaaaaatcaaacatagagtagaaggatttccactttctagacgtactgttaacgttttgtcatattgcttcatctagacacacttttaaaaatctctagcagataaggacttttttctccaaacattcaatatcattattacacataacaaatttaacatgtaattccataatcctatttcatagccagtttatgtatcatttcccccagttatctc

SEQ ID NO: 222746 - DNA, 444 bp, Homo sapiens
aaaggcctcaggaaacagttttcactcacagggagaattactgcttcccatgaaagcattttccagtgagtggaggtgggtttaggtgttatctgtgcggcagaggtaccatctcccatgtctagaaaggaaaaagagaagatgaaggccttgcccacatccaatccaaaggggagagacatcctggcgagctcagcacataagagaacgagagattagctgtccctgcatcagagcgccaggaaggctgtcccctctgatcactggctggagcctgcatcacagtcacccgtgtttgcactggaagccatgggcaacgcaacagattgtgaggaaaccctgcagatggctccgttaataaagctgccgttcaccatgccaaagctgaagtggtttctatgggaaactctcacaataaaatagaaggaagtttttttaatcaaa

SEQ ID NO: 222747 - DNA, 376 bp, Homo sapiens
catcctccctcctctacccatgggctcatttgaaggtgtgttacctctgtgttttgctctagctgtgccctgacttggctcctcttccttcctttctgcttatggaaatctttttggaactcccctgctctgctgctccgtcccccacactgtccttttatgtttcgtgtgtctgaacttgtctctcttctaggctgttagctctttaagagtcaggattgccagctgggtccagctgttatttgagcaaatcctccttgtttccgggcgtcagtttcctcttctgtatagtaaagtgttgttaaatcagttgttctccacactacccttcagtggtttcttttttttttttttctttgagaccctggtctcactc

SEQ ID NO: 222748 - DNA, 440 bp, Homo sapiens
gtcaacataaatattttctttttctgctatagcatcttgtataatctgtttgtggccaatattattgataggcttcctttcattgtattttagattcatttcactactagcagtgtttgaggaacagataacattttactatttttcattcataatctttggttaagattaatactgccaagttaggtagaacatgaaaattacaggtgaaagataatgctattcttatatatggagtttttgctatttgagggaatgagatgaatatgttttctgccctcgttgagcttatgttctaacctggaaagagaaacagaataactctaatgatacatgatgtattaatgaaatgtagggaaggtatgcattggcagtacctaacattagcctggcactatgcttagacaccttgtttcatctttcacaactctgaattatag

SEQ ID NO: 222749 - DNA, 433 bp, Homo sapiens
aacagatagaggctcccatgtaagtcagtagggacttcgtgtttgttatctatctgttgtttctatggataataaagtatgaccatcggtatactaactttccgttcatctttacttcccttctgttttttaaatcagtgacttctagtttccaagggagagttttactctgtcaactttatagttaattgtgcagcttctattgaatagctgttatgtttaaggtgcttgatgaatcacattttttacatatttgagagacagcaaacagcatattgcacatgtagttccagtggaagaaacagtggagttagaggtttatcagtggccagatttttaacagaagtaaccatagaaagggaacaaatggaggccaggtgtagtggctcacacctgtaatcccagcactttgggaggccgaggcaggtggatc

SEQ ID NO: 222750 - DNA, 310 bp, Homo sapiens
taaacactagaagcatatgctatgtcagtcaggtttccaccagataaataggactcaaaatggatcacagacctaaatgtaaaagacaaaattataaaactcctagaagataacaggagaaaatctagatgaccttgggtttggcaccctgttgttttgactttacaaattgttactaaaaacatctgggggtgagctccatttgcactggccttgtgggcagttgtttcccttttgaaggtgccccacttgacctctgagtggctagtggggacaaggagtgatagcaggaaggaatgcagcaaccaag

SEQ ID NO: 222751 - DNA, 435 bp, Homo sapiens
ccaaccaaccaaacaagaaaacctgagggctgtgaaagcctatgccacccacaagctttggatttagatctagactagatgagagtgggtggtccaatttcaatagcctccaaagtgactgtaagtttgaagtttagtatgaaatttggagtcaaaagaagtgaagctgattcacttctaccagttaacagctatgtgatcttggccaaatcacttagtccttctgagattcaatttccatctataaaatgggcatatactacctcctttctgggatttaactaaagaaaggtttgtcaggtttaactaaaagatgtgtgtaaaaatacctgttatccagtacagggaatgcaatgaatcttccctccttttccccttcgtgggttttattgttaaactcttaatataaataaatatatttcctgtaaaaccaaa

SEQ ID NO: 222752 - DNA, 316 bp, Homo sapiens
gataccctaagcaacatctgctgaagtaaactaaaaatatggagatatattttactcacacacacacacaaatatcacatatacataatacatactcacaaacatgcatacacatatccaatctgtaaagttttttccccaaaatatacattttgaatgcatccatgagcggactgaaagttaagggtactcagaaagcagtaaatggaccattaaagctggctgttgtagaatgtgatgaaccaggcttcagattctatcttgtagggtacgcaggataaaaagtagactaataggtttaaaaaaaaaaaaaaaa

SEQ ID NO: 222753 - DNA, 626 bp, Homo sapiens
actactgagctgctagtctcagcacgctgcctacagggtggccctgctctgcaggagaagtgacagagctataacccagcctaggctataacactgctgtttcaataaagctcttttcttctaccactggcttgcccttggattctttcctgggcgaagcaaagaacccaccagggctgagctccagtctggggctggcctgccctgcatcaaggttaacatatgaaatagagtgctaaaatatatagtcttaattgtactagactgagttcatttattgctctatcatttaaaattcctggcatagaatatgtgctcaaatataaatggttgagaaatgatttggtatctttgtaagaaagtgtctctttcacatccgatgcattctttcaaaactacacgtttttggtaaatttatttaacaaattcatgtaataaatattaagtgcctacaatgtgacaagcatataagcactgaaaatagggcaataaatttaaagacaacaagctggacatggtggctcatgcctgtaattccagcagtttgggaggccaaggcaggtggatcacctgaggtcaggagttctaggccagcctgaccaacatggtgaaactccgtctctact

SEQ ID NO: 222754 - DNA, 165 bp, Homo sapiens
gacgctgggccaggcatagccaggtgtcacccacatgtgggctggggctggctcactacagctagcaagagccatagttttaggaattttgcaagcaggatgttaaagccagccattattaaataatgtaggatcaaacagtgtttcaatccctacatctatctg

SEQ ID NO: 222755 - DNA, 185 bp, Homo sapiens
ggaatgaactaagtagacagattagcaggagaaaaaggcatacaaaatttgcttaacgtgcatagggaaaaatcacagaagagtgattactcaataactcaattaaggtccagatgcttgtatacccttctcctcctatccctcaaccccgacatcattaacgggccttcctcttaaaaaaaaaa

SEQ ID NO: 222756 - DNA, 521 bp, Homo sapiens
cagtattttgttatggtagccagagcactgagtacacataacagagaggaattaaagttgcagatggaaattaaggttgctaatcagctgacattgagatgtggagaggagcttggattatctaggtgggtccaatgtaatccttaaaagtggaagaaggcaaaggtaatgaagtcctattgacaccttggttgtaacctagtgagaactgtattgaatctttaacctaaaacactgtaagataatcaattcacattattttaaacaactacatttttggtaatttattacaatatcaagagaaaatcagtataaacatgttagggcatattttctgtttaataacactttaatgaatattttggatatacacacatacttgggattcatttcctccagaaagaaacattgatatagggaacaataaaatgacaaattttattctatctgtagcccctataagttgccactatgagaacactgagtaaatggaataaaaaagagcacaaatttgccctttc

SEQ ID NO: 222757 - DNA, 526 bp, Homo sapiens
ttcatgttgcactcagatggtaacttctcaatgagctcttccctgggacttgatgtgaaaaagtaaatttaaaaaattaaaaaacaccccacttatacccccaatgcttagtacatagtaggtactcagtaaatattaattcaatgagagaaagacagttgtttgtgttcctattagctgtgacattcacagcacagaagtaagaatctcttttatgatatctctagcttcttatggggagaataagacaacctgtttaaatcggaagactgcatatccgaactggagtgagatctcagtgtgattttggactcaggtgctccacggtctttggatcaacagcaacaacaaaaatggaggcacccatctggacttgccaagtctttattttaacaagtcaggatgacaagaaaatgtacaaaacctataaccaccatctcaatctgcataatttatgaaggaaacacttgaattctagaaaagtaggaaagacataattttagaataaaaaactctttttcaaatg

SEQ ID NO: 222758 - DNA, 673 bp, Homo sapiens
ttgatatttgatatatgagagaggagccaatcacagtccttctctagaatttttcaaactggaattgataagattttttccctcctccatagtagcatctatgaattatgaaacttgaatactgtcagtgccacatagaagaaactgttctacagagtttgttagcatgtttatgtgtacgtgccatgtaacaggaagaatacgaaagagtaaaactgagggataagaaaaaaataggagagagagaaagtgagtcatggctaccggctaggccttggtttggttgtttctgtatccctaagtatctcgttctagcactgtggttattcacacttcttccaaatacacgacatctttcaaatactttgccctgtttgcctaaaggtgcttaagttgggtttctgatatttgccactagaaaattcctaacaaacacttttaaacttcatcacactgaaattacttatgtaatttcaattatgaaattatgtattatggctgtaattataattactgttctattatcttattgtgataggcagaattttaagatggcccccaagagaccccagggtggcactgtacttataatcccagctactcaggaggctgagggaggaggattgcttaagcccaggagttcgagaccagcctgggcaacatagcaagaccc

SEQ ID NO: 222759 - DNA, 745 bp, Homo sapiens
ctgacgactataaagtcaggtctctttcctcttctgttcatgtaattgattgcaggaatttatgtgttaaaatttctaccttttagcttttagttaaacattcctgttttttgagaatatttgaatccttatgctattgtctttctctgtaacatacctcacacaaatttgttaaataaccgttgtatgcttttataaaaatcactgaagaaggctgggagcagtggctcacacatgtagtcccagcagtttgggaggccaaggcaggagaatcacttgaggccaggagctggagaccagactgagcaacatagtaagagccccttgctatgaaaaaaaaaaaaaattagctgtgcatggtggcaggtgtctgtagtcccagctactcaagaggctaaggtggtatgatggcttgagctcaggagttcaaggctgcagtgaggtgtaagattgtgccactgtcctgcaggctctgtgacagagcgagactccatctcttaaagaaaaaacaggccgaggcgggtggatcacaaggtcaggagatcgagaccatcctggccaacatggtgaaaccccgtctctactaaaaatacaaaaatttgctggacgtggtggtgcgtgcctgtaatcccagctactcaggaggctgaggcaggagaatcacttgaaccagggagtcggaggttgcagtgagccgagattgcgccactgcactccagcctggcgacagagcaagactccatca

SEQ ID NO: 222760 - DNA, 683 bp, Homo sapiens
attctagaggccgaggcgggcggattacctgaggtcaggaggttcaagaccagcctggccaacatggcgaaaccctgtctctactaaaaatacaaaaaaattagccaggcatggtggcgcctgcctgtggtcccagctactcaggaggctgaggcaggagaatcgcttgaacccaggaggcagaggtcgccatgagccaagatcacaccattggcgacaagagcaagactccatctcaacaacaacaaaaaaatcccatttctaatgaataacttacaagttttactattatattcttattttactagtgatttctctttattttcatagttatttaaatatatatatttccatattggcagaatggaactccacagataatatgaaattctatccttcatcaaatgtttcactatcttgttctaaacctttccttatgcttcttcaattaaacagttttggcaatgtttttatcttacttacccttctttgtccttactcccatccccaactcttacatgttaattatttagaatttaattccaggatgttattaaatgctcctcctgtaacatatttgctgactattcccatttttttccaaattaatactgccctcatacattattactcatctagaactaactatttacaagaatcattgctcaccactatttttatga

SEQ ID NO: 222761 - DNA, 147 bp, Homo sapiens
gcagggcgattttgcttttaaaataaccatgttcacctttaactgcaaacggctgtgacgagagttgtatttaattttaaattgcccatgtccagtaaccctctgtacctctttaaataataaaatgtttttaatcttcctgcagct

SEQ ID NO: 222762 - DNA, 507 bp, Homo sapiens
ttatcagcgctctcattacatacatgtacgctaacgaccttatttgcgtcagctgacatcgctccccctgttttaaattgttattcccaaaatcaaggcttgtgggtccttcccatccccagctccttccttcccagcccactgcaggccagcttccttttccagcacctcccacgtggccaaatccgatggtccccacctcgctcaatctctcagaaacatccagtccactgaccgctgcctccctctgggaaggctttctgctgtagacgtctcggaccctacactctcccggttttcctcctgcctcacgggacaatgctcctctgaatgtgggagggcccctcttggtcctgactgcctccccttccccacactctcgctagccccatggcttcaacgtggtgtctgctgaatctacgtctagagccctggtcactcgctagagcttggatttttatcaaactacctcctgagcacctcaaacttaacatggccaaaataaaa

SEQ ID NO: 222763 - DNA, 531 bp, Homo sapiens
attatcacactcaagataaaaatcagtgactaactttgatcaggatgctagggactttactggttcaaataaaaatttggcctagcttataagagtttgcagattatttaataatccactcccaaagtggacatcaattagataagtggtccccaaccttttccaaaccagggatcagttttagggaagactatttttccacagaccaggagggtgtgatgggggatggtttcgggatgaaactgttccacctctgatcatcaggcattagactctcgtaaggagcccgcaacctagatccctcgtgtgcgcagttcacaacagggtttgtgctcccgtgagaatcaaatgccactgctgatccgacagaaggcggagctcaggccgctaatgctgggctgctactgatctcccactgtgccatccaggcagtggacctataccgttccacggcccagggggttggggacacctgaattagatatctaaatatagtgaatttgcatcatatgtatatttatctgagggaaa

SEQ ID NO: 222764 - DNA, 791 bp, Homo sapiens
agatggagttttgcttttgttgcccaggctggagtgcaatggtgtgatcttggctcattgcaccctccgccttctgggttcaggtgattctcctgcctcagcctcttgggtagctgggattgcaggtgccccccaccacacctggctaatttttatatttttagtagagatgggatttcaccacgttggtcaggctggtctcgagctcctgacctcaggtgatccgcctgccttggcctcccaaatcatgctgggattacaggcatgagctgctgtacagggcctaatagcttactttctaactttcctgacatctaccatgcaaattgtagccatacaggctgctctgtaagctgattggcccctgatgactcagtctttgtgctcatagttaggtttttcttctccccttcaccttagttttctcatactcagattccacagaacaagtgagcacaggaaccctgtgacgatagagtcctgcttgacgttgaactcctttttcccagggcagactgatacttcccctcttgggctgaggtgttgtgcagtgtccacgttgaggttcaggtcctgtccctcaccagaatagtatcttctgtatagacttggtcagactttctccacattctgtgtcaggttattgtcaaataagggatttctccatttccgtagccaatacttaccaatcctgattgcgtattgaaatttcttggggagcttacccaaaaaattactgatgtctgggctccaggccagttaaattctctaggcattgatgtaaaagaaaa

SEQ ID NO: 222765 - DNA, 333 bp, Homo sapiens
tggtttttggggatagttaagcccaggccttaagacagtttgatattcagttttgttatttaggtctgggttagggataccgccagagagcatccaaacatttctgtggttgggaaggctagttatctgtgagcattccagatgaaatagcctataatgggttatcaccttttgatcttacctcagagaagattgaattggatctacctatctgatttagcagaattaaactggatttggatggaagggtaatcagctatttaatttgccagttgttagttagcatttcttcttgctgtatctcaaggatttactttgaatattctgtatttt

SEQ ID NO: 222766 - DNA, 444 bp, Homo sapiens
tttttttttaaatcataaaggcggctggggatggtgcctcatgcctgtagtcccaagccctttgggaggccgaggtgggcggatcactttgacgtcaggagttcgagaccagcctggccggcatggtgaagcccccgtctctgctggaaatacaaagattagccaggcgtggtggcacgtgcctgtggttccagcctctggaatagttgggattacaggcatgccccaccatgcttggctaattttttgtatttttagtagagatggggtttcgccatgttgtctgggctggtctcaaactcctgagctcaggcaaagtaatcccaaaggatttcaggcatgagccaccaagcccagccaaattttaaattttatttaatatttaattttatttgattttaactaatttaacattttaaaagaatgctcccttcatttattgac

SEQ ID NO: 222767 - DNA, 348 bp, Homo sapiens
ggcagagtctctttgtgtcatccaggctgagtacagtggcgcaatctcggctcactacaacctccacctctcgggctcaagcgattctccttcctcagcctctggaatagttgggattacaggcatgccccaccatgcttggctaattttttgtatttttagtagagatggggtttcgccatgttgtctgggctggtctcaaactcctgagctcaggcaaagtaatcccaaaggatttcaggcatgagccaccaagcccagccaaattttaaattttatttaatatttaattttatttgattttaactaatttaacattttaaaagaatgctcccttcatttattgac

SEQ ID NO: 222768 - DNA, 395 bp, Homo sapiens
ggtaaacaatgctatggtttaattatgttcaacttacaggcttataactactagacaaccaatggggaattcatagtttgccatagagaatgcctttgggacacataacctgtttggaatgaaaaagccctggagagtattgtaaaataacaaatgtcaggtttgatggaatgactatgcatgcaattaagtgattttctttagtgctagagttcttttttcttaggtaaatcattttaaaaaatggaccagactttgtgaaagtagatatgttacataaaataatgttagctaaagatgaatggaataggttaagagtgtcttcttgaaaatttgaactatatctctttcaaaaagaattttattacctctaggctggacttgactgaaaagtt

SEQ ID NO: 222769 - DNA, 458 bp, Homo sapiens
ttatttttgattcattccttttgtacacatttatacttatcttgatgaagcagtgtcctcatggttgtgtaaaggcagtgtgacattgtggttaggacactggttcaggagccagactgtctgggttcagatcccagcctcttatttcatgtgtgaccatgagcaagttttgtcatctgtagaatggaaacaggagtcagggctcatattcagtcagtagacacgagtacaataggaaataattatgtgctgattggtagaatagccttgacctggcccctgaggtgtccctgtgctgggccctctgggtctctgcagctctagagaataaagagggagtgcctggcacagcaaggcgcatctgttccagttgcacagtggggtgcggtgctcggattttgaacatcacccccagtgatggcacctgcttcttaggatggtcctcaggattgaatgaa

SEQ ID NO: 222770 - DNA, 347 bp, Homo sapiens
tccttaatgccatctttctctctgaagacaatggtttcattttttaacaatatcctgtgggggaagcctgacccagagaactgtttaagatacccatattctccatcctgaggcaggaaaagaattctgaaaaggctgtagggattggaactctcagactgtgggacagaaaaattagcacagtaacttccttctccacttttgtgggttaacccaaaactgttatctgaactacaaattccttaagattagggattgtatcttttttgtttttgtatctctagtacccagtttaatgcctcagtaagtgatgaataaacaaatgaatgcatacatgcacaaacaaa

SEQ ID NO: 222771 - DNA, 388 bp, Homo sapiens
gcattagcaatggcccattcccaaaaaacattatccaaaaattcagggtgtatgtattgatttatatctaggtcatagcaatggtttcttttctctttttctctttttttttttttttttgagatggagtctcactctgtcacccaggctggagtgcagtggcacgatctcagctcactgcaacttccgcctcttgagtataagtgactctcctgcctcagcctcctgagtagcgtgtgccaccatgccttgctaattttttttttttttttttttttttgtatttttagtagagatggggttttaccatgttgctcaggctgatctcgaactccttacctcaagtggtctgcccacctcggcctcccaaagtgctgggattacaggt

SEQ ID NO: 222772 - DNA, 346 bp, Homo sapiens
gttactgcaatcaggagctctgggagtccactggacttctctaacttgactttagagaactccatctagcctctctgtctcagtgtccttatctgaaaaacaagggggtgggctggatggattctgagggccctcagacctctaagattgtgtatatgctcttagggagttagcatgctaacgggctgttgctaccaaggtaagttttggcatttttttcctggtggtttctgtgtacacagtgagacacagagtgtgtattggtacagggatgatagcaacctttgtccttctacaggaaataatgccctgtgactctgactcaagacctagtctcttgttaatt

SEQ ID NO: 222773 - DNA, 504 bp, Homo sapiens
tgttttgaatagcttaattatggaaggcctcagagatgacattaaacccaaaacctgaaaggtgagaaagagccagttacagaagatctgaggaaaattctatactgggagaaaaataactgtaaagacctcaaggtaaataaacttggaatgttccgttcaagaaactgcagaggcaagttgggttgcaaacaattagggagagtgggacagggtgaggtttgagaagcagggaacatcataaactttgtagaccatagtagtttggtttttattctaaatacaataatagctaatattttgagcacttactgtgttatttgggatttgaatccagatgctctggttgaagagcccattccctaagtgtcatgctatactgactctaagcaaaactttgccattgcttcatatgtgttcatgccctgtcagggcatagaaagcaatctatgtcctgacaatcacggaagtgtattccagatacaatagaaatgtactctgaga

SEQ ID NO: 222774 - DNA, 490 bp, Homo sapiens
ccatagcagcatctgagtagatgtcagaaaaagcattttacaaagttcattctttcatattaaaaactcagcaagttaggcatagaaggaatgtatctcaacacaaaaaaagatcacatatgataagcccacagctaacattatatacaacagtgaaaagttgaaagctttttctctaagatcacaaaccagacacactcaccacttctattcaacaaagtactagaagtcctagccagagcaattagacaagcaaaagaaataaaaggcatgcacatggacagaaagaagtaatattgtctctgttgtcaggtagcatgatcttatatatagaaaaccccaaagaccaccagaaaactgttagtactggtaaatgaattcagtaaagtcacaggatacaaaattaacatgcaaaaattagtcacattttacatactaacaatgaattcttttaacaagaaataagaataacatttacaatagctttaaa

SEQ ID NO: 222775 - DNA, 460 bp, Homo sapiens
actttgagtaatgtgtgtgtgtgctgattacatgtctgccttgaaatgcaggtcctgagcaaccaccacagattgtgaatttataaattaacctcttactgtccaatttcccttcttacacttgtcagtgaaaatgaagaaaaatatcctaactataaattttttcaccctatttttaagtaatagccatgattgtaagtgaggctgtgtggttccttgaactttgaactgaagtctgttctgatctagccaggtattttctaaggccttctatttttattcagttgaaaccagtcccaaagggttagataaaatatatcacactgttttttgaagttttcttctgaatgttgtggcagaaacacacactcaggttcttgtctcttccatattcccactcctgtagtagcattttctctgtactaggatggaaaatttgctaaaatataaagaattgcta

SEQ ID NO: 222776 - DNA, 501 bp, Homo sapiens
tatttcacctagaaaatagaactagatatagtcccatatgcattgagttgttaagagaattagatcagaaaaggtagaaggtgtttagcacaatgactttcatgtagtaaaggctcaacaaaagttacgtattttaaattccttaactccacccccaccatttgccccattctggcatgcatttttattgcaggtcattttaatgacctagagtcattcattgatccttcatacatttgtttttgttgttttttctttgatatgattcattttttcttttttcgttttagcaaaacccaagtatcaagttctgcactcagtactgagataattgcactacacagagatgagtgcaatatggaagctaaacacaggatgctttgaagaaaagaagaatcccttctattttgtcctgtaccttcctgtaccgcataaccatgctcagaactcaaagaacacacagcctttctcaagattatggctggatggaaaaatttctaa

SEQ ID NO: 222777 - DNA, 531 bp, Homo sapiens
  misc_feature (437)..(437): n is a, c, g, or t
  misc_feature (446)..(446): n is a, c, g, or t
  misc_feature (473)..(473): n is a, c, g, or t
  misc_feature (493)..(493): n is a, c, g, or t
  misc_feature (516)..(516): n is a, c, g, or t
ttttttttgtttgtttgagacagagtcttgctctgttgcccaggttggagtacaatggtgtgatattggcccactgcaagctcttctcccagggttcaagtgattaacccacctcagcctcccgtgtagccgggaccacaggtgcaccccaccatacccagctaatttttatatttgtagtagagacagggtttcgccatgtcggccaggctgatctccaacccctgtcctcaagtgatccacccgcgtcaggctcccaaagtgctgggattacaggcgtgagccaccatgcccagcctattttttcctaaataaaaaatgtgacatcacatccacataaattaccaaatatccctctcatctttacatcatactgtattcccttctctgtcttttgtcgacgcgggcggaatttagtagtagtagtcgaccccggnaattccgancgggaactgaaggggaacagctttccnaagtggtcggattagagctngggtaatcaaggtcaaatggttnccgtgggaatggtat

SEQ ID NO: 222778 - DNA, 503 bp, Homo sapiens
cgcatcatttagagaataattgttaatcagcatagacattttcagttaattatgcaagagtgagagcttgggttattgtttctgtcctggcttgcacatatctgcaaaagcaatttgcagtggccatcccctgaccttcagtgtacagttttagatgggaaataaggggttttgtgttttctggttgggagattccgaataatgacttcagcctggttaagcagctacagtgtggtttgaaccacataacaggcagccaaaagcctttctggtctgtcaacagcacagattcaaaagtgagtgtggggggaagtggctgtgatggtggtgatggcagaggctgcagggggcttgcccattccattgccaggctgtcagagagcgctcataagtatgggattgttaaaggtagcagagatcaaatattttgattgatgacatttacaaagtatttatttggctgccaagtgctaatttgatattgtgacgccctcttttttaaa

SEQ ID NO: 222779 - DNA, 477 bp, Homo sapiens
cttaggagggtaccaacccaccaccctggccctgaccccagcatcttttcagaccaaacctggcaaagccagctcctccctatcccactccaaagctgtcctccactctccgttacagaaacacctgccagctcactccctgctaggattccgaagtccctccaagccctaggtcggcctgagcagcctcagccagtaggagctctcctatgggaatgaaggctgggagcatgtttagaaagcaaagtccccaagtttaggatgagcccctcacccccattcctttaaaaaagagcttccctttctgcctcctcacttccttcagcctgggagggttccactccataattggcttgtttactgccactttgagggtttctgaatggcagagatgggaggaaaattttgctggaagaaaaggagtgtgtgccttgagctttgaggctgatgagtaaaccctccaaatgcctctctaac

SEQ ID NO: 222780 - DNA, 484 bp, Homo sapiens
ggttgtatttactctggttatttttggctatatttattttcacatttgtcttctacattattgtttgattttctgcattgtgactctgcttatctctaatatactttaaaattctaacacttactttagattcttttatatatcatttaactcctttttaattttctgcttcttaaccaacttccttcgtattttagactcctaatcaggagtttttctttaatcttttatatcatagagaggaattttttagaaaaaatgtaaatatagagaaagacaaaagaaataataacacacctgcatacacaccacctaaagctcataatcatgaacattttctcatacttgttttgttggcttaaaattcaaccaacccccactttaactctggcactcccagaaacctttaccgtgcttctctctccccttttcaacagcacttatcaccgcctaaattaacatacggtttccttagaggttatat

SEQ ID NO: 222781 - DNA, 224 bp, Homo sapiens
tgtctattatgattaccttaagcaaagcaagatgcatgaataaccagcagtaaatcaggtattcaatacttgaaattgtgtaatattctgtgactgtgcatctggccaatttcaacttctccttctttttttttttttttttttttttttttttttttggaggaaatttccctttttttgccccgggggggaaacagggggccccactttggccccacgtacac

SEQ ID NO: 222782 - DNA, 124 bp, Homo sapiens
ttacaggcttaattcactttacttttcttgtataaaaaccctatgttgtagccacagctggagcctgggtccgctgtatggagactctggtgtgggtcttgaggaggtggtcagtgaattcctg

SEQ ID NO: 222783 - DNA, 255 bp, Homo sapiens
tatgggctatctggttcctctgctcagggcctcaacaagttgaaatcaaggtgtggccagggtggtgattcttatctgaggcttggagtcctctaccaaatcattcaattctttacagaatccacttccttgcagttgtagaatgaaggtccctgttttctttttcttttttttttgagagggagtctcgctctgtcacccaagctggagtgcagtggtcaatctcggctcactgcaaccttcgcctcccaggtt

SEQ ID NO: 222784 - DNA, 376 bp, Homo sapiens
gttccctgggatatgtttgatgagtttttgtggcagagaagcagagaaaggagaaaggtgatgtctatactacttcctttttctccccagccacaaatgccagagtctataaagagaccctgagaagcaagctctgtgcagagtcacttctaagaaataccaggataaaatgtaggtgagagacatttgtgtgaaaaaagggatgagagagaggaggaaggattgagaaaattttcaaggcagaaagggacctatatcttctaatttggcaaaatgggagaggtaggtaggagatgggaatgctctcttatctatctcgccttttggatggagattaataacacaacccaggagaaagtgatccttaggaagccca

SEQ ID NO: 222785 - DNA, 504 bp, Homo sapiens
ctttaattttgatttgatgcttgtataaagagcaaaataaaagtcaaattttattcttctgtatgtggatagtcagttttttctacaccatttattgaaagtaattttctttcttcattgtgtatttttagttattttatcaaaaaaatcaattgaccacagacacacggatttatttacgggttctatatccctttgtactgttttacatgtctgtttttatgccattactatgctgttttaattactatagctttgtaatagagtttggagtcgggtagtctgatgcctccagctttgttctttttgttcaagattgctttggttggtccaggtcttttgtggttccatacaaattttagcagtaatttttctatttctgtgaagaatgacattggaatttgatagtggttgcatttactctgtagattgctttgggtagcattgacacttttacaattctaatttttgaattcatcaataaaggatgtttctccacttatt

SEQ ID NO: 222786 - DNA, 334 bp, Homo sapiens
aagaaatggggggctctctggctccccaccccccatccctgcagccccaccccaccccagccctgcgccaaagggagagcagagccccctccccgaaggccacgtccctggggagacagtgagctcatgcaaggggaatgttcccaagttggagtgagtaagaggcgggccaggcggtgggggggctgccaggcgcggggctccgcgtgccctcgccctcgggtgctgtctagacagagggcagaggcgggagaagcggctccagggcctgctgaccctgacatgcccagtgcctggtgtttggtggtgtttgaggggttgggcaggcggccgc

SEQ ID NO: 222787 - DNA, 387 bp, Homo sapiens
cagaaggtattcccttggtgtctgaccagccaatagatggaagaccattttgatgttaaatcctttttttttaaccacatattatgttaatccatttatatgaaatgtccagaataggcaagtctatacagacagaaagtagatgagtagttgccagggtgttaatgggtatgaggtttccttttggggtgatgaaaatgttctaaattgattggagtgatggttgcattgtgagtgtcctaaaaaacattaaattacatatatgtaatcgtatcatttttaatcttatctttttgaggatacaatgggtgcaattgtgtgagctacgtgtgtatgatgagaatcaggtggttgtggatctttgtcccgggatcaaaagaggagaag

SEQ ID NO: 222788 - DNA, 467 bp, Homo sapiens
tatttccaaagttaaagcttacacttacagttcaaacaaaactaaatcaattaggctctatcctaatggtgtaggtcagagtccaggtgacatcaagacctaaatgcaaatgttgattgtgtggttgcccatgttcctggagtcagttactcactactagagtcatgtgtcagagacaaacatctcttggggcatcctagccattagctttgccaacagagcaggtactaaatttatccaaaggctttgtatgtgctattgcttgatacatgctaggctgcttggtcactacattttataatgttcacagtggccattagatatgcaaattttttgtgttgtatagttgagtattggtggcagagtcttgcactgtcatctgggctggagtgcaatggcatgatctcggctcactgcaacctcccgagttttcctgtctcagcctcccgaatagcctctcgaatagc

SEQ ID NO: 222789 - DNA, 252 bp, Homo sapiens
gttgctgattgcattgttattttaatcaagccttaagcaacggcataattggtggatataatttattcacttcctatacagttggtacattaatatccctaagtgcttcacttttctctctctctctctctctctatattttttctttttttggtttttgtatttttattttatatgtggagtgcttcagtttctagttagctcttacctatttgaatgttgccttgcaactttgagaagtccaaagtttgt

SEQ ID NO: 222790 - DNA, 602 bp, Homo sapiens
cattttacattcctaccaacaattgtccaggtttcctatgcctccacatcattgccaacacttgttattttttggttttcttcattatagccatcctactatgtgttaagtggtatttcattacggttttgatttgcatttctgtaatggccaatgatgttgaacatattttcatgtgcttttttggccctttgtagatctttagagaaagaaatatatatttaagtcttttgcctgttttttaatttcattgtctttattgttgagttgtaagaatttttatgtattttggatactaatccctcatcagatatatgatttgcaaatattttctctcattctatagttgtctttttatttgcttgttattttactttgatgcacgaaagttaagttttatgaagtccaatctgtttttttatttggttgaacaagttgtaattttaatgtatgtgtaaataaatttaaaaaataggactattatttctatatgttattctactccttgtttttttcacttaaacataggtcttggagatctttttatgttggtacataaggattgtccccattcattaattaataaattactgcatactata

SEQ ID NO: 222791 - DNA, 379 bp, Homo sapiens
agggtgagactctgtctcaaaaataaataaataaataggatctgatacatagtaagctatcaatagctaccatattagccaggcaccgtggctcacccttgtaatcctagcagtttggtgggctaatgcagacaggattgcttgagctctggagttcaagaccagcctgggcaacatagtgaaactaaaatagactttactaaaaataaaagtacaaaaaatctgccgggcatggtagtgggcgcctgtagtcccagctactcaggatgctgaggtgggaggatcatttaagcctgggagatccaggctgcagtgagctgtgatagcgccactgcactccagcctgggtgacagagtgagacccagtctcaaataaata

SEQ ID NO: 222792 - DNA, 387 bp, Homo sapiens
tattcttatttcaaatttcaatagtttactactggtatataggaaagcaaccgacttttgtatattgatctagcatcctgtagactcacttattggttattagagttgttttatggattctttgaagttctccatatggacatgcatattatctgtgaaaaaagatgtcttatttcttcttttctgatctgtataagttttgttttgttttcttgcactagctagggctcccagtaggatgttgaacagagtggtaagagaggacagtcttaccttgttttcaatatcagagggacagtgttcagtctctcaccattaagtatgatgttacctgtaggtttttttttttaatgctctttatcaagttacaaaagttttcctctattc

SEQ ID NO: 222793 - DNA, 388 bp, Homo sapiens
ctctgatgtaatgttgcccattctaacaaagtgtttgcgaaaccttaattacttgccctatttggtgagaatcaggcaacgaacagagaatcacatttaatatggatatagaaaatatttcgaccgggcccagtggctcacacctgtaattccagcactttgggaggctgaggccggggattacaaggtcaggagttcgagaccagcctggccaatatggtgaaaccccatctctactaaaaatacaagaagtagccaggtgtggtggcatgcacctgtaatcccagctattcgggaggctgaggcgggagaattgcttgaaaccggaaggcagaggttgcagtgagccaagatcacaccactgcattccaacctggaggatccgtct

SEQ ID NO: 222794 - DNA, 219 bp, Homo sapiens
gccccgcccctcccctcccccgccacccggcttggcctcagccccctcccctcccaattctggcttgggtcttggggacgaagatactaggggaaaaggcctagaggccgaagatcccagtatctttcctcctctcccgccacgcccccttcccaaggaggcggaagggggggggggggcagcaggggttggtcacctgagcccaacccgcttcagtca

SEQ ID NO: 222795 - DNA, 501 bp, Homo sapiens
cttctgggctcaagcaagtctcctgccttattctccagagtagctgggatacaagtgcatgacacttttatagtgtctttaaagtgacttagaagggtttttctttttgttttaaggttaaattgaccttgtcatttataaaagcaactatgttcatcatgaaatttagagtctagaggtggaaagaataccatcatccatgggcttatcactgagataaccactggtaacattttttttaattgcgataaaatatacataagaaaatgtaccattttaaccatttttaagtgtacagttcagtgacattaagtacactcacattgttgtgcaaccattatcactatccatctctacaagttttttaatcttcccagacttaaactctgtacctaataaacactaattcccattttctctcccttcagccatgacaagcaccatactttctgtctctgtgaatttgactactcttggtacctcttttaaatggaatcattc

SEQ ID NO: 222796 - DNA, 372 bp, Homo sapiens
tgaggccaaggaggaggtggctgctgaatatctgttacttgggagaagctgtggcagtggggattgtatttgttctgctaagcctcttgtattaaggctttcataggagttgtaactagcctttactttgaagaatcgtgacagagtagactcaatattgtagctgactagatctgagaggggcaggagatggtgtcttggctgatgccctcagcccacctttaactgcagtggacacagagctgcatctctgctgtgtgtctttgcacttcctgctccaggccttctctgacaccatggcggccccctgagcctgtgccgagattgtgccactgcactccagcctgagcaacagagctaaactccatctca

SEQ ID NO: 222797 - DNA, 511 bp, Homo sapiens
gatcatagaccatagactgccctggacttgggctgtttccagtgtggggctaccgggaacaaagctgctatgaaactttgtgtgcaagtctgtgtgtgtgtgtgtgtgtgtgtgtgtgagagagagagagagagaggacttccatttctcttgggtaagcactaggagtggacttgctcaatcagacgtgactaatgtttacttgtaccttgtacaggaaattgctgggaagtctcttgagagcagtgaccatttcccattcccgataaccgcatgtgggggtcctacaccaacccaccacaacctcaccgatgccgagcgctgttgcgcattcacactccggtcactctcgtgggtgtgccgtggcaccttcatgtggtttgaatctgcacgttcctgtaggtgaaccgtgctgagcctttcttcatgtgcttattggccaagggtgttcattcctttgtgaagaatgtgttcaaatcttttgctcattaaaaaaaattcgttgttggtc

SEQ ID NO: 222798 - DNA, 426 bp, Homo sapiens
tatgttaaggaaattaaataaccattttgtggtgtgtctaaggtgagtgaactcagattcaataggcaatgagaggttgctttttaattctgcaagtatttaataaacaagaaaaatatccacattcaagggcagtattagcatgtcagatcacaacctctgtgatttaattatacatgtcctctgttcttaaagagttgtaaagggaaataagaatcctagacaacagccagccgtccgtctgtggtactgaaaacatctacagagcaatggactctagaacccctttctcttccaagcacattttgaggagcttctgtacctcactgctgactctagggccccactccctgcccaatcttcccattccccaagagcttcctccccttccattagaccttggtgctggagccctgatcattctgt

SEQ ID NO: 222799 - DNA, 396 bp, Homo sapiens
taaaatcatgagggcctgggttacagtggcagtggtaacaggaaaggagtgaagttaagaggtttttgaagaataatttgtttatcgaaactaattgaaataaatatttgtaaagtctttaggatgtgaaccatctctaaaatgagaagttaatcatagatatttggaggatagtttttcaagcttcattgaaaagtcaggccatcagttattattggcagtatcttgatgaaatttcaaaaagccatgaaaacatcgcatgaatgattttggttttcatttgtcctgcttaatgtgcatatatttcattcagaaatactgaggtggattagggattgtggatctgtagtagtagtagtagtagaaataggaattttagatgcttaactttttttt

SEQ ID NO: 222800 - DNA, 173 bp, Homo sapiens
cataatcctcctgcatctatgatctcggaacaaatgcaatcactgctaagcagcccaccctctggcctagactcatgacctcatcctgcagagctgaggagggtgcagtaagacagactgagctgtgcagggtggctcagtatcaggagatgatgaacaaatggggatcccaa

SEQ ID NO: 222801 - DNA, 316 bp, Homo sapiens
tgggcagatcacctgaggtcaagagatcaagaccatcctggccaatacggtgaaaccccatctctactaaaaatacaaaaaaattactggaccttaaataggagttttccagaaagttaaggagataagaattgggagcagcatggatcaaggaaatggaagtataaaattaggtattttttcactgctctcactatgcttagagtccaattagattacatcttattgtggtagtggattatatcttatgacagaatgagaagaaacaatctcattcaagttagtgaaaattcagaaatggtacagacaatctggg

SEQ ID NO: 222802 - DNA, 235 bp, Homo sapiens
taaacgacaaagcaagactttgtctcaaaaaaaaaaaaaaaaaaaaaaaaaaccatgaaatacaaagttgtaactaaatgtggaagacaaactacaacgaggacacctcaagctaagggtccatgaactgtgaccaacggacaaaatccctgtgttgttataggtctgtgaatgaaaaatggtttttacattgtaaaaaaaagatgagacagaggccttatgtgacccacaaagc

SEQ ID NO: 222803 - DNA, 525 bp, Homo sapiens
gggagaggatgcagagtaggcagcgaagctgcttccccacacccgggtttgactctcccaccagcccgccgcctgggaaacgcgccctcggctggcatcggggtaccagagcccggctcctttcttcctttctttcttttttaaacggctctagcgcaaaccaggcagtgggtcagggcccagaggcgggggagggaagaggagagggctgtctccaactcggggagaagaacggccggccgcaaagtttcccggtttgtgccagtttggggatttgcgaatcagaccggagcggagggaacggcggcgccttttcagtggcggagatctcaggtgccccacgccagggtctactagagaatcgggcgaccgcaagctcagtcgcgggatcaggcgaggctcgccagctccacgaagcgtcaccggcacgtatttttctttttttaacagcctgtttctaccattcagcctctgtctcacatgctttataaaaaaaaaagaagtaataaaactcctttaaattaa

SEQ ID NO: 222804 - DNA, 645 bp, Homo sapiens
cagactcgtctcaaactcctgggctcaagtgatccaccacccttgttctccaaagtgctgggactacaggcgtgtgcctggccttgctgagtttcttaaatctatgtatttttcaccaaatttggggagtgtttagccattatgtcatcaatttttatttttgcaatcaatctttttcacctctccttcaggaatacaatggtgtgcatgacctttaatattgtcccataaattcttgatgctctgttcattttttaagtgtttttcctctatgttcttcagattggataatttcaatttacctattgcaagttcactgactcactaattcttttctctgtcactttcactttgatattgagcccattaaaatgaatttttattttagatattgtagtgtttagttctaaaattccattgggttcttcttttgtagtttctatttctctcctgagaacttcatctttccattcatttcaggagtgttcacctctagttcttatagtatagctgtaacaactgctttaaagtctttgataattccaacatctgagttgtctcaggattggcatctattggttgtcttttccattgataatagtttaaattttcctagtacttttttgagtgattttggattatagc

SEQ ID NO: 222805 - DNA, 465 bp, Homo sapiens
gagaattatcacacagttcaatttgtttttgtattgagtgcctgtagttaagtatttgcatagttcagcaacctgcagagttatttcttcccttttttggagacaaggtcttgttctgatacccaggctggagtgcaatggtgcaatcgtagctcactgcatccttgagcccctgggctcaagcaatcctctcaccctagtcttctgagtagttggggctgcaagtgtgtgctaccacacccagctgatttttaaattgtttgtaaaaataaggtcttgccatgttgtccaggctggtctcgaactcctaggctcaagtgatcctcctgcctcagtctctcaaagtgctgggattacagccgtgagccaccatgcccagtgggttattccttagtgagcaattgtttcttctgttagaacatgaatttataatttgtttttactcttggggataatatttaaaat

SEQ ID NO: 222806 - DNA, 886 bp, Homo sapiens
ttgctctgtcacccaggctggaggtcagtggcgcgtccttggctgcaacatccgcctcccgggccagcgaatgccccccaacattaatccccaccaagtccaagccagggaaaaggggattcatttagaaatccagacgtgttgaccatgtttaaaaacaaaaacaaaaacaaaacaaaaccaccacttttagagagtaaccaaatgcaatctaaaggagcggtccccagcgtttttaggcaccagggactggtttcatagaagacaatttttccacagacgggtgttagggaaatagtttcgggatgaaactgttccaccttacatcatcaggcattagagtctcataatgactgctgaaaaagcgcacaacctggatccctcgtgtgcacagttcacaatagtgtttgcgctcctatgagaatctaatgcggctgctgatctgacaggaggtggagctcaggccttaatgcttgctcacctccggctgtgcggccctaacagtacctgtccatggcctggaggtttgggacccctaatctaaaggattttttttcccgctattttcaaaagatctccaaaatccaagccatggaaaaaggaaaatccaatacctcatcttatacattgaatagaatttctcataggacgttcctttggataagggcttgcaaccctgtgaaacatttaagaactaatttggagtcttgatacagtgccaactgcagcccccaaaggtaccaaaccaataattatgatcctaaattttatgcttctcagaatccaccctggatgtttactttcatgattttgttttattttatccaagtggatacagtttatgattactctttgctattaaattttttgaggaaacttaaaaagg

SEQ ID NO: 222807 - DNA, 290 bp, Homo sapiens
atctgaggatccccgaacatgtcgatgctatacaggctcttttttgtttccatatgaattttaaagtagttttttctaattctgtgaagaatgccaatggtagtttgatgggaatagcattaaatctattaattactttgggcagccaggagtggtggctcacatctataatcccagcactctggaaggccgaggcaggcggatcacgaggtcaggacatcgagaccatcctggctaacacggcgaaaccctgtgtctactaaaaatacaaaaaattagctgggcatggt

SEQ ID NO: 222808 - DNA, 611 bp, Homo sapiens
ctgaatgtaaatggtctcaattctccaattaaaaggcatagaatggctgaatggttaaagaaacaagacccaactgtaggctgctctcaagaaattcacttcacctataaagacacactcatactaaaagggtggaaaaaggtattctatacaactagaaaccaaagaagagcaagagtggctatactcatggcagataaattagactacaaatcaaagactgtaaaaaatgacaaaaaggggtctatatataatgataatgggtgaatttactatataatgatacaggggtcaattcagcaagaggatataacagttacaagtatctatgtacccaacaccagagctcccaagtatagaaagcaaagattaatagatctaaaacagaaatagactgtaatgcaataatagtagggtacttcagcaccccactctcagtaatggacagattacccagacagaaagtcaacaaagaagcatcagagttaaactacacactagaccagtggtccccaacctttttggcaccagagactggtttttgtggaagacattttttcccagaactggggatttgggggacagtttcaggatgaaattgttccacctca

SEQ ID NO: 222809 - DNA, 560 bp, Homo sapiens
acacaggagaccatggagctggaggggaaggggcagaaccaggcaattcatgtggtcttggatgctgccaggctcaggattcacaggggggtccttgccctctaccttgctgtcctccttgcagggatgcatggcctgtccacctggcgaccagtcatggccatgctgtgagtgagaacaagcaggaattcagctgaggacaatcttgggcagggcagtggggaccttgctggttggtggggagtgaggtctgtctcagtctgtttgtgttgcgataaaagtctgtttgtgttatctgaggtggctaatttataaagaagaagtttatttggctcacagttctgtaagcggtagcagcagcatagtgcttcttgtgcaggagagagagagacagtgtgagaaagagagagaaaggggaagggtaggagggagagagagagagagaaacagagaggacagagaggagaaagggagaatagagacacagagaggagaggcggggagggaggtgccaggcacattttaacactcaatcttacggtgggaaactctctcattac

SEQ ID NO: 222810 - DNA, 349 bp, Homo sapiens
caggggaccccactcctaggtgcccccagacacgcagagccggcccatattatcacaggggaccccactcctaggtgcccccagacacgcagagccggcccaggttatcacaggggaccccactcctaggtgcgcccagacacccagatcctggctggcattcccactgggctttagtggccgccatccttccgtgcacgcgctgtgctcaaatttcacccagactcggcctcgccctgttgacccgcgggacgtcaccggtgtttactgaccgtgtgggtgtgctctgggctcctttcctgttctcgtttttatcctggtgcacgcacatgtgtgcattttcttacca

SEQ ID NO: 222811 - DNA, 380 bp, Homo sapiens
caggatgttccatcttaatgactggcaaaatgggggcaccaatgaaacagaaagagagaggcatggggaagaacctgaactcctttcttagctgccactaggaggttaagaacttataataaaggatgggcttattttgaaaaagtcattttttaaaaagacttctacagaaagacattctgtgtagctaaaactcactattttgattgcatatgtttatttgtgttaaaattatcaagtattttccatttagcctttgacagttactaatgaatacatcttccaaaagtcacatgggaagtactgataaaatgcttgtgttcccattgatcatggaatgggcttatctctttgagagaacaaaactatgaagttagatc

SEQ ID NO: 222812 - DNA, 468 bp, Homo sapiens
agaactaaagaaattttacgtatgagaaaagtaaagtttttgacaggtagggagataaggttcgttaactcttttaggccaccattaacttttcaataactcttgctgttgggaataatggaaaaacataagctcgattattcatattgacccagattgccatatcgtatttccaatcaggagatagtctctgagcaggtaggtcttgcagttagacaaagagagagttgtatatggtaccatcttctttcacactgtccaacatgaagctaagattaaaggatttaaataactgtcgcctcaaaataaaatgagtttttgcctgtaagttctaacatatacgatggtgttgaaaattgtcttattttcaagatatcatttgtgttattttaaaatatctcttctaaaacaatagcataatccattgaattttctacattaaaaacaacattataagacaactgcatt

SEQ ID NO: 222813 - DNA, 464 bp, Homo sapiens
agatagaggtgagatgtaacaaatcaagaggccttgatgaatgactggaattgaagaagagggaatgagcaaaaatgaatctaagatttggagcttggttggctgggaggataattctgctattgcagaaatcaatgaggtcaatagacaagctcatttttccacagcagtagtgttgcagcaagaaatgaaggcttttgaagagcatatgcagtagagataccatatgcaggaaaaatggctcactggagagttgagaataaaggagaggagttcaagggagggaatggggatgattggggggctatctgcaaggagagaattgatgtgctgggaacagacgatttctgagggagagagaaaaacccagggccttaaaaagtgtccttggtcaagaagcagaaggagaaagaggagcaggaaaccataaaagaaacaggcgaagcaggagagagaggagaata

SEQ ID NO: 222814 - DNA, 492 bp, Homo sapiens
aaaaaaaaaaaaagtaaatattcactcctgcatttatcctggctctgagtctcaactgtgtctttgttttctttgtattttcctagtgatgctctgatacttagacatggcactctggcctaactacaaacagactgctcctccagtgggcttaatctctgtctggttttctcccttctgatatgtgtctctgccatgattcagaaggtatttgagtctgtctaagaatttaggtgtttccatgtccccaactttcctttctcctccatggtatgacgcagccccaaaaccatgaacatcttactttcatatctcaaagtaggaagttctttttcccccagattcatgggcatctttcttttcccccctttttttgcgttgttatttatttaaattttatatttgtgaattcacaggttgatgtgtttcattatattgtttctaattctcttaaagtaacttactatacaagtaaaagcttcttgtaccaca

SEQ ID NO: 222815 - DNA, 339 bp, Homo sapiens
ctttatcagcaccatccttcaggactggttttttccccactttggattgattgggcaggtgatttaccatccaagatgaagagttttaaaagaagaaaaagagacatgggaaattgctgtgcatgtgcaacagcatgcgtgcgagagaaagagagatacaaatcctgttgtgttatatctattgacagtttcataccaggcagagctggcaaaataaacttgagtggacgatcctagcaacttgagaattgattaaagcttccttgggctttcagcacagtgtccacatcaaaaaggcatgagaagcaaaataaatgattcttttgccatgatatgccg

SEQ ID NO: 222816 - DNA, 402 bp, Homo sapiens
ctaaagatagattgctgtagcattgatagcacttgctaattagattgaaaggagacagggatggtggtgtaagagagcagaatatacggttttttagaagttattatttcactgagttttcatattttgaagaattaagcataaaatttccttacctaaattctgtaatcaaatcttgtatgtttaaaattatttgtgtgcacatgtgcacgcgcgtgtgtgtatgtgtgtgtttaacgaacacatttgagttttggaatattcagcaaaatgatagttgctggctgggtgcagtggctcacacttgtaaacttagcactttgggaggctgaagcaggaggatcacttgaagccaggagtttgagaccagcctgggctacaaaacgagaccttgtctctaca

SEQ ID NO: 222817 - DNA, 506 bp, Homo sapiens
gcattcaatagaaaataattaagcatgtgaagaagtaaggatatacaatccataacccaaaatgtcacagaagactgaattagtagataagaatattaaaacatatatttattttttcaaaataaattttattgtgtatatttgaggcttaaaacatgacgttataggatacatatagatagtaaaatcttattaaagtgaagctgactgatacatctatcatctcacataattcctttcttcttgtgacaagtgcagctaaattctacttacttaacagaaatccctaatgcaatataattttattaacgttagtcctcatgttgtacacttgatctctaaacttgttcatcctacatatctgccattttgtatcctttagcatacagtatttcatattttcaaggacttagaggtaagattgtagatgttaagtaggaatatagaagatataaaaagatccaaattaaacttctggtcatgcaaactataatgtctgagataaa

SEQ ID NO: 222818 - DNA, 219 bp, Homo sapiens
taatgctgagatgctaagatggttttctttgttgcctagagcgctgggagtcttttgcaaaagctgctgccaatcaggcttgcctatctttgcagggctaattaacagcacttgggcaagcaagggggcggacgcctgcacgatgatgcgaatggtgccatcccaaggcttatgactaattataaacacaaagcacttaagggccgagattaataatga

SEQ ID NO: 222819 - DNA, 607 bp, Homo sapiens
gtttctgtgaagggagataaacccttgccgatgataaacagtaggcagagaagctgtagctttagaaagaagctgtggcaaagtcaagtggcaagaatttgggaatgacacacattttcccatcatgtcatgggaaataattagttttcatacaagatggtaatacactgtacatttatttataaatcctccacttctcttccatgttagaagtattttgagattactaaaaaaggatcactgctttgatgtctggcagggctaaacagccatgttacaacattgttattattaccttccattttcatagctgtttactctttcaaaagggcttcattcacaagtatgttcttatttgatcttcacagaaatttggatagaattaggcagtattattagcgccatctcacaaatgaggaatctgttggtcaaatgggttaaaaaccttgctagaggccatccagggacctgaaggcagagatgggactcagttcaggtctcctaactctcactgctgtgttcctcatcggtcactgttctcaggaccacatttcagttcagctcctctctcatttattgactacccgctatgtttcaagcactctgc

SEQ ID NO: 222820 - DNA, 967 bp, Homo sapiens
ggagcggggctttgccagggtccattgtactcacgctggggggctagagaccttcttttactggttctgcttatcagccaaacttcacctaacctttggacttgttaagccagtgccttgcagcctaggcgcggggcttttccaccggttctcagttccgctttagtccagagagaagacactacgcttcggggttcagtttgttgtaataggtgcaaatctttgcttctcataattctgcccaatggaagaacattctctgcctacccagcttgcctcaagaaggataatgaagtgttcagagtaaatgtccctgaagaacaatctcttcgtctgtctctcactcgctatcaggatagaagcatcaagtgtaatgaagatcagtttctgtgttaagctgggaaaacccatttaaaaaacagcaatcacttctgttgtaacaacaaaactttgattggcagttgcagctgctgtgtgccccatctgattcccaagcctcattctctctcaaaattcaggtgtcagcaaacccattcttccccacaccccagctaactatgtgaatgtgcaggcaatttcacacagaggataggacaaacttcctatgagtgtccaggtatgttttccaggtaatctggctattcatatctagcaacttcctgtaatgctccttcctagtcctaccttgtaatatgccactttgtgcaatataagcgcttatcaagtaattgttctgtactatagatcttcaaacagattcaccagtcccttcatatggaagtttaaaaagagctgtgtaaagtagaccagcagatagtctttcagaatgcagttcataatgttaagtgagctatcttgtaaaactcttcagttaaacttcccccaaatagaggaagacggagtaggattgaaataacatctgtttatgcttcacacagaataaagtcgtgatggactgatataataa

SEQ ID NO: 222821 - DNA, 378 bp, Homo sapiens
acctgaaattcaatgtttatatcaactttattcataactaccaaaaactggaaacaaccctattgtctatcaactggtaaacagatcaacgaacattcatataatgtacatccatagaatagaatactactgagcaataaaaaggaccaaattacaaatatatgcagaaaacatggatgaattgcagcagcattaggctgagtgaaagaagccaggctcaaaaagcaaatgtatgattccatttatgtagcattgtagaaaaggcaaaactgggtgggattacaggcgtgagccaccctatctggcctattttatttttgcttatttgtattttctaatgtttctatagtatgaacaagttatgcttttgtaactaaa

SEQ ID NO: 222822 - DNA, 286 bp, Homo sapiens
ccagaaatctgctttttaatccaagagcagcatctgaaaccagagtcaagactggagaaccaggggctgccttctcggtcagacagactcggaggaggccagtatccagatggtgtcgcctcatacactgcaaacctgaaaacaggccaccgtgcccacctgctccctggaggtcagccacatgcggagatccacccagcagataggtttttggattttgctgatcgatgggaaggatccatcgatgtggattccaagcctttcaataaaagcgactttgatgttg

SEQ ID NO: 222823 - DNA, 616 bp, Homo sapiens
tgagaatccccacagtgtgacacagagacacaaaatgaacaaatgctgttgggaaaatggcaccgatagacttgcttaaatatagagttgccacaaatctttaatttgaaaaaaaaaatgcattatctgtgatgcacagtaaagttaagcacaataaaataagttatgcctatataaaatattttgaactgaatgaaaatgaaaacactcttgtcaaaacttgtgggatgcttgggaggctgaggcaggagaatcgcttaagccaggccagggaggcagaggttgcagcaagccaagattgcaccactgcacttcagcctgggcgacagagcaagactccgcctcaaaaaaaaaaaaaaaaattgcaggatgcagctaaaccagtgctttaaaggaaattaaatactattagaaaagaagaaagatttcatatcagtgatccaagcttctatctcaaaaaaagaagggcaaattaagcccaaagtaagtgtgaaacaataaagatcggagcagaaatcattgaaatagaaaatcagaaaacagaaaatcagtgaaatcaaaaactggttgtttgtaaagatcaataaaacatagtcctctagccagaccaaggaag

SEQ ID NO: 222824 - DNA, 333 bp, Homo sapiens
gaaatttcacttccaagaatttaatctatgaaaatccctacacatgtactcaattatatttgcataggatgtattataattgttttgtttttgagacaggatctctgccgcctaagctggaggtcacttcaaactcgacctcccaggctcaagcgatcctcccacctcagcctcccaagtagctgggaccacaggcacgcaccatcacgcttggctaattttttttgtattttttgtagagacagggtttcaccacattgctcaggctggtctcgaattcctggcctcaagcaatctacccacctcagcctcccagagtgctgggagtacagg

SEQ ID NO: 222825 - DNA, 606 bp, Homo sapiens
  misc_feature (242)..(242): n is a, c, g, or t
  misc_feature (245)..(245): n is a, c, g, or t
  misc_feature (259)..(260): n is a, c, g, or t
  misc_feature (262)..(263): n is a, c, g, or t
atccgtgaaaatcacctgctgtcatgtgtttgaagagccatagatgaaagaaatgaaggctatgaagaaattattattgttcattctgaagtttttctttttctaatagtttgatttgaagtgattttgtgcagcaaacttggaaaaccatcatttaatgcacttgcactttgatatgtgcaaataaatgctaaaatataaaatttgcatatgtgatataatttaaatatatatatggcctntgncagaggcagagctnntnnctcccttgccttttcttcctttctaaaggaaccttgagttttttcgggaacacacctctacccaggttgggggtaagtactaattagttgagtcacacagcacccctttgagtttgctgcagtattgcatgcagtttgggaactgtgcttttaacctgtataaataattagaatttacttataatagaaaataattagaaatgacttaagtgattgctaataaagtttaccaaattagttatctagacaattaaatataactcttctgatataaatctaagagaaaagcgaagtacagaattgttacatgctactgttattatatgaaaaaaattgcctgtga

SEQ ID NO: 222826 - DNA, 554 bp, Homo sapiens
ctgcctttcccaaccaacttgaacaacttaccgaactccagcagtcctacactaggactattttgtaatcacaacatttaatgaataaaaataaaaggctaggacattaatattcaaaatcaggaaataagtggtaacattatcactatgtaattataaacacattattagttctaataggaaaacaaagcaaagattacccgacagtaaatagggctaagaacctgttttagcattgagtactcagacaaaaagaagggaacagacactggggcctacctgagggtgatgggtaggaggaaggagaggactgaaaaactacctatcaggtcctatgctcactgcctgggtgacaaaaccatctgtacaccaaacccccatgacacgcaattcacccatgtaacaaacctgcacatgtaccccctgaccctaaaataaaagctggaaaggaaaaaaacaaaagaaaaaaagaatctgtttagccaaaatgaagactatcttatagtgagtagatgaatgacaattaacaacacaacagaaaaatacccagtggc

SEQ ID NO: 222827 - DNA, 627 bp, Homo sapiens
acttcaagtgtgatccaaggtctggcagcatcatcactgttgcccgggcatttgttaaaatgcagatcctcaggccccaaccaaggcctagtgaatcagaatgtgcattttaaccacaagttcaatgatcggtgtgagtctgagaacaaccaccccagatcactgtttgttctctcttctaaccaattcatggctgtctgtcattgtcacatcactgggttgggtagctaaccttcgacactgctttttctggtttttactcttttctccattttttcttttcccttttctgttcttgtctttcttctttttccgccatttcttgcatgattctccccatgtgaaaggcaccaagggggactggcttccacagccaatggaagcattcctttcctgaagccatcaatccaaccacgctgtgttttcggccatctttgcatttgtgactgctctgggacattttcactgatgcacagggcgtcctgttgctacaaatagtgaaaggtgccaagctgctgaatgccagctaactgaggtatacctggaccacttcataaactaagggaaagtaactgtcattttttttttttttttttttttttttttttttttttttttttatttttt

SEQ ID NO: 222828 - DNA, 409 bp, Homo sapiens
aaaaaaataaaaaaatgcagtctctaaattttgggggagactgatttcagtaataaaactctagtcttccaaaaaaaaaaaaaaaattcttttaaaacttctaattattaggtttttttttttatctcttcagtacatcaaaatgtctggtggtaggaaaatactggactcatatatgactgtctacgtgatttgcagggcccagtgcaaaatgaagtggatgttgtacctcgttcaaagtgttaagcgtttcaagatggcaacagcagagcattaggccaagtatgaggtcattatgtacatgggtccttgtgtgaccacagaggtcacaggaacatgaagctagacctgagtgtatattcagataggtaaatcttacagatttttaaaactcaataaaagaaaaact

SEQ ID NO: 222829 - DNA, 1314 bp, Homo sapiens
agaggagagggaggtcacggcgtaaaggtgcagctgccgccaccgccgcttctgcaaggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacctcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttcta

SEQ ID NO: 222830 - DNA, 1484 bp, Homo sapiens
agaggagagggaggtcacggcgtaaaggtgcagctgccgccaccgccgcttctgcaaggtctcagggacgggctgcagccatgtcctattgccggcaggaaggctttgcccaggatggttccttctggaatgtctattcccctccttccctccctgaagctctttgtcagggacaaaggtaggatccctccccttccgtcttctccactggatgcctgtgtcgtattcatctgtgaccaccaggtactaccacagagctggagctgaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacctcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttcta

SEQ ID NO: 222831 - DNA, 1028 bp, Homo sapiens
agaggagagggaggtcacggcgtaaaggtgcagctgccgccaccgccgcttctgcaaggtctcagggacgggctgcagccatgtcctattgccggcaggaagggaaggatcgaatcatatttgtaaccaaagaagatcatgaaactccaagcagtgcagaattggtggctgatgaccccaacgatccatacgaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacctcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttcta

SEQ ID NO: 222832 - DNA, 753 bp, Homo sapiens
tatgcttcaaggtttaaaaagttatgctttgggagtttaaatcctcttttttgaaaatataataatattatatatttatttagcattactgtgtgccaggcattattctgaacactttaaccatattaactcatttaatcctcagaataactctgtggcttatatagcattatgattattgtcttacaaataaaacaaggcacaaagttaagtaacttcctaagatcttacaactagtaaatatttgggatgggttggtgaagagtactaaaatgcccaaaacactgataaaaacaaaatagaatttgagatgcaagaccaacgacaaactgacagtatcaggtctacatattgtgagaacaatgtatatggtattacttacacaaagtaacatatgtggtatttcaatgcattctatatcaaagatgtgggcaataagacaattttcttttaccaaattacaatcttattatgaatgacctgacaacagtatagcagcatattctctgaacagatctaacaattgtatgcaactaaaaatgctaaaaaaatttattttataatcactttatacaaatccaagaactgtcaaaaaagtaggcaataataagatgctgataaaggtaaatggaacatgaaagctgattttttttctgttaagaacatttaccaaataaatttaaatcgagttttagtttgaagcattttagaattcaggggttagaaagccaagctcagggcccactaaatttg

SEQ ID NO: 222833 - DNA, 352 bp, Homo sapiens
gagaacctggagtctaagtcttagggatgtgacccttcttgaaggcaagtcactggtgacaattcaccttcaggccagcttccgtgagggccgtaaagtgcctctcagtgaagattattaggagcctggccaaatgtttgcccaagttgccttgaaaggcaaaaacccatttaaatcccattcagactaaaggtcaaaagtctgatatcctgggtttttattgtgtcggatggggttcaggagcagtgggatgaagaaccaagagtgttataacacccaaggagcattacgtttccaacggagccaaacttccctgacttgatagttttgtccaaggccagccctgtgagcc

SEQ ID NO: 222834 - DNA, 494 bp, Homo sapiens
cagcttctacgggggggtggtctgtaactgcactggagggggaatacctaaatgctgctttccgcccaaagtgggaaatccctgctgctcctgtaagagtcacatctatctgcaaagaaaaaactctggctggtgcttggcatttttacctattctcttgcattaaaaatgactaagccatactgaatagtttctcacttgtaagtgggagataagccttaggtacatatggacataaagatgggaacagtagtaaaggcaatccctttcagagactgggggataagagattatttctttcaatgcttgaattcttgaattgttgttttgcactatatgaagtgtcccagggattcgctttttttttttttttaaaaaaaagcactaaattttaaattatctgttttttcataattttcaacagtatcacaggtaaatagtaaaattattttaaaatggaaaatgttttttaagtttgaagacaaagcaacttt

SEQ ID NO: 222835 - DNA, 277 bp, Homo sapiens
tttgagatggaaagttgagagggctgcagtctgatggcctaatgaggcaaggtttatagctggtagtgaggagaatggatggaagattaggaagtttcaggagagaaataggcatgaaatagacatctcagtgcagatatgcaagcttagtagaggaaaacctaagtgtgctgagcaatgttgaatgtctttttgaagttggaggtgatgtatttaaattgaaaacagtatgcctaattgtgtgattttgcctcaccaatgttcagctgtttaggta

SEQ ID NO: 222836 - DNA, 717 bp, Homo sapiens
cctgcaatcccacccaggccacagattggaaatccctttccaaaaaaaaaaaaaccaaaaaaaaaaaaaaaaaaaaagaagaagttattaatatattctttgcgtttggttaaaaacaagtctgaaaaaacttttttttaggttttatttattttcttttgcactgtctttaggtatttcatgttgatatgttattttgaggaaaagtgtgtcatatatcaaatacatctaacaccatttccacagtttgtgttatgtgactattttatgaaagaaatcaacttcaaaggaggtttgggttttactttgttttgtttctgtaattcataaacaatagtgcccttgaattggtccagagtttacattttagactttgtgttctgacattttgccagtggcttacttgaagaaacactttaatgaatacctgtgggaagaatttctctcatggtttactaataagaatggctgtgcttcttctgggcccttaccttatttttatcttatagatgctatgactctcatcgatttttttttttagaagtctgatagaaaatgtagggatgaatttccttgatacctttagcaaatctgtggcaccttactgcaatgcattttagagccaaaccttatttccagctttcttttatttattctttattatttatcttttctttttccagatttttatggtaatttaaaaaaattacttaggta

SEQ ID NO: 222837 - DNA, 1290 bp, Homo sapiens
tttttaggtctgcctagactccactatgtagctgcaccaaaatttatccaccagttccctctactggacacttggattgtttccacacttttttagtcacaaacaaggccacgttgactaactttgtacatacatcattttgtatttttcagttacatctaactagggaaatagtccttgaaatgggattactggatcaaagacttagaggtttttcagactattccaaatagtgtgaattcagactccaaacctcatgagggtcagccagtggctatatgaattctcactaatgagaattccttccactagaatctccttccactagtgttaagcaagtcagaaagtttccttactgtctgcctccacagtaatttttttctctggtacaccctcctcctgcgcgtatagccctttgatgggctctggctttatttgaggtctgatcaggtctgtcctgctgtgcgcttgggcctcctcccagtcagcactgattgttgctgtggagtagccagcacctgcaccctgatctggtattctactttgatgagggtttccctcactatcttgcaagttcaattttagagggtggtgatgttttttctaactttttattaatgttataccaatgtaacatccaacaacatgaactttaatatcctctaatacccagtttatgttaaatttcacccaactgtctcagaagtgtcttttatacataataggtttgttcaaatcaggatccaggcaagggccacccacttggttgaaatgtctcaagttccacaaccctatcccacactgccactattatgtcgtttgttgaaggtcatttgtcctatagaatatactattctggattttggctggttgcttcctctttcccccatactttcacttatttatcatatttgggtgttgtcaacctgacccatccatttacaagctccttattgactttttcacctagtgattttatccagcagtgaccatacctggatctttatttcattaaggggtttctaaatggggatttttctaatcttagttgttctgcattggttagtcacgattcttttatgaagacatttgccttgccatctacttggtttctctgaaattcaattcatacaggaaaaacaagataaatgctgaattatttattgattttcagtattgagttgatatcctagcagcttccaaaggtgaccaatgaatgtttatctgagggttatttttatttttattttttttgagacagagcaagactccgtctcaacaacaacaaca

SEQ ID NO: 222838 - DNA, 315 bp, Homo sapiens
atagctacgaaatataaacatggaaagactgtggcggcaggcggcagacccctgtgctccagcgtctgagctacctgtgccctgctctgtggatctcccatcaagttcagaggctttgctaactggtaaacagcttgttcatcagtgtggctgatgcaggaatgggttctctggtcaggggcgatgtcctatcctcgcagaatactgcagacacctccctccctgcacggaccgggcaggaacagcgagctatgagccctgccacccttcctggatgggggacacagctggggccccacccagacctgactccca

SEQ ID NO: 222839 - DNA, 488 bp, Homo sapiens
agaagaaacatgaacaaaagagattatgccctctttttaagtattaagtgcgtgttcccagatattggtgcttaatgtagtggttttgttttaagtgagaacattaggctaacccagtcacccagggtcatttatcagttttcatcgaatcagggaaattttcagctactgtttcttccgatattttacttgcccctttccctgtttccacactatgggaactgtcagcttaagataatcctttatagtttcttttgagcattagatcatatgttactgattttcatgatgtcacatctttgtgacgctggtattttaccagatgctgtgataaacaataaacattatctgaaaataagtgtggatcaggaaatgagagtgacagtgtcccatctgatcccatggtttgagaagttacgtagcacccaatatgcataattgctgttatttaataatgaaataaaatatttcctttcaattatgataca

SEQ ID NO: 222840 - DNA, 457 bp, Homo sapiens
ttgaatttctacttctcatcgatctggcccagtgtaccagtgtctaacattcccctgaatttaatttctccactcaaattgcagaacactgccacaggaacagttctttctgtcaacagaagcccaaaagcagacagaatataggatatgctctcaggaggcagcctagcttctgaaggcaagggatgagagaatggactgggctgggccatgtgtgccctatttctcctttcaaatatgggccaaaacctaggagcattacactaaaggggttgcctgcacagaaaaagcaaattaggaatgagtagtccctttctccataattattattatataccagcaaaaccttattattttgaatacagtaggtaatttggctgaaaaacatctgatttgtgaaataatcgaaaagaaaatattgctattttatgctaacaccaaaaatataatttgataa

SEQ ID NO: 222841 - DNA, 324 bp, Homo sapiens
attaatctaaaaaaggtctcagtagtaacttattcatgaaggaagaactaatttagtagtcaatgttattgaagggacagaatatcacagttttacacgtacattggttaaaattatgatgtggcttgagaaaaaacctccctaggcctattaacctaaaatttgttagtgtagaataagctctgttaatctaggtcattttacatttcaggctgctttgcgttggctaaaataaatattcagctgtaaatgacaatttggttcaaactgtattattatagaaagagttgcatttctaagattgtttagaggacttatttaatc

SEQ ID NO: 222842 - DNA, 415 bp, Homo sapiens
tgctggctgcccattgctgtggctgtgcccctgggactttctgtgtctgcccaggagggggtgccagcatcaatcagcttttcagccaactagtacttttttaaagttgccttaaaaatgaacatagccagctgggtgtggtagctcacacctgtaatcctagcactttggaaggccaaggcaggcggatcccttgaggtcaggagttcagcaccagcctggccaacatagtgaaaccccacctctactagaaatacaaaaattagctgggtgtggtggcacatgcctgtagctccagctactcgcgaggctgaggcacgagaattgcttgaacctgggaggtggagggtgcagtgagccgagatcgcgccattgcactccagcctgggtgacagagcagactctgtctccacac

SEQ ID NO: 222843 - DNA, 332 bp, Homo sapiens
atgcctgtaatcccagctacttgggaggctgaggcaggagaatcccttgaaccctggaaggcagaggttgcggtgacccgagattgcgccattgcactccagcctgggcaacaagagtgaaactccatctcaaagaaaaaaaaaatcatagaggcttcctgctcctgagttgcagctggtgacttaaactgtggaaccgcaaaggaaaactagttacgtttcagagtcataggtcgtacaactttgtgaacgtactaaaaaccatgggaacagtgtacactttgggtgaattatatggtctgtgaatatctcaataaagctgtttaaaaagt

SEQ ID NO: 222844 - DNA, 460 bp, Homo sapiens
ctgctttacttgaatgatgagtcacattattttaagaagtcaatatgaatgtatagtacctacatttttacttggaaattgtacttcagtatgtgttatcagtcatacatagctcattaagaatgtaaatatttaaactacttttggatagatgtggttcaggggaacagatttgttgatgttgtgggtttgtgttagtaaattggctattttccaggtcatgttagtggtaggctttccatttcctgttgtgacatgttggtcataattttcagacggctcaggaagccagatttgatctctgtggtgggtcttatatcaaagcagtatcctgtggggtttggccactatcgctgttttgtagaacttccaacttagtttggtagtcaaacttgtcagcagtgatctaaaatgtataatattttataataagtgttaatatttgttgaatgcattctgt

SEQ ID NO: 222845 - DNA, 628 bp, Homo sapiens
acatgttagagaaaatcaaagaagggaagataaagaaagctaaaggagctcatgtaatataccttcaattgttaaaaagagaacacagaagatggccgaataggaacagctccagtctacagctcccagagtgagcaatgtggaagatgggtgatttctgtatttccaactgaggtaccacgttcatctcactggggcttgtcagacagtgggtgcagtccacagaatatgagccaaagcagggcgggggatcgcctcacctgagaagcaaaaggggtcggggaattccctttcctggccaagggaaaccgtgacagacggtacctggaaaatcaggacactcccaccctaacactgcacttttccaacggtcttagcaaacggcacaccaggagattatatcctgcacctggctcagagggtcccatgcccacggagcctcactcactgctagcacagcagtctgagatcgaactacaaggaggcagcgaggctggggaaggggcgtcggccattgctgatgcttgagtacgtaaacaaagcagcagggaagcttgaactgggtggagcccaccgcagatcaaggacgcctgcctgcctctgtagactccacctctggggtcagggc

SEQ ID NO: 222846 - DNA, 616 bp, Homo sapiens
agagttctgagattctttattagcaactgacagttttctaggaactgaatttttacacttagagctgcgaaaagccaaaagcatttctaaatgatctccatcccattcccctcaaataataatgtacacgctcattatagtttgttagtttctcatgcctttctttggtgttctcatggttgtgagaagttgggagaagcagcgtctaaatttaggaaatggatttcttttctgttactaagtacattgctataatttaaagacaacaggagaacatgtcttttatctcaaatgggtctgctatttttcttctaaggtgtttctctaagagtaacattatgtaatttaatcagtgttataaaaaatggaattcctggttaggattttaaaaggtgatgttaacagatatcaaattttttatattagggattgaaggacttttatttatttatttcattttaatttttaagctccaggatacatatgtaggatatgcagctttgttacataggtaaatatgtgctatggtggtttgctgcacctgtcaacccatcaccttggtattaagcccagcatgcattagccatctttcctaatgctccccttccccccaccc

SEQ ID NO: 222847 - DNA, 556 bp, Homo sapiens
aggccaacatactaaccggctccaatagccatcactcaccaagtgcgtttacaaggctttgttcctgtctcttttgtggcctcacaatggcagatgcacaccaggtcccacaaccagagaaaaagagagggaggttactcgtggagatgtcagaaaaagtactccccttgtgcctgacttctttgattaaacccttgtttgattttgtccagagaggcaagacttcaacatgtagctctaagtgctgggccaggcaccccaggtttagatgaaaaactaacgctgatagaggtatgtgtttacatcagaccgaggttatacttacatttttcatttgttaatataaatctaagttaaccacctcaagcgggactcagcaagggctgctctttattaatgggctggtcgttgctgtttttaagagagtgtcattaaccctaacatacgggctccttgtgtaattgaacagtaaatgtgattatgatcccaactgccatctccaggcacttcttggaacacaagttctttgtacaggagaaatagtcagacacaaagg

SEQ ID NO: 222848 - DNA, 568 bp, Homo sapiens
tcatgggggtggctccccccagatgctgttcttgtgacagtgcataagttctcacgagatctgatgattttataagtgacagtttccctggcctttcacgctctcacctgcccccacataagacgtgctttgctttccctttgccttctgccatgattatgtttcctgggacctccccagccatgcagtctgtgagtcaattaaaactcttttctttttaaattacccaacctcaggtatttctttatagcagtgtgaaaacagactaatacacatctcttttatctctgtcctccatccctcacttctcattctcacaataggtaaccactcttattttccatttattgtccaggtaatttctatgcacatgcaatccaaggtaaatatatgcattttttctttttaaaattttatttattttttccagctttattgaggtataactgagaaataaaattgtataaatgtagcttgtacaatgtgatgttttcatatatacagtatgaaatgattaccacaattaagctaattaacatatccatcacctcacatagttatcattttg

SEQ ID NO: 222849 - DNA, 507 bp, Homo sapiens
acctgtctctgtttattcgtttgtttttaatttttgtaatcttgttgggtcaagagaagaggttcactactaggcacggcctggtttggtcctcagatgactggctcagagccaagacatctggattctctaaaatattgaaaaaaccaaaggtgcttttcctactcctttgcttatactcacacagtcactcaacaatttacttctaacaacagatacgttgaggtttttccccacacacctagcaatctgcaatggacaccgactgcatgccctaaaaatcaattcaattctgacactatctactgggagacagtgtcagatcccacaagcctgttccccccacccaacactacagatggtaattgcaagcctcaggttgcgacctgtgcttctgttcaactggctatacattgggactctcatgacccccctccttaggctcaattaatttgctaaagtggctcacagaactcagggaaacactttacttaagtttgaccattt

SEQ ID NO: 222850 - DNA, 577 bp, Homo sapiens
tatgtcgatggctctgaatgccagactctgccgtgtgtgtgtgtgtgtgtgtgtgtgtgtgtggtcactaaccacagcccacaggacaaacccagcccacagcctttttgtgtatggtctgaacacagagaaagtattttagttttgttgttctttagagatggagtcttggctcaccacaacctctgcctcccaggctcaagcgattctcccaggttcaattgattctcatgcctcaacctccgaggtgctgggtttacaggtgtgagccaccatgcccagcccacatttgatgaatttttttgtcttttgttcttttaaaaatcatggttggaaagcagagcataattgttctttatgtagatcccaactgattgggattgttagggagatgttttggcattcagtaaatgtttttgttttccattattaagactatgaatattttattttattttctgagacagggtctcagaatttgtcaaatttgtaaaatttatagccagatgtagggtaggggtggcctactttctgtaaagggccagatagtaaatattttaagctctcaatggaccct

SEQ ID NO: 222851 - DNA, 430 bp, Homo sapiens
gcccagctaattgttgaatttttagtaaagacggagtttcaccatcttggtcaggctggtcttgaactcctgacctcataacccacctcggcctcccaaagtgctgggtttacaggtgtgagccaccatgcccagcccacatttgatgaatttttttgtcttttgttcttttaaaaatcatggttggaaagcagagcataattgttctttatgtagatcccaactgattgggattgttagggagatgttttggcattcagtaaatgtttttgttttccattattaagactatgaatattttattttattttctgagacagggtctcagaatttgtcaaatttgtaaaatttatagccagatgtagggtaggggtggcctactttctgtaaagggccagatagtaaatattttaagctctcaatggaccct

SEQ ID NO: 222852 - DNA, 349 bp, Homo sapiens
tagtagtttgtggtttcaccaatcaggctggtctcaaattcctaacctcaagtaatccacctgcctggaagttttacctttttaaagttagatgaagaggaggagatgatgtgcagcaagatcaggataggagttactgaacacatttagaaagaccatgtgggggatcacaacaaaagtccacgtgcaccctaccctttcacttgaacctgagctgtggaagccgtcccctggccagccgttgggtgtgggccaccactgtttcttggattggggcagcggctgcgttccaggccatctttattgagccacccccctagtgcatcatctctgcttctcactgccatta

SEQ ID NO: 222853 - DNA, 452 bp, Homo sapiens
gctaaaagtgatctacttgatcactgctgtggaggcaggtgagctctcaagttctcccgtcagtggatgcagaaacaaagattttagcgcaagtagtcaatttggaaggcgatcctgggaaacactgtattggagtgggacctgagatggagaaggaaaggaagcatatgaaaggtgtgctctcaatctctcattctgctgggggtactctgggatcccacgtagggcgtgcatcgggaaggaaatgtaaatgtggactgtgtggcttagcaggctccaggtgcagagaaagcatcaggtgaagccatggagggcatggatacgagcagagcatcagcagttctcataaaagacaccataccagcacacctttcccacctgccccagtgcagtaattcttctgctccattacaaataaagggcctgtcttttgccaacctctgttcctgcca

SEQ ID NO: 222854 - DNA, 475 bp, Homo sapiens
gtgatattttctatggaatatgattttggtcttcaggctatgtttatataatcattccatcaatgttattgaacatcttactatgggccaggtagtatgttaggtattgtacttataaaaataagtaaaaatgactacaagggtaaaaagctcacttaccttctaagcccaagtggataacaaaactggttgaggtagggttgccagatacaatatagggtgctttaactgaattgcatgagttgcattggacctacttacactaaaaagtaaaaataaaatagttgtttatcttttctgcacatttaaacaggcttcttgcattcatatttgctaaatgcagcaaccctaactagctgggaactggggagagctagaaagtacatgctttatctaaagggagcagctactacctcccctccccaacccctctcaggaatcattgccacaaggcatgcaaccccagtgaactcat

SEQ ID NO: 222855 - DNA, 406 bp, Homo sapiens
ttacatgcactttgtcatgtaactctgcagtctgtcccaataaatgaggcagataaatttcctgctctttgatttgggctcattcatgtgattttctttggccaacagaaacaggtaaaagcgtcagtgtcctagtcccaagactaggccttaagaggcctcatatgcttctacatgccttcttatgtttctatcatccacatgagaaaaccatccacaggacagcttgctagtgacagaaagaggatgacggacacgtgaagcagagctactccaactaatcccagctaaccactgccatgtgagaaagccctgccaaaatctgcagtgccacccaaccaagctaagttgaaagcagctggcccatggatacacaggtgataataaacgaaagttattttaaaaa

SEQ ID NO: 222856 - DNA, 322 bp, Homo sapiens
gcttacatctttctcccatgctggatgcttcctgcccttgaacatctctccaactgcttcagtttttgcagtcggactggcttccttgctcctcagcttacagatggcatattgtgagaccttgtgatttcatgaggacagcttgctagtgacagaaagaggatgacggacacgtgaagcagagctactccaactaatcccagctaaccactgccatgtgagaaagccctgccaaaatctgcagtgccacccaaccaagctaagttgaaagcagctggcccatggatacacaggtgataataaacgaaagttattttaaaaa

SEQ ID NO: 222857 - DNA, 410 bp, Homo sapiens
aggccaggcagctgccagagctgggccctagaaaatgacactctggtcctcaggtttgttcggaaactcatcacttttccaaacagcccacaagagactgatttctccacctgaatcccagtgcaccaattggcaggggagctatgcctcacggaacagccaacactggccacttgcatggggcatgcccttcctggggcaaaggctgctagggagctcagaatagaacttggcaagaggagaactagaaaaaggaaactgacgttctggggctaagctgggagtgtttgtatgattcatgacccccttccctggactgtcctagataaatctcagctgctcctggcccatgggacctggcccaccagctttttgacaatgtgaagaccactccacccttacccacaaca

SEQ ID NO: 222858 - DNA, 471 bp, Homo sapiens
tttctaatagaggaaaaatgattttcatgcaacatccttgagaaatcaaagcatgtgagaatcatcaagataggtaaaaatttgaatatcagcatatttatctcttcaggggatttttgaacaatttctctgatgtttcaagttcagcaaaatacatacttctgaggtcctctttgcattgattttaggtatcttaggggaaatgtattctcccactaataatctaccagaaagcagctctgagcgtttctttctagtaactcctggggtcctgagacttgggacttggactcagcagtctgcattcaggtcgagttcagtcattgggatggaagtgatacagtcccccttgggagcgataccaaagtgcttaccgagcacttgcttcaagctgagatgactgaactctcctcccctctcctgccccttcctctgatatcctaaataaagggagagagttcacagctcctg

SEQ ID NO: 222859 - DNA, 607 bp, Homo sapiens
gacatggggcatcaagtatagcctgtttgaccccagcagaccccagacatgtctgtagctactggtctcacctagccccaaggcgtccctcacctggccaccctcatcttgcaaataatgtgtctccgagggtgtttggctctggatggagcttgtccttggagggcagaggtttgctactgtccaggttgttactgagtatttgcttcatgcctagcagtacctttcaggcgatgcattgagtgagggaatgataggcatgctagggaccctgaagataattccaaaacagaagtaaaaacaccggaatcatggcagcatggctggaatatgtacatggtccccatagtgaccacttctcactgacaacacccattggatatgtgaggcccagaggatttatgaatgagaaaatccaaaacaacaagaaaacctctggtctcaatactttacacttatatctactatttaaaaaaaaaaaagttggctgtgcatagtggctcacgcctgtgatagcagcactttgggtgactgaggtgggcacattgcttgagcccaggaatttgagaccagtgtaggcaacatagtgaaacccccgtctctatac

SEQ ID NO: 222860 - DNA, 1167 bp, Homo sapiens
tggtcttgaactcctgacttcaggtgatccgcctgcctcagcttcccaaagtgctgggattacaggtgtcagccaccatgcctggctcatttgctgtcttaaccacaatattattaaaatattatactgacatttaaccaagaatgtttaagtactttctgattatttacttgtctctagaacacatcagtgaatagttaagtccttaatgtcttggtaagttcttggaaacgtctacttaaaaagtgaaacaatgtataatgaaaccaatttttttttcctcatcaatgtcgtaaggaaatgaggttgattgaaacaactttggagaaccttctgtactcctttcatttagttgcggtttccaagaacctatccacaacattaagtggggacttactatatagccaaaaataaaatgaaaggcatataattttgaaatgtacttgtagctttggaatgtactgtacagtgagttcgtcatacatctagatgaggatgtaaaagaacaaaaacttggaatttccctccctctccatgcagctttgaagagtctttaatccaagggaaacctacagttctttctctgccgtaggttctcttctcctctcttccacttcctccagctcctgtttgtctcttcctccctgtgtgtcttactaccttgttttgggggtttgttttctctcctgatttttacctctttcagtcctcaaaatggtctgaataaactggagattaatttatttttgaaagaagtgtttgtatctactaagtgaggttatggaagagatccaaaaatgttctgggtggcaggagaagacatttaaaatacacagttaataagccacatttagataatctataattgactgtagtttattcagaaatgtcttttgttaaataaagcttctaagtgaagtctcaaagccacagaattaagaaaggctgtttgtttagtcaatgtgattactgctcatatttttaaaaggaaaaaaaagcaaaaaaaaaaatcagtttttcataaaaggaaatgtgtccactattttaaagatataaatattctgtctagtagatatggtatctgcaataaatgtgtttgtacatattgtcatattctgttaatatcaccgtaatttccaagtgaactttaaaaaactataagggatc

SEQ ID NO: 222861 - DNA, 314 bp, Homo sapiens
caagtcaaccctgggcaacatagcaaaacactgtctctacaaacaaacaaacaaaaaacacaaatttgccaggcacggtagcatgtgcctgtagtaccagctcctggggaggctgaggtgggaagattgcttgaggccaggaggttaaggctgcagtaagttgtgattatgccactgcactccagaccccgtcttgaaaaagataaataaaaaatgttttaaataaaaaagacttcacatgattgacctcgctacaaaaatgacaactcaaatctcacaggctctttctgtgtggttggttgggttaacttttg

SEQ ID NO: 222862 - DNA, 519 bp, Homo sapiens
gctaatagtgctgaacttgagaacgccgctcttggtggacagttgcatggtgtctgtttttgacaataatgaataaaggtacttgtgcaagcctttttacagacttatgcttttctcccccctaggataaatgcctaggggtagaattggtacatgtaaggtagatttagttatccaaagtagctgtactgtgttacactcccaccgtcgatgtatgcaaactctagagtctggtttcttgacatctatgccaaatattggtaacacaatttttaaaatagtagcttttctagtagatgtgtataattatctcattttattttttattactaacgatattaagaaatttttcatttgcttatttgctattatatcatttttgtgtagcatctgttagtttttatagctctcttgtttctatgttgtacattatatttatatattcttgctcttattcataataaatagtatatataattgtgtaattaaaaataaacattaaagtataaatatatttac

SEQ ID NO: 222863 - DNA, 802 bp, Homo sapiens
ggccatcagctgctgagaggctaggcaagccctggagtccttgtcagttttttgataatgactacctttactcggtactgcaggccaccctgtgaccatttctgtggtctgagccttgcctacctctccacctctcttcgtcacagcattcgtccattcattcagcagatgtgttctgagcatctgtcacactgggggctttctggatgtagacgtaggacgtgatatctaaattgagtgctgagtcggggaatgggtctgatgctggcagggagacccatgactcctttttgtgacacagcagaaactctgggtgctggctgccgtggcttcttcttgcttagtcacagggcagagttcaggcaggaaaatgaggccaccgggcctcttgtcccagggaaaaaagccttttataaagataagaggataaggccccgtggacactgagttgggacccaccctgatagccaatctcagtaggagctggatccaagaaaaagcaggaaagtaaacaaaaccaaaatgtgctggttttgagtccttctcctgaaaaaaacggagctaaacccatggcggtttagagtttaggggctgtgggtgtgagtatatatgcgcctatgtatccccccactcatttttgctagaaaatggcaaaccacctttctgtatcttgttgcatttcccccgattttgtgagcccagggagagagaacaaaacggtgaccagctgtccttgtttctgtgggaagttgtgaaatttcatgtagtcttgatcttttgtcctcagccaccctcatttttt

SEQ ID NO: 222864 - DNA, 453 bp, Homo sapiens
ggcgggattcttgctactgagcgatccgtctctcctcctggctagactgaggatcttctctgtccccgtccttctggaatttcattatgatgtcacctatggtacatttctttcgtgtttccaacttctaattctaatacaatttcaaactcacagggtaattgccaggatagtccagggagctctcacacgtgcgttccggactcactgcctgctcccgtctgcccccttgcccccgcctagacctgtgcacgtgcagctactgagagtgaagcagagacgtcgggcccctgggccctcaacacttgtgtatatttcctaagaacaagcttctcttacgcagccacagaacaactcgcatcaggaaattatcattcatacattattctctaatccattgtccatagtcaaattcatgaattgttccaatgatagcctttattgcaaaaaaaa

SEQ ID NO: 222865 - DNA, 225 bp, Homo sapiens
ttcttaaacaactgaagagtatgctggttctagtttctttcctctgaatcatgtgtgtgtggtggcaatttagtgactgggaggcactggaaattattggttataataaattgatgtcatgcccacagcacagcaggcaaaaaggatgaattagagacagaaatagtaatagggttttgtccaggaaacctcaagcatatgaggtattgccatgttgattacttt

SEQ ID NO: 222866 - DNA, 437 bp, Homo sapiens
agaaagggcccacatctcgagtctccagtctctccttgaaaagagcaccccctaatcccggaggaagggagggtgaaggaggaggggagagcccactacaggcaaggcaggaaggttaatcattttgttaaccggaaagggtgctgccccgcctggccgtcgtcaccgagcgtgtcagtcacccgctctcgatttcgccgcagaattacctgctcaaagagccaccccaagaagccctcagctccgaggtcttcccgcccgtcgtctgcgggaagtaaacggcgtcctccctccaaagaagtggatgccccttcgactctcctccgccccccggcggttcctaaatctaggaaagccagccccggcatcgctcactactcctgcacctcagctctgggatacccgctcagtacagacagaccatcaaccaaaaaaga

SEQ ID NO: 222867 - DNA, 660 bp, Homo sapiens
gaatttttagatcggatttttgtggtaaatgtattccctcagctatttgcatgtatgtgggtttcagtaagtattcctgtttatgttttgggctgcatttagacttgttattccttttgcaaaaattccttgagttcacccaataaaaccagtaaaaatcagccatttgcagtgtggtcaggaaacagtcaacagtattagctggacattagtgttgggtctctgagtttcggatgaaggaatgatcatttcagtagtttagttcacttgtttttcctctttgtgttaaggctatcattcagagggcaaacagttcccggtgttgtgaattgaaaatatgttctgaatagatttgctgattgttgagtatgttttgcttacacttaaggccaaattcttccttgaagatgagcttgtcaataaacatcaatggaaaaataaccccaaatttgtgacttctggggaatttgaatttaaagagaatatctgtaggataacagactgtgggtttctagtcgttggattaacatgttttgtttagcatgcttagtgtgggagtgttcaaggatcttagaatttgtttttcttaaagcaaagaattgactgagtttttgtgctcatttgtataatgagaaggtttcctcccatcatgtgggttcg

SEQ ID NO: 222868 - DNA, 272 bp, Homo sapiens
atatatgcaaataaatatagaatgtgtccagcagtgatgaatgcagtaaagtttttaaaaggcaaggtaatgggtttgagagtgttggggtgtgctcttttatggaagggtcagggaagggctcgctgagtaggtagcgtttgagcagagacgaggtaaatgaaccatgaggctatctgagggaagagtgttgcagggagagagaacttctgggtgccaggacccagaggaggggtgtgttcactgttcacaaggaacagcaaggaggctgg

SEQ ID NO: 222869 - DNA, 437 bp, Homo sapiens
tcagtaattgtctttgctttttaattaggttttactcagtttcttgtgaacattttatttgctcttaaaaaatagattggtagcacatttctttcataactgtagcatcccaggataatttcttatgtgtttttacatttatattaacactttttaaccttacctctgtcctattcatattaagtattgtatattattcattgtattctttctttaatgtttaatgctgttaaatgttaaattctttttccctcttaatatgtcatggcctttggtatgtaagaagcagaccaaacttgacttcacttgcttctaatgacccatctggcctgcaaaataccagtttattttttccctaaagctcacaagtagccaactggcctgttaatttcattctcattttaaattaaaatttaagggaaaatagcaaaatataa

SEQ ID NO: 222870 - DNA, 466 bp, Homo sapiens
accaaccaaccaaccaaacaaaaatcatatacttgaatcaaagctgaaacttttcagtggtgatttacaaggaaacaagtaacaaaatgtgaaaaatatgagcatttatttaactttggaaacaagaaaatgccatcagagttagaaccagaatcatagcatatcagagcccaaagggccttccaaggtcttagttctatccattcattgcctaggtgtggacatatattcattaaggataaatggcatgtcagagtcacctgcctaatgtgtgaaagggtcatcatgttctgattcttggcttagcatgctttcaattaataccacattggtagggaacatgggtcaacagaatgagaagtataaagtgacagatgtcttctgaaaagtaatggtagccagttgaataatgaaaacagtaaattttaagaagactagggagtacaatgtaataattttaaaaaga

SEQ ID NO: 222871 - DNA, 595 bp, Homo sapiens
tgggtgagggtccttcagaaggagctgtggttgaacagcaagattttcccctatgcatggtgtgttagtcctttgtgcattgctataaaggaatacctgaggctgggtaatttattttataagatgtttatttggctctcagttctgcagtctgtacaagaagtgcattgtccagcatcagcttctggggaggcctcaggaaacttacagccttggcagaaagtgaagggggagccggcatgtcatgtggccagagcaggagcaagagtgcaggaggggaggtggccacatgcttttaaacaaccacctcccacaagaactcactcactattgcgaggacgacagtaccaaggggatggggctaaaccattcatgagaaatttccctccgtgatccagtcacctcccaccaggccccacctccagcactgaggattatagttcaacatgagatttggtggagacacagatccaaaccatatcaaatgggttctaggaacttagcctagatttcagatttaggaacagtatcataggtcaccttttcaaaatacataaagtttcctacagaaacaatatcaattaagtgcatgttt

SEQ ID NO: 222872 - DNA, 325 bp, Homo sapiens
gggtcctcccaaagcctggagttgcagttagagtttaccaccttgggatggcacatggaggtccgaagaacggatagacagctcaacaggcagccacagggcctgaggcaggagtctccctcagcggggacattcagcaactcactcaagactgactctgctcaggctgtctcggctttcacagaggtagggttgggaggagggtggctcagagaggctggggaaggccaccaagtaccacagcttctcatggcatcacacagggacaaggcttgggggccctttttaagcagcttgacccaggatgctccagtttcatgcctgc

SEQ ID NO: 222873 - DNA, 160 bp, Homo sapiens
aagctttttttttttccaagtcattagtgaacaagagcccttaggacaaaatactggggtaaaaattcaaaatggcaatgattcataaaatttgtttcttgtaaaaaagccatggtttcgcagagctctcgttttactttcatttatgcctactaagctt

SEQ ID NO: 222874 - DNA, 313 bp, Homo sapiens
aactctccagtttttaaatgtgtggctaagttttaaaaccagtatttcagggcttaggcacctacacaccatttgaaatactggttctaggaaaatgtgctacaatgccaagcaactgattaaaataagtcaaataccattacatcacaaactgaggcaggtagaagcttccaatatatggttttaggcaaatactgtgtgctttctatgtgttgttctggggctgtaggatgcaaagctaggaaataggcaatacacacaaataactacaacagacggcagtatgtactatatcaaacatatgtcaacatga

SEQ ID NO: 222875 - DNA, 565 bp, Homo sapiens
cactttgggtggccaaggagagaggatcatttaagcccaggagtttgagaccagcctgggcaacatagtgagaccttgtctctatttgaaaaaaaaaaaaagaccaaaattgatgccacgctgatttccaggccatgctctgatatataaactagttcttcaaatggggctgacacctcacacgttgttagaagggaattccaatgagagagtggcagggtgaagttctcctctaagcttcttccttccttaagatttgatctggatctctgggtgcagtatcaataacttcaataacttttctttttactgactagaagattatgagagttctcatgaatatggagttgctaaaaataaaagtttaagaaatttccagctgggggcggtggcttacccctataatcccagcactttgggaggccgaggcaggtggatcacctgaggtcaggagttcgggaccagcctggccaacatggtgaaaccccgcttctcctaaaaatacaaaaattagctgggggtggtggcaggcacctgtaatcccaactacttgggaggctgaggc

SEQ ID NO: 222876 - DNA, 145 bp, Homo sapiens
aaatgctgtgctatgtaacaaaataatacaatgtacatatgtataaaagttaacatatacatatcaattaacataagcataactgtaatcacatatactgataaataaaaatataaagtaatatatggtaatgacccaaccattt

SEQ ID NO: 222877 - DNA, 530 bp, Homo sapiens
aatctaaatatatgacaaaattgcacagaactaaatacacacacacacacacagacacacacatgaatctggtgaaatctgaataggatgaatggattgtatcaatgtcaatttcctgtctttgatactgtatttagctgtccaaaatgtcaccattggggtaaaatgggtgaaaggcatacatagatctctgtattatttcttagaactgcacgcaaactacaataatctcaaaataaaaagtctttttttaaaagacaggccacaagctgaaatttataatacacaaacatacaaaacaatcgggaacaaaatacaaaaaatacctatgacaatgacaacacaatagaaaaaaaaagggcaaaagggtacgacctcaggattcacagaagaggaaattccagctaataaacctatgaagagatgtctaacctcattggaaatcaggaaaacacaataataaaataacaatgaaatactactttacatccatcagattggcaaacttttaacagtctggaaagatcagg

SEQ ID NO: 222878 - DNA, 518 bp, Homo sapiens
tgaagaaaaaatagagtcatgagataaagtagctctgttaccctgattctctaaccagggaggtgaggaaagacctcactgagtgggtagtacttgagtgcagacctgaatgctgggaagaacaatttgagcagaccaagtggcaggtgcaaaaggcaggtgtagctgacattgtgtgaagagcagcctggaggctggggtggctgaagtctggggagtcaggagagataaggtcctgttagacaggttttgtgcttaatgtgatctgtgatttgagtcccttggctcggtgttaatattgagtgtttgatggcagcagaagatgttcagtaagcacttctagagctgaagatagctgtgcaagtctgtagtaataggaatgtggctctgaatttggagctaggtaacttggagtgaaaacctgtgactttgagctttaatctattaagcctcagtgtttccacgcataaaataaaagaactaaattaaggcccattacgttatacttccaagactta

SEQ ID NO: 222879 - DNA, 758 bp, Homo sapiens
gttctctcttagacctcttcctctgagggaatcagctaccatgccatgaggatactgcagccgtcctgtggggaggcttttatagagagaaaccgaggtttcctgccaacacccagccatatgagtgatccatgtcagtgagcctctgtggaagttgatcccctggctcctgtcaagcttgctaatgactgtagcttcatctgatatttaatgcaactataagagaaacctccaagcctgaactgcccaccaagctactcctgaatctctaaccaacagaaactccagaagctgcatggctgtgccacgccagtctgcacgctccagctgccagacagcatgtcttcccctttgttaataatttctaatggtttactttcaagttaatttactctttcctatatctttcatttggctatggagtccatgtagtaaatttttcattgcagattattgtatttttccgtcttttttatagtttctactactcagctgagaatttctaccttttcattttttccagtgtgttagcctcatgaagcaccattataagagctgctttcaattatctgatatttctaatatctggaccatctcaggactggcatctattaattgctttttcccatgagatttagtaatgttttatcagttcttcatatgtcaaataattttaggttgtctcctggacattgtgaatgttatgctgtataaattctgagtcctgggtcttgttataatcctttgaagaacactag

SEQ ID NO: 222880 - DNA, 499 bp, Homo sapiens
caagaaagacttttaaatgttcttgatacgtaaggcagcaggtggagattcaatgatggtactgccattgagcatatcggtcaagattttaacagtgtaaggcctcttccttaaattgtaaaatagctcatcttttgattgaaactgctaaagtgtaagacatgtaagactcctgttagaattaacactctctgccatttaggtgggggatgaaacattaaactgttagtatacttgtaccttagaataaagtaccttattgtcctgctataagaaataatttgacaactaaaaatccatggaaggtgtaatacagcaattgaaagcttgagtaaattcaattttgtgggtttttttttttttttggaaaaccccctatttaaaaacacaagtgatttagattaagatatttctttcagtatttttggtaggggtgagatgggtgaagaaagaagagtcttgttcaattcagacaagagaaatgaattggaactctgga

SEQ ID NO: 222881 - DNA, 373 bp, Homo sapiens
atggaaagaatgaatgctccagggctggcaggggctgggtaaccttggcagtgccatgaggcagggggtgtgtctgcggtggttttgtgctctgacgtctaagcccaaggcctggcacataataagcattcggtgaagatttgctggactggggatgctcactcgcctttgggaatattgtgaggccatgtaaaaggatggttttgaacgctgtgacttcaccacatgaaacgcttgggatacaatgtgaaaatgcaaaatgagcctataaaaggctgtgcttacaagcgaaatgtaagtttctggctgcctactaacatgtagctacacaaacctggaagtcttcctgccaaacatgcagaagagtcttcgc

SEQ ID NO: 222882 - DNA, 278 bp, Homo sapiens
atatcttactgttttacagaatgccacctttatgaagggaccatgccggtttttactgggaaaagtaacgagtaatctaaacacagtgttactccacatatacaccagagaacaagagctcagttccatgaatagagcagactccactatctccatgaaattttgggatgcaaggtgctatgtaagtgtgaagccactaccaagttattctcgtcttaataaaggacaagttgatttactttgttaccccaccaataaaataccggaataagacttga

SEQ ID NO: 222883 - DNA, 215 bp, Homo sapiens
aatgcatagacttaccattgggttacgtcttgataaagccatcataaactaaaaatatctgcatttagtacagctaacctaccaaacatcatggcttaacctagcctaccttaaacatgcccaactgaaggctaatgttaattgttctgagcatgtttaaggtaggctaggttaaacatgtttaaggaaggctaatgttaattgttctgagcatg

SEQ ID NO: 222884 - DNA, 4261 bp, Homo sapiens
aatgcatagacttaccattgggttacgtcttgataaagccatcataaactaaaaatatctgcatttagtacagctaacctaccaaacatcatggcttaacctagcctaccttaaacatgctcagaataattaacattagccttcagttgggcaaaatcatctaacgcaaagcctattttataataaagtgttgaatatttcatgtaatttattgaatactgtactgaacgtgaaaaagagtggctatacgactactccaagtaccgtttctactgaatgtgtatcactttcatatcaccaaaaaactttaagtggaaccatcatatacctgggactgtctgtaattcaaaatctttctagacaaggaaggaatcaccagtagcactgctgggctatgggtaggtgggcaactacctactaggtgtaaatctgtcaaccaaaaaagtaaattatggtggctttaagggagaaaatgttcctctgaatgtgtttaaaatcccatgggtgtagctacttaaatgaagaaatctggtgagtacttagctatttaaaatttaattctttgcaggtacttactttacaagaagtattcttatatagagagattcatattgctataaatatgtacataatagctaacatgcgcttaccactggcagacactatgctgttatttaataggcaataatcctatgaattagtattattagtatcaccatttttcagaatttaagttttcagaggcaccaagagtttgaactttaagacatttagctaataaaaaaatgtggccaggatttgaatccaagggaactgaattttggagctggcactcttaaacactatacaatgcagttaaatatatgtagtttactgcccataataaatttttccaaaaaagagatggcttcttaaaaattttaaattagattcagattagtatagacacttgcaagtcaatgatgcttaaaaactaaactaaaaccctatgccagttgagtgtttatttcctggaatgtttactcacatacaccttatggtggagaggggagtttataattggccacagagcctgagacctaatatttttgaaatcataatatattttacagtacttcacaatttacaaagcatatttacatacattgtatcacatgaacctcaaaataatgctgtgaaatggggcagataattctgtaaacaggcattattcttaactttatagatgattaatgaggcttacaatgataagtcatttccttaaataacacaattctctcaaaatctaagatgttccaaatgactgaatgcattatgaattagcctatcataggctttatcatctgtcacataacatttaaaaaaagatttctcacaataaaccaaaataaaattttactttattttatttctgctttatctacaataaatattataattcaacagtaattactattgttgaactagcaaaacccacataacaaaataaaaatcagaacatgaaaagctatagtaaggagaatgagaacaagtatggatcataaaatccagaattaggagcgaaatggtccaaaaattatgagattaagatcaatgattacataaagcactcagcatttttgtaattacttaaatttgtaaagtgccttcaaaaatttgttactcttttataatccctaagagatcactgagagacaataatagcctttacacagcagatgaagaacattttgaaagtactatgaaattcagttattatttttgtttaaaagaaaacatcttgtgattctaaatcacaagagcccgaaattctttctgaatataagcaatgccatttacaaacattcctgctgcacccatcttctacaccccctgttgtaatgaattcgcatacctgcctccgattacaggctggattgccccaaagtagtcttctcagaaacctatctacacagttagcttctttctcttgtgcatcttcaaactctctttgtctttagcatcaacatgatatactttctgatatttcccatcttaaacttttattgttttttcttatctcaagaaaaccctgccttgactcacggccattcctccagttgtcacaattccatccctcttctcctttagaaagtcaaacttctcaaagtatggagaaaacaataaccatattttaaattggcaatcaaacttcaacttgctccatactggcttctgatcccctaatgctctccaaattcctcttgttaggtcgccaaagttaaatgaattctttttagtttctatcttatttggcccctccagctgtacttgatactttgtccacacctttccttcttgaaacctccctctcttggctcctacaacaccatgctctcttttctcctaaatttatggccatttctcaatctcctttattggcttcttctcaactactaaatgttagaactactcaggactctgggcttttactatatactccatttcctaggcagtctcatacatgccctgggctttaaataccatctatctgatagtatctctaatatagatctgtcttctgagttccagaacttagcaattctattagatgtctcctgggtattgcaatactcagtaagttcatatctgacagagaccttctaaactgtttatcttttaacctttcctatttcactaaatggctcttccaccatccaactagttgcaaatgctaagaacctaccatattcaaatgttgccatgccttgtggtgttcatactacttaccaagatatgtcaaatcgatgtcctcctcttcatctgctgtcatctccccagtcaaagccctcttatcttgagcacactgtttcaatagcttcctaactagtttccttctatctttgctcccctccaattcactctccatacagcagccagaattattgtttaaaaatgtatactgggtcatgtcctgcccctaagatacggaaatggctctttcttgcatatgaaatccaaatgcggccttgcctgaatctaatcctgcctaggtctgcagcttcagcttgtgctactctagccattactcctatgtttccatcatgactgattctctttcagtttctcagattcaccaagctctttgcatgtgaattgggagtaaaatcgtccaaaaattaagaggttaggattaaatgattacatgcctttcctttgcttagaatgttgttccacactccccactttggcttcaagactttgttaacacagttctgtctactgagagtgtcctttccctcatctctgcctgatgaagttctattcatctttaggactgatcttaaatgtcatcttcataaagtcttcctggtcaaattttccctgtaagcatactgagttacttttttctccatatacctaaagataattttgcatatgtctctgttataacatttatcaccgtactgcaatcattttttaaatttctgccacattagaactgtacaatatgagatacgtgaatataggactgggccttctttagatccccaaatttagcaggtgcctaacatcatccaatctgtcacccattaatattgctttaagaataagagccatcttacatggcaacaaccactagtgaagattgtatttattaacttgttagtgtttgtcatcacggtgacatacacatattcagaaaaatgagtcaatattaataattaaagacgttactgtgatgaagtttcctgaaatctgagctcatctgtatacccatatccaatgacttgaatgtctcaatcaattcattggctagcacaattctcaagccttattagggaccataatttctatggttgacatcttaatgctgagtaggagccggaagctttgtggactctcaggttcatgcacctgaaagtcctgtgcttaagtgtgtgcatgatcttgctcagaagcaccaagaacaggggtgagaagagagaatgtagaacatccattgttatacaagaggcagtgacaacagagatggcctatttaacttacttcaaaagcctttaattctcaagcaccaggaaaacaattttagagctgactacaatagatcttttgctagactgttctgaagactagttttttagaaagtaaaaccatattaccagaatattaatccacaataaggttgaatacaatttgttaaagaacagactccatgtactattacaaaaatgaggtctgacctgaaacaccatccatttgaaatatttaaaaaaaaaaa

SEQ ID NO: 222885 - DNA, 463 bp, Homo sapiens
actgatatgtgccatgacacagataaacttcaaaaacatgttaaataaaagaagccaaacaaaataccagcatcgtatgataaacgtccaaaaaaagccaatccatggggacagaaaatagatcagtggctggccatggctagaaacagggattaactgtcaacgggcacagaggatcttacattgtgggtgatgaacaaatctaaaactggattctggccatggttgtgcaacttgataaatttactacaaatcattttattgtacatcttaaataggtgagttttatgatatgcaaattctgcctccaaaaaaagccattataaaagagagagaaggttgggtgcagcagctcacacctgtaatcccagcactttgggaggctgaggcgggcggatcactttaggtcaggagtttgagaccagcctggacaatgtggtgaaacccatccctactaaaaata

SEQ ID NO: 222886 - DNA, 406 bp, Homo sapiens
gagatgatgatgtataacagtgtgtgacacattagtactatgtaatagtttgccactggtacagtattatcttttttctttttttttcctgattcagatcccaaaccccgctttgtaggtgcaggaaacaggagacccagaagtgtaattccttctagtgacccgcctaaagagcaggtcaaaggacaggaaggagatttagatggtttaaaatctcacagcggaggggattaatggagggggcgggcaggtgtacagggtggagccttcctgatcccagggctgaaggatggcggtcctggcccgccagctgcagcgtctcctctggaccgcttgcaagaaaaaggagagggagaaggaggggagggaggaagaggaggaggaggaggcggggcgcagggccccc

SEQ ID NO: 222887 - DNA, 392 bp, Homo sapiens
ggaaatcgaggcaagaagagacaaggcggcttctaaaatacggggattcagtcctacaccaaatgtctcccagtgtggaattttttaaaaagatattgatccagtaggccaggtgaggtggctcacgcctgtaatcacagcactttgggaggccgaagcgggcggatcacctgaggtcgggagttcgagatcagcctgaccaacatggagaaaccccgtctccactaaaaatacaaaattaggttggcgtggtggcgcatgcctgtaatcccaactactcagggggctgaggctggagaatcgcttgaacccgggaggcggaggtcgcggtgagccgagatcgcgccattgcactccagtctggacaacaagagcaaaactccatctcaaaa

SEQ ID NO: 222888 - DNA, 422 bp, Homo sapiens
ccttcatgtctgcatggtctctcagtcatgtcattctgtaccaaggtcttattactccccaaacccaggcattcttttgaggcatcaaattctgaggctgggagtttgatgagtttcttgcctctcctgtcccgtggtaggtgtgcccaccacctgtggacactggtgctgctcaccacactcttccctggcaccacgctcttctcctggacaccaccggcttcccttccctgtgttagggttggcagagcctgaaaagctgggaaagtggcacagactgtatcgatatctttcccactttgtgaatgacctcctcatattctccaggaccaaccaagctcttggggcctggggcacatgggaaccatgcagtgtggcctctcaggggtgcagggagccccgccccagaaaggcagagggta

SEQ ID NO: 222889 - DNA, 429 bp, Homo sapiens
cctttttggcaccagggactggtttcgtggaagacagtttttccacggccagtgggagagggttgtatgggcatggtttggggatgaaactgttccacctcagctcatcaggcattggttagagtctcataaggaacatgcaacctagaacccttgcatgttcagttcacaatagtattcatgctcttatgagaatctaatgccaccactgatctgacaggaggtggagctcaggtggtaatgctcacttgcccactctcacctcctgttgtgccacccagtttctaacaggcctcgaactgctactgttccatagcctgggggttggggacccctgcatcagaagatatattggttgaaaataatcaggttgaaggatgaaaaggagaaaaaaagactgtaaaataaaaagtatgagatgtataagta

SEQ ID NO: 222890 - DNA, 656 bp, Homo sapiens
cgcgtcccagggggcacctgcctagaggccaggcactgcactggaccctcagacacagcttgtgcagcctgcttaggagcttgggaaatgactgtcatctgtgatcttgctggtcccaggaagcccattttacagatgaggaaactgaggcccaaaggcacgaagcgacctctctcagcctcaccaagagcactggaaggtggtgtagggctgcggccgtgcgcacagagagcacagcagcaggaaggctcctgggcctccagctcccctccctcagaagcctcccagagtgacaggaaggtcagaggccccggggagggggcggggccaggatctggcaatttcctatccctctctgttggctctgtgcatctaattactccttgagtcatctgttgctaaccaggaggggaaattaaatattaataatgtaatacttctctgtgattaccccttgttggggacagatcagagggcagatgctgccccatacagacaggggacacatgctgcggaatgtgcataatgcctcttgaaagaaccaccttataggattccacgcggtcagactcaaaactgctgctgcttcctgccttcctcctcacctcccccaacctggccactttaattaaaactccatttaatcaaaaaacaca

SEQ ID NO: 222891 - DNA, 554 bp, Homo sapiens
ccacgcgtccggtttcaaaaaagaagagtaagtcaaaggttaaacttttggggcggaggaaaaaggataagaaagaggatacagagtttaatcagagttggcatcagatagagtaaccatggacatttggaagctgtaacctctctcatatttcgccaaggataactgcttcctgtattatcatgtaatgagttttatgcgtgatggaaaatgtaaaagtaatcttaacccaaacctgcattttaatgccacatggaccggctgtaatttatggcatctttaagatagatgggtacacatattatgaatatactttccttttgccagaccttgacattctgtagacttttaatggaatattatttgcctctttcatcttaccttgacgtatgaggtggatggcttacgtgcagggtaatgtatgaaccttcccaagctctgtacaaatataacttgtcattcgtagagacgtatgtatttatatgtgtgcatgcagtcttatttgtagattttcttcccatttgcttaatactgaacgctatggcctagatgtg

SEQ ID NO: 222892 - DNA, 494 bp, Homo sapiens
gctgggaatttagccccaggcccaaacaaacacgacagaccctttcaacgctaatcttctcgggtcaggaggcttgtgatattttgctatctttcttgatattttgaacccatcacaaggtctctaaacagggacttcgcttatacccagggcccctgaaatcacaaacaaaagacaactgtttttaagtagagatggccttggtagtttagacctgaggagagtcattcaaacattaattagaagacagattaatcagttaaagttcgtggagttaagacattaaacaatggggcaattaaacatgctagcatacccggagtctgtgttgataaactacctagaaatgtatcttgggagagtcttgaggattgagggctggaaaagcagcgcctgtacctgataggatcgcccctcctccgagactttcagttccattcctctagtccacatcataaaccaccaataaagctgaatttaaatcccagctatta

SEQ ID NO: 222893 - DNA, 392 bp, Homo sapiens
agggctctggcatatgcattgggcctctgtgaggttttaatgaatgaaggctgaagaaactccacagagatggtgactttcccccagcacagctcttgccctcaaggaagagacactcgaccaaacaggcaactggaaacaggatggcttcgtgggcgtgtgtgacttacacagggctgtgcactcagaagaatcccgtgactgacttaggctctgcagctgccatcttgaaattcttaataacttttgaatggtgttgggggtggggttggaggggatggtccacactttcattttgcactgggcactacaaattatgtgaccggctctgattaaaatgctacaagaactaacatgaaactggacacagaaaccagaccccagagcacata

SEQ ID NO: 222894 - DNA, 351 bp, Homo sapiens
agggctctggcatatgcattgggcctctgtgaggttttaatgaatgaaggctgaagaaactccacagagatggtgactttcccccagcacagctcttgccctcaaggaagagacactcgaccaaacaggcaactggaaacaggatggcttcgtgggcgtgtgtgacttacacagggctgtgcactcagaagaatcccgtgactgacttaggctctgcagctgccatcttgaaattcttaataacttttgaatggtgttgggggtggggttggaggggatggtccacactttcattttgcactgggcactacaaattatgtgaccggctctgattaaaatgctacaagaact

SEQ ID NO: 222895 - DNA, 676 bp, Homo sapiens
taccacattacttgtttctttataatactgtttagtaaagttatttgttatcacatttttggtgtgtttatggctcctaactcccaaccccaaatctgtaaactctttgtaggcaagaaaactatttattctttaaacgtttcaccaatgcctagtgtactgcctagcatgtagaaaatgctcaataaatttaattgcttgaccgactagagcaaaatagattaattattctcagtatttttttaattaaaaattccatctcattcacaacttaacagatgttaaaatattaactgtcttttcttgctggtattttctaatttttcctataccaaagaggctccaaaaatttgtttttatgaatatattattcatgggagggtcagtttagtggcagagttagattttttaagatagtagaatttcatgagatggagtgaaagctctagttagacatggacctcagagctggaagcccagaatccaatccagatttaacaatggcttgttgcacagcatggagaagttgatttaccttcttataacagtttcttctttaaaatatagattcagtattagtcaagtcccaactatacagatagggatgttggagaattaattaaagagtatctataagattctttgacttgactttaaaatgtatcattaaagtagt

SEQ ID NO: 222896 - DNA, 418 bp, Homo sapiens
ccactatattgtattgcagcgaatctcccttttaaatgtattaatatttgacttatatatttggatgctctggtgttgggtgcacatatatttaaaattgttatattgtttggttgtattgactcctttatatcattatgtaatggtgttttttgtcttttttcaaaatcattcgttttttattttttattttattttttcacacatttatttcagcaaaacatcatcctttgtattaagttaacattaatttggattttagagtttatatggttttgtttttatcttttatgtaagttaattttggttcttcagttgtgtaaaaattacaagggaaatgaatttatatataactagttaaaactgacacatacaggatacacattacaataaaaacaatttaagtcaatcctggaaa

SEQ ID NO: 222897 - DNA, 432 bp, Homo sapiens
tagttatttcacagatgccactggggtaggtaaactgacccaactctgcagcactcagaagacgaagcaaagccttctacttgagcagtttttccatcactgatatgtgcaggaaatgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgct

SEQ ID NO: 222898 - DNA, 641 bp, Homo sapiens
ggttgcagtgagctgagattacgccactccagcctgggcaaaagagtgagaccccatctcaaaaaaaaaaaaaaaagaaaagaaaaagaattgtggcctgagttcatggaaactagttctggatatgttctgaatattaggtcattttagagtttttgtttgtttgtttttgttttgttttttttcaggaagccttttggaagcattttgtctgattctgattcattgtgttgaattggctgctaaaaatgttttgttcatttcccactgacatgatctttgacacagcatgtacagtatcaaattccttagctgttctatgtgttgaaataattgagaactctaccattcagatttgaacctatctacataacactttgctttctgtggtatattctgctgttcccacatctccctcttgaggtcttcctctgctaattatttgcctttaaggcttcccttgtacttcagctctccatgagctgctataagcagagaaggctgattaattgaaacctgattgtgcccttcatgggaatgcaagtttgctatagtaatttggtggcactgagttcagccatctgttcatattttcctctgtgaaaacactgtgcaagattttccaggtatacataaggctt

SEQ ID NO: 222899 - DNA, 308 bp, Homo sapiens
acagctcatacttcagtggtatttgcctcttaagtcacttaccccttattactctgaacaaaactggaatccgaaaaaaacaaaaacaaaaacaaacaaacaaaaaacactggaactgtggctcatctctcagggaatgagctgacacttagtagaatctatgacatgagggctatgttagagaccctgaaatgaagctgggtgaaaaatatcaaggtgttgtgagtgacaaagatgatattccaaagattcaactgagaaagagtcagtgtatcttattattaaaattgcttctgtaagagtcatca

SEQ ID NO: 222900 - DNA, 426 bp, Homo sapiens
tcacacatgtaatccagcactttgagaggccaaggtgggaggatccctcgagcctaggagttcgagaccagcctgggcaacataacaagaccttgcctctatttataaattcaatttattattattttttttaaaaaagggagagaactgcgaggaaataaaaagagaaagggccaaggccaggtgcactggctcacacctgtaatcccagcactttgggaggccgaggcaggcggatcacgaggtcaggagatcgagaccatcctggctaacacggtgaaaccccgtctctactaaaaatacaaaaaattagctggagatggtggcaggcgcctatagttccagctactcaagaggctgaggcaagagaatggcatgaacccgggaggcagagcttgcagtgggcggagatcctgtcactgcaat

SEQ ID NO: 222901 - DNA, 412 bp, Homo sapiens
agagcacaactgagctcccagaaaacagccagcatcaatggctgggcatgtaagccagctggcatggacattccagaccagtctgtccttttgtcaccttagctacagggaaggcccatgaccccagaagtgcccatcattatgctgaattcccgagcctcagtggtccaccgaggtgtggaagcatgtctcacaagggtcagatggagttctggcctggattgatgtgtagatgcttgagggagaagctgggtttctttcagctggggtggctctgctgggatgtggtgggccttgggtttccaggtggtcattttccttatttgcagtagaaggaatgaggcccatatagagaatagagcaaattaaagggagagaaagagaaaaaagtaaggagagaggaagaaagaga

SEQ ID NO: 222902 - DNA, 538 bp, Homo sapiens
gggacttgctgtgatacctgccaagtttccttatggaggaaggaacacatacctcttctaggcagttgacataagagccttgagggttaagtgactccactgacctccacttcagatgcctggagaatcaacgtgagcacagataggctagaacttggggatgtggagctggagtgtgggtttcccacagaagttgatgggagcagagtatggatggctctacatgctgaagaaatcacttcttgtactttggcttttcttgttagggagggtaggcgagtctataagatgtcaaaaggagtttttaacactggtcttacatcactcaagggcagattgatcagagacagactggaggcttgaaaaaacatacctttggcataagagaaaaaagtattgcggaaataggagtagttcactggagagttgccaatagaagctgaaaattcttcagccttttgacccataaagtacttggaaaaatcttatactgaaaaaaaaaaatcaagttgcagctagaccagagggatgtagaatc

SEQ ID NO: 222903 - DNA, 702 bp, Homo sapiens
gttttagggtcagtgaacagtaatgatttaggtatacagctaggacctacatttaaattcttacctgtctactaaaaaaagattataaattttcatcgaagattaaaattatcaaacttttttaaaagaagcctttttttattttgagacggagtcttgctctgtcgcccaggctggagttcattggcgcaatctcggctcgcggctcactgcctcctccaccttccagattcaagcgattctcctgcctcagcctctcaagtagctggcactacaggcgtgtgccaccatgcccagctaattttttgtatttttagtagagacagggtttcactgtgttagccaggatggtctggatctcctgacctcgttatctgcccgccttggcctcccaaagtgctgggatcacaggtgtgacccaccacgcctggctcatttatttttgaagttccaggtagggtaataatatcttagcttagctttaaacagtcttaacagtcataataaagttgaaatgcctttaaatgttgtacctaatgtagtgcaatgaaagagctctgtgtaagggcttttctttgtattgattaatttgagatgacttattaagtagtgggaaaccctaacagttggtttttgacaggaaaaaaaaacaccttaaaatttgttttttagggtggaaaaacagggaaaaggctgatgttt

SEQ ID NO: 222904 - DNA, 2503 bp, Homo sapiens
  misc_feature (1299)..(1299): n is a, c, g, or t
agctgattttctgacagccccttctcctctcctcactggatatccagtttccagggtctgtgtgtggtgggaagcaaactggcctgaggttccatccactggtagaaatgaccccaaagacttcccatgcagggagggcaaagaagaaagtgctttggaatggagataccccttttcctcctcctgaatgtatcagagttagttatcaatgctgactgagtgtgcactctcctagacaccatggggagaggcagaagaggaaaccagatatggtccttcttcttgggactctcctgacctaggaaaagagacagatgaatgcagataactgagtctatatacagggactgccacaagctcacactttactgaatgttcagacctagtcatacatcctaagggcattgttggaagcttctggaactaagtctctggggatttgaatcaactcagaagactgactcattcacttggctgtggaggctgttccagatattaggagctatgtatgtggagccccggatttgggccaaaagatgcatttgactggagagaagggattgagatttgagcagttgttggacaacacagaaatgaaacagccatagcaaacttgcctgccgtgatttctctgctgagataatgggacttttcagactccctgtaactgagatctagataaaaagagacgtctggaaaaaaactggtcccaattgtcgcttggctttgctttcataactatctgagtgtggcatatgtcagactttgaaatgctgggtctcttggaaatacaaataccatctgggtctggataattcccagaaacctaggctactcagtaggaaatgaggagctggaaacataataccgagaccaggggcttgtccttgggccaccctgtctcgtgtcctggacacagtcacatgactcgtacagaaaatgtcactgggaagacaccataaggctcatcttttcacgacacagtgacctctgttatggacatcttgatttctctttgagaagccatccctcccccagtgtgtatagtctagcagccaagtccgccttgcctctggccaagggcagcctgaaactcaaacagggcccatcccttatccctggatggaaatcttgagcagagtgcctgacgggactgaagatggctgaaattccagcaagcagacagtggttctctgaagaggctcccctccgcccacacccatgagtgtctgctccccagatgctccaatcctacttctccagctttaccttctgttccataagctgcttcattttctntctccaaatccctcttttgctggttggacaaagattgtttctgttgcctgcaatcaaataacccaaaaggatgaacaggtgaaatcataaacatacttttaagtgcctggaatatgcctgcttctgtccatctttcaacccacttgcatcagaagcccccttggaggatgagagcctgtcctgtgaaccatggtggttcagagtggaacacagcagagtgtggaacaccaggaatttagagcaatcagtgaaatatgatgtaggcctctatgtcagaaaaattactaataagcagttgattattagtaatcaataatagccttcccattttatatcgagcacagcagtcagcatgttaaaaacaaggactgctggacaccagctgcgatgaaatgctttatcagaggacggcccttgatgtctatgtccatttgcaagtgcggcattaattacaaggctggtttaagtataatcagtaagtttatatgctggatgctcaagatgatttctggctaaacatggaatttctatttctattttccttatgttaaaagccggaacagcaaaatgtattcctaatgtcactattatgacatttacatcccgaaaagttgcagtaactgatcaatacaatagtggaatgcctggaaacctgttccttttttgctaaaaaaaggagggcactttttatgtctttgatgtgaagttcatgttctttgacagtgattgatggaatatgctacagaaaaggctgattacattttactagagaagtaaaaaagaaatgcaggagaatcccacagctctgggattgaatggaaagcaaaggaggagctcctctagggggctatgggatgcctctgtgtagctattgaatctctggggccatggatgagaatttgcttggtcagtaggtcagcattcaagagtatgggctggatgcagagtaaacgacctgctgagagtaatggccactgctttacttctgtcttcaaaatcctgaacaagctcctcttttggccaactctaacctggaaccatgcagattaggaagagaaagagaagtggattgtgagaaagattttagcttggtcaagttgataacgggatgattcagaagaatgcaacccttatcaactaggtatatctcttttttcctacatttattgtccaaataaagcaaaatcatgctttcacctgcctg

SEQ ID NO: 222905 - DNA, 420 bp, Homo sapiens
gatgtcgacactggacatccttcccagggaggtagttcattcagtcatggaacatttcaaggtgggaagaaggtgttcatcacatggctatgatcatgtacccattgcagaccaccctgtcctgggggcatgaggagttcatctcctaaatcagtggttctcaacagggacagtcctccctccccagaggacatttggcaatgactggaggagttgctactggcatctcctgggtggaggccaggcagggctgctgctgaacatccctgtctagtgcacaggacagcctccaccacaaagaatcatccagccccaaatgtcaacagcaccgaggttgagaactctgttctaagccctgaaattatcatttgacaagcgcaattataatgcaatgtctttttgatgcaccaaaggcattaa

SEQ ID NO: 222906 - DNA, 464 bp, Homo sapiens
gttctaactttttggttggcaatgaatcactttttaaagtatgtgttggccaaataaaatagatatccagtcacccgcatgtgattcttaattgtatttttaagataaaccaagcaggagacatttaaaaatcttctgtcacttacatgtctctggctacacatgttgtcttataccaaccaggaaaggacaacggatcatttcctggtcgtgctacccctttacccacgtgctcattcataccctgtgatgcatgcaaatggcaccactggcctgcatcctacttcgtgatagctggttcttgctcagaaatccaagagaacttaggcatcagttatcttgtaggtgatatggccagatggtttggaataagtgtgcctcccatttctaattagagctcatccctgtgttctgcactgggattgctgttgactcctgttatttcttgctaatccaagctggaa

SEQ ID NO: 222907 - DNA, 720 bp, Homo sapiens
tttaagatttcttaaaatctttcagtgtctagaaaaagtaaattaagagttttaaaatagttataattaaaaatttgaaatgttcacaaatacctgcttttaatttcatacccaaggaggcttactgatttccagttctaaggcttaaaactatacatttcaaaattcactgtagcatatctctctcacaaaaggaagactaggcagttctacactacaatgaaatttattgccagaacagtcaggaaccctgcaaagaatacagtcagtgatggtaatgaagaaataaaaagccatgaacaagacccaggtttcccctttcttctaattcatatagaagtcatccggctctgcaaatatttcatggatatgttttatcttagagaaagaaacaacttacacaatatgcccctgtaccaaacctgcacccctgaatcttaaatagaaatggaaattgaaaaaaaacttaagctctagattcctcctctctctgggcagggcatctctgaaagaaaggcagcagctccagtcaggggcttatagataaaacttccatctccctgggacagagcaccttggggaaagggtggctgtgggtgcagcttcagcagacaaacattcctgcctgccagctctgaagagagcagcagatctctcagcacagcgcttgagctctgctaagggacagactgcttcctcaaatgggtccctgacccctcg

SEQ ID NO: 222908 - DNA, 545 bp, Homo sapiens
gcctgtaatcccagttaacttgagatgctgaggcaggagaatcgcttgaacttgggaagcagaggttgcagtgaaccgatatcacaccgttgcattccaaggcaagactcaatcacacacacacacaaatcatggggagaaagatgaaacctgtgttcccctttttttggtagtgcccacatctggtgccccatttttaataaccacaggatatttctttagattgatattctcacaaagaagaaatagaatataggctgggcgtggtgtgtcacacctgtaatcccagcacttacggaggccgaagccagcggatcaccagaggtcaggagttcgagaccagcctgaccaacatgatgaaaccctgtctctactaaaaatacaaaaattagccaggcatggtggcatgcacttgtaatcccagctactcgggaggctgagacaggagaatcgcttgaacctgggaggcagaggttgcagtaagccaagatcgcaccattgcactacagcctgggcaacaagaggagcgaaactctgtctcaaaa

SEQ ID NO: 222909 - DNA, 747 bp, Homo sapiens
gcagtggctcacgcctgtaatcctagcactttgggaggccgaggcaagagcatcacttgagctcaggagtttgcaaccagcctgggcaacatagtgagacctcatctctatgtatacaaaaattttttttggaaagtttttcagaaagttaaaactattcttagtttgcagattgtacagacacaggtggcaggccatacttgacctacaggctggactcctgggtgagatgaagcgattcactttctacatggttggggggcaaaaataccaaaagaagactatttcatgacatgtgaaatcccagtttccagcattaagtcttactggcacacagccagctccctggtttatgctgtccgtggctgctcccgtgttgcgacggcagagctgagatgctgtgacagagatggtgctcggcccactgccgaagtcagccccagagtgaggacttgagttgccctcttggcctgcaatgcctccaatattcacctggccccttacagccagtttacctgccctagacctggcccaacccctagcccagagactttttaatgccgtggaaactgaggcccagaacaaacttcccaggttctcacagagcattcgtgacagagcagaggtctcttctgagtgttctagcagaggcagccagaagacaaaggaaaaagggaatgagatagaatgcaggagagacgacagtggcctgtgacctggtggacatcacccctgcaccaaggggtg

SEQ ID NO: 222910 - DNA, 355 bp, Homo sapiens
ggaacaaactcttgatacatgcaacaccatggatgatactcaatggaattatataatgaaaactctttttttgtctggcttctttaactgagcatgatgactatgcttatttaaattctacttatttagaattctataaattgcaaatcaatttgtagttgcagaaaacaaactatggttacctagagatggcggggggagggaggttggaggggctgtgaaggtttagaagggctcttttgagactgatagaaatgtacacttccttgattgttatggtggttgcttgcatgcatacaaatgtcaaaactcatctaatggtacattttaaatatatgcagtttattgttcatga

SEQ ID NO: 222911 - DNA, 362 bp, Homo sapiens
ttgaaacagtctcactctgtcaccaggctggagtgcagtggtgcgatctcaactcactgcaacctccacttcccgggttcaagcgattctcctgcctcagcctcccaagtagctgaaatgagaggatctcttgggcccagaaggtagaggctgcagtgagctacaatcacaccactgcactgcagcctgggcaacacagtaagatcttgcctttaaaaactaaacaaataaatcaacttttttaaaaaacaattttttcccttaacggtattttctagcacctaatattaaatacacatggtggttatttcatgttttctaggaaacaagtaactaacataaaaacaaaaaataaataaaat

SEQ ID NO: 222912 - DNA, 315 bp, Homo sapiens
attcaattaaatatttcctgaagatattaactccttagaattctattcccagttctctgctcttattctgcaggcctcatatagattaataggtaactccacctacactatgactttaactatcattgatatgctaatgactccccaaatctaaatctagagccattactctttggttcaagaaccacatatgggctggtatagtggttcattcccataatcccagtggtttggcagctcgaggctggaagattgcttgattctaggagttcaagactagcctgggcaacatagtgaggccctcccatctctaaa

SEQ ID NO: 222913 - DNA, 404 bp, Homo sapiens
gtaggattgttatgagctttaaatgatctagtccatgtaaagacatagatgagggcttggcacagagagaacactattgtttaaaaatagggtgacttaatgtgtgtaataagtaactggttcattgcagtgtacaaacatgaagtgttttctttttattcagctgacctctatcaactactcctttcgtatctcaatatcttgggcccagccaataagtaactgggcactttgattttcaaactcagtccagcccagcttaaactttccacctcccaaacttgcaagaggtggtctctggcttcttctgagctcttgctcctccagtgtggtgggtgagggggaggaagggagaaaagtaaagtctcttcactggccatgatgatgaggatggtgagaggaga

SEQ ID NO: 222914 - DNA, 600 bp, Homo sapiens
tataatgaagttattgagtacttatcacatgcaagacactgagctaagaaatcttaaaactcaaagatacataatatgtagtacctgcatgcaaaattctaccagtctgatagggaaaagacaatgtgtataactgatacacaataaaaggcagaaagtcatgtgaaaaaagagaggaagagaggctttcttatgaaaatccaaaagaggtcaggtgcggtagctcatgcctgtaatcccagtactttgggaggccaaggcgggcagatcacttgagcccaggagtccaagaccagcctgggccacatggcaaaaccctgtgtctattatacaaaaacataagaattagccaggcatggtggtgcatgactgtaatccagctacttgggaggctgagataggagaatcacctgagcctggggggatggaggctgcagtgagctgtgatcatgccactacattccagcctggctgacagagcaagaccccgtctccgaaagaaaaaggaaagaaagagagaagaaccaaaagaggaagaatatctttgcctctatttacactttgaaacccttactttcttttagaccaagcttaactcct

SEQ ID NO: 222915 - DNA, 574 bp, Homo sapiens
ctgacgccaccaatcaaccatagataagttacttagccaacttgtgacttaagtttcctcatttttaagaagtggagataacaatatcagcaataacaataatcaaaacaataatgtcagcaagccattaacacattagttccacccagtagagacacatttctaagtgtatgttagacacttactgtttcacccatctggcatttctatcactccatttgccatggaaatggattccatgagaagagaaaaaaagaggagcttctctccaatactttcaacagaggagacaggaagagggagaaaaaaattttccagtacaatatccaaagcccagccaaactgtgaatgcctacaaaccactcagagaagtttcttacgtcacctttgtaatgggtaaagtggtagtaatattatctcaaatggcaggtggacagattttggaagtagtgagttaaataaggcagctttgtcgtagactcatacatttccactcatagccctgccctccggcacccccttgaccctctggagttccttggaggacatgaaaatgtgaactcacagccccagg

SEQ ID NO: 222916 - DNA, 317 bp, Homo sapiens
caggatttgtcaccaccttcagtgtgtgctaatgtgtgtgtgaatctctgcagaggaggtagtgggaggatagattgtagcagtgagtatttaccaatttcatttgactaacaggtccccttttctacagagagccccacccatctttttatccttattttataaataaagagacttagaacttgttcaaagtagcttgtcccagattaccaagctagcaagaggtggacttgggattcaaatccagaaccctctgtctctctctctctctctctctctctctcagacaggttctcattctgtcgccacgtcgacgc

SEQ ID NO: 222917 - DNA, 436 bp, Homo sapiens
acacacacaccattaaacaaacaaaggccagtgggtctcttggctaaggattctatggtgcatatgcaagaaatgctactgataaggaatgttatatcaagtttctcaagagtggataaagctgaccaatctagctgctatacttggagaggataatatggatggtgtaaattagaattgtatataagcaataagttagaatatggacagtcttttttttcccccttttttttttttttaaagaaaatggacattctttcatgattcatcaaaagaatcattggagaaactgatttatcatgtgacctcaagtgtttcttggaaaccttttggaggaaaaagaaattaaacatgctgaactggctgaaaaaaatatagaagaagcactttcagatcatattaaatatatacaaactggaaagaatctatgcacaca

SEQ ID NO: 222918 - DNA, 355 bp, Homo sapiens
gtcattcttgaatgtatctctcattgatatgatcagtgtcagtatgttttagatgaattattagatttcaggtaattttggagctgtgaagctctgaaagctgcaaagctctgaacttctctgaaagaaaagctctgaacttctctgaaagaaaaatgtatacgttgaagccaggaggcatactttttttcttgctggaacacccaataagatgatgagcattaaaaacaagtttactgccttaacaagatatagaataaaataatgaaacaataattaaagtttaaacagattggtgatacatttctacagtgtttactctgtgagaagggaaggtagaggtcaagagaagaaa

SEQ ID NO: 222919 - DNA, 423 bp, Homo sapiens
caccgtgcccagcctataacagaatttgaataaagttctagatgaacaatgaaggagcaactaattttgcctgatgaggttcagaagatttccctgaggaagtgacaagtgtagctgggtcttgaaggataagtaggagtttgccacgtaaaaaagactagaaaggcaatttcaggtgaaaggaaacaaacctaagtgcatttcctactgaggagaggggcttaattcagtatgatggaaatcagcaagggttgagtctggaaaaataaaattgggtcaaattagggaaggccttaatgtcttgttcaggactttgacttttatcctgtagggcaggcctatcattctcacaagtgtgatccgcagaccacctgcatcagaatcacctggagtgctttattaaaaatctcacctcacactcta

SEQ ID NO: 222920 - DNA, 454 bp, Homo sapiens
gtatcgacgtgagattttgcaaatttgaaccataggttatatttgtaagattgttctctcagttattaagagtttgaaattggggttgaactgtgtctaaagctatggtttatgtgtatgtttagtttatgtagttgctgtgtgcataacatttggcaggggaaaatgtttttactttcaaacaaactgacaagaaattgttccatcttgaatttgtgtaagaacgtttcagaactaaaacaaacttaccaaaactaggtcttgtccattaaatgagataatgcgtgtaatgtgtctagcaagtacttggaaattattattgttaagactgtcttatagtctaacttatcaactacaatgatgcctcttctgaatttcctaatttcttgcctttatctttttttttttttaattatactttaagttctgagatacatgtgcggaatgtgcaggt

SEQ ID NO: 222921 - DNA, 434 bp, Homo sapiens
tacagtcagtcagacctggtcttgagtgtcagctcttggctctgcctgttattatttgtataactttgagctatatactttctctaagcctcatttttcattttttttgaattttaatattcttaatatttttaaattttgtttcaagttctagggtacacgtgcggtatgtgcaggtttgtttcataggtaaacgtgtgccatagtggtttgctgcatctatcaacccatggacacagggagggcaacatcacacactggggcctgttgcggggtgggggtctagaggagggatagcattaggagaaatacctaatgtaaatgatgagttgatgggtgcagcaaaccaacatggcacatgtatacctatgtaacaaacctgcatgttgtgcacatgtaccctagaacttaaagtataataataaaaaaattca

SEQ ID NO: 222922 - DNA, 552 bp, Homo sapiens
tcatgttcactttgaaggcttcagaaccattgcttcgacttagtattttatcagcgaggtgcagaggaggccagaacatagaagtgcccatcaggatggaaagactttagaacttttcatccctttaatctttgtaaatgcaaaatgtgttgtgtcaaaggaacgtagatcttatactattatcatcaaaagatttgaagttatttttcttctcaaaaggaatctgtgatatcaacagttgcatattgtttttctgttgtaaatcaaacagcttggaagaaaaatgttgccatgttttttgaaagggcagcacaaactatgatcattatggataaatttgagagttcatcctcatgaacttttaatgtttcaactgagtggcagttgcaaataaaagcgatgtaagatcaaagtgtttaatattatacacacatacacacacactatattcaagattttaccatttgtattggaatagattgtttaaagaaattttatagttgaagcattgattgatttttccaagagtttcttttgatttacaagcttgta

SEQ ID NO: 222923 - DNA, 213 bp, Homo sapiens
agtatgaacccctaggaggccttgttggccacaaagtccaagatttttttccagtttacagattagtttcaaattccgtactaccggtactccactactacccaagagtgagccctcagtaacctcattggagtctttcctcattggaaactagattatctttacaaacccaacaattgctccagttttttgctagaacataaaccttaacta

SEQ ID NO: 222924 - DNA, 494 bp, Homo sapiens
atgttgtgtactgaaaggatcgattaaatttgaagtcttctatttcatggatagaacaatttttaaagcatttgcaatgaattcctggattctggtttgcagaaatattcattatttgccaaatgggtaatttgcactaaaaccaaagttgatgttacttcagtgcccccttaaaggaatgtgatgttttatcaggcttagaaaaactgctaccgaaatagacataaatcccttctatctgtgaccttctatggcaaaggtttgtactctttaatctgtaataatacaagtacttggcatattttaggtgcccagtaaataaatgaatcactggaaagactataccccttacactcctgccttaagctatgttaaaaatttactgggaggctgaggcaggagaatcacttgaacccgggaaggcggaggttgcagtgagccgagatcgtgccactgcactccagcctgggcaacaagagtgagactccatctaa

SEQ ID NO: 222925 - DNA, 434 bp, Homo sapiens
ggggctatgctccatctccctgccccggttgttatgtgtatacccctacaagaatactcacctcttgccttcaggtggcatttttcaactccgctggagccaatgcccaggaggagcaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatgggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcagg

SEQ ID NO: 222926 - DNA, 571 bp, Homo sapiens
tcaaagtcaggagtttcaataattggtgtgtagggatagggatatgtgatttgggcccttcttaaagtggtcctgtgttgtctgtatctgcctctacttatctttatgtctcacattgaattgtgtgttctcattccagcataaggaatacctgacactagcctcaatgaatgatgtttattctgtgagtattagatgcgtatctaaaccagttattggactctattctgtacagcactcaggagaaagaatgatgtactatgcaacatgtgggttcatcaggtgctcacttatatatgggaaaagtgtcaccatgtggtcagtgtgagagccacattcctaaaagcagctgaatcactaggaccctataaaatgtatttgctgtttctgctgccaaacacaatatgtggcattcaaacttcttgggatttcctagaaatacgtaagttcaaagaatgactgaatataagggtgcatatgaaggtggagtgcacaataaaagtaataacagggatgaaaggagaagttaccatccatggtaaatagtgtgccagacactggaaactagtat

SEQ ID NO: 222927 - DNA, 460 bp, Homo sapiens
tgaacctgggaggtggagcttgcagtgagctgagatcgtgccgctgtactccagcctgggcaacagagcgagactctgtctcaaaaaaaaaaagaatgaagtcacttaggcaaaatgtagaagatacatactctatgctttcactgaaagtctaagcacctgaatgtgacttacaagtagggtgaccataatttctgatttgctgagaatagcctggtttatatctgttgtccctacctaagtattaatattgcctggtttcactctcagtaaagtctccatttgtacaataaatttatattgttattctttttagaaggcccttccagatctagcatcttcctatatctttatcatcactgccctatcttagactccatttgccagccaggtggacataccttcatttctcatatgcactcttaacttcaaggttttttttgccaaggtactgcctacc

SEQ ID NO: 222928 - DNA, 1009 bp, Homo sapiens
ccaatctgggcagaatgtgagataaactattaaaactgccaacatttttctttccacatcaaatccaccaaagtcactgaataaaatatttaagcatctcaagacggaagagctctgcagataacttcagtataacctggttctacagaaacatgttcctactaacttgcgaaaatctggccagtagaagttgccttcttttatacttaccactttctatctcccttctagtttcctgatgatgtagaatataaaggaaagaaaaaataagccacttgcataagccaagttatggcttttgtcttagttttatttctaaatatccatggtgtataaggctttgtaagtcaaaaaatactgggaaaggcattcaaattcaaatcaaaacaattatggtgtaattttcacaataagtaatgtcttaaaactctgtttgtattcatagaaatgacataccaattagtttttcttctcagtcaacaagacaaagaggtaagcataatcagttatattataaactaaaggcaaacattttcctcaccataaacacaggtgttgatatattaaaatctgagacaaatatttcatttgagtattcaaaatattttaaatatacatataacactatacaagctgctttagacatcttcagtatttagccaaaagtggatataacaacgaattatagaactgttgcttctgtgggctgattcaagttcaaattattttgtccaggagcacaagtctctaataatttcatgcattaagcaacagaatatttaaatctgaaaatcaaactcaactgggttcaaggtacaattattttaaagggaattgaattatctctgccgaattcaagagtatatgttctacataaaggtatcctaaattaaaataatgaccaaaagaacatatctgtgataagtctggtgcttagatagacaaattatgttacttaagtgaagatttaaataacttctacgaccatgagttaatcattattttttca

SEQ ID NO: 222929 - DNA, 427 bp, Homo sapiens
atttattatcagcatcaatggaaaccagaagttaatggaataatacctttcaagtgccaaaagataatggtcaactagaattatgtacttgcccagactaccttttaagaagagtgaaatagagacatttaaagataagtgataattgagagtttagctcagagatatgcacaaaactcctaaatgacatatagtcatgcactacatgacaaagttttggtcaataacagaccgcatatacaatggtggtcccataagattatattggctgagtattgctaatccaaaaatccaaaatccaaaatactccaaaatttgaaactttttgagtgccaacatgatactcaaaggaaaggttccttggaacatttctttggattttcaggttagggatgctcaacactaagtatcatgcaaatattccaaa

SEQ ID NO: 222930 - DNA, 352 bp, Homo sapiens
cgtcgacttttctcgctgctgtatgtaccagactagcctgcctagactagcttcgtgagaattctttgttcagttttgagccccattttttaatggggttgtttgattttctgaagtccaccttcttgagttctttatatatgttggatattagtcccctatctgatttaggataggtaaagatcctttcccaatctgttggtggtctttttgtcttattgacggtgtcttttgccttgcagaagcctaaaaggcacttttatgggagtaaaatggagcaatggagaaatgactcagaagtaaagagtatgactgctttttcagaggactgaagttctattcccgtcgacgc

SEQ ID NO: 222931 - DNA, 569 bp, Homo sapiens
cgtcgacttttctcgctgctgtatgtaccagactagcctgcctagactagcttcgtgagaattctttgttcagttttgagccccattttttaatggggttgtttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggacccaacattctgctgcttacaggaaacccatctcagggaaaaagacagacactacctcagagtgaaaggctggaaaacaattttttcaagcaaatggactgaagatacaagctggagtagctattttaatatcagataaaaccgacttccaacccaaagttatcataaaagacaccgtcaataagacacaaagttgtatctatgtcgagcgatcgcgcgcccgtctacgcgttctccaatttattagttta

SEQ ID NO: 222932 - DNA, 367 bp, Homo sapiens
ttctcaaccttccacaccgcctctcatcacagagctctggtatgatggctctgttgggaaacttctctctccctggttggcttagctgacctccgttccagtgtcactgcttcaggacgcttcccccgatgctgtcagaccctgacggcaggcccctgcagtgctatgtgcttctctcccagcatgaacacaagctgcagctctatctctctgtgattcttggtcaatgttcaaatccttcgctggactgagcactccgtgagacaggaatcaggcctatttttactaaacattgtatccccagagtcaagccgggcatctggaagttggttggtgcctaagtataatttataaatggatggatgaa

SEQ ID NO: 222933 - DNA, 409 bp, Homo sapiens
atacagtggggatgatgcccacctgtgctgtgtacagatctgcttcctgtacaggcctagagacacatcacatatatgtgtttctatgcacaggtctatttctaagtgcatttctatttatattaaaattttatttaatttaatgttatctcttttcaacctgcctgtcttaatctcttcctttcattttccctctaaacacagccaaactgaaataaaatgcaaaacaagcttcatttctcctatccagcatttaatgtctttttgctaagatattacaggagaacacacaacacacgtgcattcacatggactcactctacaccacctttccctgccttttccagaaatgagcccactgtcacagggcctgctgcgttctcttaaaggtcatggggagctctgaatg

SEQ ID NO: 222934 - DNA, 412 bp, Homo sapiens
gaaattcttaagtgctgttccattagagatttttatgagactcaatactctttcgggaaagtctaatatttaggtcacctttccagtaagaaatttgtaacataaaggatgtgtacacacccaccttcccatttttttttaggaatcagagtgtgaagttagttgagactgacctccaacgaagaagcctgttttccaccagcactaaggcttttatatatttctgatccaagaaggtgacttttgcaggatagagactaagaacatttagcaaagtgtgtttgtaaaatagccaaaggtttatattgaagcaccctcttctctgtcccctaatgtgcaatctgaatgaatggaagtcaagaaagcaaactaaaactataattaaaaggcacaattactcatacaaactcca

SEQ ID NO: 222935 - DNA, 516 bp, Homo sapiens
cttaattgttcctgatttcgggaggggaaaatggaaatagcatttccgttgcatttttgtgaacaaaatttgagtgatcatgttctttgttgcatgtagtagatggagaggtgaatgaaagattcagctttcttcctgtacttgaggcatctgtgaattgggaattcagacaaacagataagcaactaattctggatataaaatttgtgatttaggctatgcattctactggggaatttcagatgtataggaatgtagttgaaatttaagtggtcagggaatgctatctagaggaagaaaattatgactagagacaagaataaatagtagtaacttaaaaaaatatatatcagggaagaaaaaatggatttttgttccaggaaagaaactaagtatgaacagatgatgaactatttcaggaactgtgtctgcaattcgttccttccagtgggttcttggtcttgctgacttcaagaatgaagccgtgcaccctggcagtgagtgttacagttctta

SEQ ID NO: 222936 - DNA, 388 bp, Homo sapiens
tgggccatagggaatttcccttttggaatcaaaatttaggagatgcaattctgagaacactgaagctaactgaaacttccatttggaagatcctattctcttgagtccttctgtgtgagctgcttcaggtttcatgctactttgccccactttgttgctatattttgtaacagcagaggaagggggaaaaaccctcatcttctgatgtttatttgactattgaggctaattgttcatttgctgaaaagaataaaagaccaagggtctctaaaatactacattgtctgtgtgtgtttgtgcacatgtgcatatatgagtatttttgcttgtacatgagtatattctttgtccgtgtgtgttagaaagtgagatgtgagcatcaagctta

SEQ ID NO: 222937 - DNA, 550 bp, Homo sapiens
gccctcggtagcctctggggtccaccccaactccacgtagccccccagaagcaaggaacgcaggctcagcatgccaggattaagcctgtgggtccaacagatgtgagctcaagtcctggctctgtcacttcctagctgtgcaacttagggcaagtgacttcacccttctgagcttccacctctgtcaatgtaaatatgaacctccctccccaggttcaaggatctgtccacttaggacatgaggcgctttgcatgggagttctgaacactgtcctctcctgcttcaaacagggtcttctcggtctccttgctcactgggccccagggccccaactttcctgaaggacctgtgcagggccctggagacacaaagatagatcctgcccagccctcccctcagggggcgctctatccagcgaaagacagacacatgggcattggcaggaaacagtcggagctcagagtcagaagcctctgctttcaccgttaaggacaggccaagacagcacagaagcagcccaggatggaaccgtgggaagccccgcaagta

SEQ ID NO: 222938 - DNA, 594 bp, Homo sapiens
tttttaaagtataatttgagttgttacttgatcgagagaaaaataggcatcatgatttgaaatactgccaggcattttttctagcgtcaatgtgaaggagggcataggattactatagtcagtcaaacatgagcttggtagttacgaagaagtataattatttcagcaagctttttttcccccttctgtttaagtagacccaattccagggcagatgtgtgtgtgagcgtttgttgaacgccaactattgtgcctagtgctttttcaagaaattttgtaattctcagtcatccagcactgaaactgacttgccctttggatccaggcagacatgggtccttgaaactcagcacagccatttactttttgtgggaccttggataaattaacctgtctgaacttcaatttcttgagtatgttcaaacaaatcttgcaatgcagagcacagtggcccatagtagtaaccttggacgtatccattaccactatttcctataggcctgcttttgccatcttttaattcttctaatgcttctcaaaaggttacatgtggtaattttataacaagaatgatcaaactcacaaacagcagcc

SEQ ID NO: 222939 - DNA, 513 bp, Homo sapiens
actaggtacttttattccaagattcaaggctgattttctaaatgttggcttagaggtgctactctcagatcagaggccagtgcattcctgaagaagcatgatgactgaatgtagagtgggatttctctcactaatagctagaaagtgttcgtctcactcagtgggctaaagagaatcaccaggtatgagaggttgtcacagagaaacttaaaaagccattttcttaaccttcttgttttggactaaagtgaattgagttacttgcctggggcatcaagttaaaaggaggtgtggaaaactgagatcaagatatataatattttaatgtagcaacttgtcctcacttgaatcaccctaatcttggccctgactgagatgctgacatgtctaaaatctcatttatggaaagatctaaagataaaacttccacaaatctcatttatggaaagatctaaagataaaacttccacaaatgtggacattcttactgacctatgcattggtgttactatt

SEQ ID NO: 222940 - DNA, 376 bp, Homo sapiens
ctgcacgagaagagaaggatgggactcattaatagaaatcaaattgcgaggaaccagaaaagtgagagccaggtagcattaacagtctgtgtttgagctaacccatgcctcttgttaggcaaaggaaagaacacagcagccagaaagtggcgaattggaactgtaaccagggcgcctgcagcatattcagaaacgattcctccgttgagaaatggctgtggtctcttgcgtcagaaaatgtaggaggcatagggtccagtgaagccttgtagagaaaagtttttgtatttgcatttgttttggtttttgtttacacatagagaaagtatttggccagacactgatatgtatttttctacgttgtgtgtatgtaggt

SEQ ID NO: 222941 - DNA, 542 bp, Homo sapiens
cctagtgccagagtcaaataggcaagcagagttgagggactattaagtgccattgtttcaagggaacaggtgctaaataccagtctgaagtagctctgccagcacacagccgctgctccaagccaaggggatgtaaacttagggggagtacagaagcataaggcctctggaataacaacagccccaaagtgtcccaaagcctcttttttctcaattctagagcttccttgactcttcatactcagccaatccacactggcttcagtgcctccatgtacactccttcctgtgggggttagctgggtttttccagacacgacctctgagtacaactgaggcaaagaatcccagagttctttgggaagcagtgtgttctgacttcaaaggcattcccggtgcatcagtcagaaaatgaaaaccacttatgccatggcttacatacaagccagctcattatggggggaaaacacgtggagaagaatgctcgctaggattgctctctgaatagcagctgtgggaagcaggccccagcacagaatgcc

SEQ ID NO: 222942 - DNA, 458 bp, Homo sapiens
actattattgtacacttatgtgtcaggtactgttttaaacacattgcataacaggttattcctcatagcaaccctatatattgtgatattattatatatatttttaagttttattattattattattattattacttttagagatggggtcttgctacgttgcccaggctggtcttgaactcctgggctcaagcagtcctcccgccttggcttcccaaagtgctgggattacaggcatgagccaccttgcccagctgatactataatgcctgttttgcagataaggaaactgaagctcagagaggttaagtaacttatgcaggatcacagcgagtatgtagtgaagctacttttgaaacccaaagtatctcagttatgctgtactacctctcttgaggataatgatgctcaaaaaagtgctttgcgaattgtaaaacacctaccaatagtgactaaaa

SEQ ID NO: 222943 - DNA, 323 bp, Homo sapiens
agtccccaccccaaaactttgcttgtgcccctccataatccctttctcttggcccttcacaggcaaccactggtttgctttctgtcactttggattaattttcctttattttttggtctggtgtctttcactcagcataattactttgagattctcccatgttgttgtatatataccaacagttcattccttttcattgctgagtagtattccatcaaatggatatgccataatttgtttattcattgacctattgatggccatttgggttgtttccagttttgggctattacaaataaagctgctatgaacatttgtgtcta

SEQ ID NO: 222944 - DNA, 285 bp, Homo sapiens
cagagctcaaccaggaacagataaatccctttgttgggctacaaataagttgtttataagtctcagtattcagaatggtcttctatcactcaagagagaaaccacagtagtcaagagagaaacaccaagaaaatgggcttatagatatcaacgtggatattttagtatttgtgtctgtaaaaatcatttttgtgcagacattgattttgctgttacatttttttaaacaattcagatgccattttcttttttcactcaataaagttttaaattatctaatacata

SEQ ID NO: 222945 - DNA, 644 bp, Homo sapiens
aggtaaggctttttttgcattgctataagagtgcaaccaggtcagaaaggtaaggtcagatgagagcgggaattaatttgcatcatccgaaggcagaaaattcctcctgtgatattttacctatgaagtagacaggaggcaccattgtgtgtgaaaatacgtactagccacagattgaaaagaatctaaaaccctaaagttagaggagactccaggattatatcaacatgttccctttccaaaacacagaattgcatcaactatagtcatagcacttattgtctataccactcatgtttcacttatataatagattattttcctctccaataataacagcccagagtagacctcatgttctcctttccctgagtgtcagggtgctcagagtccattcttgtggccaacaccaacgattatgtttatgtccgatattaactcttagaaggggcctgtttacttcttccatttgcatttgttctgatttcttatttcaatttcattcatcttatggtctgtataattgcttaagctcctcaagttctttttattaagagttgtaagtaaaatttaataaacaataacatagtctctgctattttgatccttgctctttgccatgctggtttacttattctttattg

SEQ ID NO: 222946 - DNA, 422 bp, Homo sapiens
gctttaaaaattgttattgtgaccaaaaatgcaggcaagtcttccaaaacaccaaagtgatgagttaatttattcaagagttactactcctacggcattaattcgtgaaagggatttttaacagagtacgcaaaccaagaagggccagattatcaaaatctaacagactctgccaagttacccatccacttctgaatggctgggccattcctaaagtgctacctggtcaaaacggacacagataccaaacagcgcaccatctgtgcccaagtgttcaaacacagctcaaaacatcacaacagcaacacagtctgtgaggaccaatctgctatggcagcatttctaaaaaggcattcacagtgccaggaagtattaaacaagcacctaggcactaatgaaagggatgaagccagtgtcatttc

SEQ ID NO: 222947 - DNA, 357 bp, Homo sapiens
gatcccttggcttgagccagttgattcttgtaagaatgttagtgcagtaatacagtaactaataaagaggaaagcagatgccagtgggtctggaggagccttcagacagcatgtgatttttaaggagatgtgggatgaggattgcttcttgttttgtatatggagtagtgatcaaagtctctcatattccagcccagggctggactatattagtggatagttggtatgtcaattgtactatattaaccataatgtaggcctggccagactagccactgtaggatctaggatttaaaactatctcactcttctgtcttacacaaaaataaattccaggtggattaaagagagacattt

SEQ ID NO: 222948 - DNA, 415 bp, Homo sapiens
ctgacagcacgggacatggaaacttgggtggatacattttggtgatgggtgggggtgagggaatcctgcagggaaataagtcaagtttactcatatctttggcatctgctgctcatccctaggcagccaaggccctgggataccagggattcccctgcagcccagggagtctgttgacttctttggggaaagagaagaggtggagacaggcaatagtagaattaatggtgccataggtatctcttggggcaggcagagagattacatttttaaaaaggaaaacattgaatctttctagctggtactcatctcctcctctcttgacatttttcatctctcctattaaaaattcattttctttggacttcaaacttgaacaaatcttgcctattttagaaaaacacacacatacaca

SEQ ID NO: 222949 - DNA, 520 bp, Homo sapiens
ctgagggcgtaccaactgcttgtgaccaggaactacctggccacagactgggataaaccatctacctcatgatgtcagcttatcacctgtttctggtgggttctctatgaactacctctccagggcacttcttccctcctcatccacatccggcctctaatgatgcctgttcacccctccacccagttatgctcccttacaaaattcagacacagctgaccacttccaactttttggagctggtagagttgtccatttggctcagttccgcacagaacaaaaccatttctgagatgtgtgccaccattcccgtacccatgggagggcagaccagcctccattgttaggggagtataacatttctgaataaatcagagtttcagagcaggaaatagccctcagaggttagccaaaccaacctcttgtggaacaggctatggcccaaaaacgagcaaggacttggtcaagattgctctggaaagctaacagcaaggcccagcataaacaacagctcttcaac

SEQ ID NO: 222950 - DNA, 480 bp, Homo sapiens
ctagcgggccctctgccgaccgcctgcttcacacccctcagcgctccctgttgcctgcggactccacggcccttcctggactggcccttgctcaactcccagccaccattgtccctaccactgaacccttgcacaggccacttcctcagacgagacaacctctcgttcactccctaaagccctcttcaggtgtcacctcctccaagaagccctcctcgccacccccagccgggtcagaggaccttcctctgtgctccctcggtcacctgtgctacctctaacaccactgaccacactgtatcgtgagtgtccattgacgtgaccaattgccctgccaggctgtgacggcctcaatggtaggggctgcatgtgattcgtctctgagccccctgtgcccacccagggcccggcacagagtcgatgctcaataaatgtgtgttgactgcaaaaaacaaaaaacaaacaaacaaacaaacaaac

SEQ ID NO: 222951 - DNA, 398 bp, Homo sapiens
ccgcacactccgtcagcacatattgggaagccaggcagaaagcgacaaggaaggtgaagtgaacaagagggaacccgaaagctgaaaacctgcccccctgagagttgcctagatgaccggccccggctgtgaatgaaggtgtctgggcagacgcttgtgagtatgggtggggatacgtgtacgggcctgcctcaggacctgtggaagcacagatgaagacaggaaacagttgagatgtgatgggagttaaaagttaaaaccgaggacctctgacactcacagtcccagtgccaaccctaaagacgcagtccagatcttcctgcattcttttcttctcgcgttctccctaggcaccgccagaggcgcaccctggtgcatgctacctacatatgaggaaa

SEQ ID NO: 222952 - DNA, 496 bp, Homo sapiens
tagaggctttctcaagaaaaacacacatatacaagtttttatacaatttcaaggggtttataacagttcattttagactccctgcaagtccaaacacctcaagttagaacccttccattatactttcactcagcatggaatggaagcagacaggcaaaactgttctgctgaaggtacagccctaatatatgggcaagggaagcatgaagcatgtattcagttcacttacgggcttactgtgtgccaggcactgttccaagccctagagattcagcagtgaacagaggactaaaaaagtatccctgcctttggagagcttatgctccagtaggggaagacagaaataaacaagataagtaaaatacagtgttaaatgctgataaatactatgaagaaaagggaaaatgggaaggacaaggagtgtacacatcagaggtggggtgttattaaaacaattttaaatatggcagccaggaaaggtctcactaaggtaata

SEQ ID NO: 222953 - DNA, 687 bp, Homo sapiens
ttccactgacagctggctgaaacaaggaatttatcctgtatagaaaaatacaagacttggttcaatggcctctttaaatctgtaagacattcaaaagagaaacctgcatacattttgaaataaatgactccacgattcttccactcctaaactgaggagatttgcagataactcacaacttcctaagctaagaggtatttttatttttctccaaccattccaataaatgtgatcaagatacagaattttttcaggagatcatttgctccatttttttctttaaatttgatatttgctttttgatttcttaaaaagactatcaagagagtaaaaataaaacccagagaatgggagaaaatatttgcaaatcatgtatctagtaacagactgggattgaaaatatattaactactacaattcaacaactaaaaaacaacccaactcaaaaacaaagaacttgaatagtcatttctccaaagatatacaaatagccaaaaagtacatataaagatactcgacatctctaattatcaaggaaatgctaatcaaaaccataataaggccaggtatagtggctcacacctgtaatcccaacactctgggaggccaaggtggatcacatgagcccaagagttcaagaccagcctggcaaacatggtgaaaccccatctctactaaaaatacaaa

SEQ ID NO: 222954 - DNA, 459 bp, Homo sapiens
cttatgttttgtggccatgtgtcatgaattgttccctggaaagggagatccataaaggaggaactgtagctgggtttgctgagcatattatctcctgtttgctcccctgacttgcacaactggcaagcggctttaaagccgacagcaaagaagctgcaaaatgaagatgacattagtgatatgaacacgcacaaaaaataaggaaatggccaggttgacactctgctcctttatataagctctctgtcaagcccatttcagggtaagaaagtcatgaggaaccccaagtctgcctagatgttggccaaaataaaactggaagtaatagaaaagttggaaatattaatatctgatatcattaacaatgtacctcatactaagtatattgtgccttggaatattagcttataagaataaatatatataatttaagaataaataaatatacatatattggga

SEQ ID NO: 222955 - DNA, 348 bp, Homo sapiens
  misc_feature (1)..(1): n is a, c, g, or t
ncggcctcccaaagtgctgggactacaggcgtgagccaccacgcccggcctaagatgcactttctttagtaaatgactattagattatcacctgcttccttaaagcaggactcagcacggcaaccaaggaatcaacaataagcaatgctctcagcttccagaatcgcatgtgtctctcccctctcgggcgggtggtgagtccccggaggacacctgactccagccttcgcaccagcagcttcactggctctcggtccattgtaacttattgggtgctggatttttttgcattttgtgttaacattctttgagctttgttttggtatacaataaagttacttaaaaaca

SEQ ID NO: 222956 - DNA, 348 bp, Homo sapiens
aaccacactgccacccggctcctcctctgccctcatgaagacagcaacagctgctgttgttactgttaccactgattaaaccagtgtcaggccccgctcaaggcattatatgcacatgatttcatcctcatgacaaccccatgaagcaggtatcactctctttctacagaaggaaacaggctcaggagaatctgtgatttgtccagcatcttcaaagctgaccagcgatgtgaccctgggatagtcatttaatctctctgtgctcattatcttatctgtaggtggggataatgatactgatttcaatagagtcaaagggaggataaaattcaatgagggaacatatga

SEQ ID NO: 222957 - DNA, 396 bp, Homo sapiens
gtctaggaaaggtgagattagctggctgtggggtaaatcacctgacacgaagagcccggggttaaccaatcaccgtgggagggctgccctggagcacacagcaggctgcacttgggaaaagtccatttgaacaagaatttcttcttgagaaggtctgagtagccaagggaccttgatctaggagtaggaactggtctcaggtcactgattgccagggtggcctgggcaaatcgtttctcctcttgggggctctgggtccccacctgtgcagtgagggcatgcatgctctgatgccttcatgagtggcagcacggcaccatgttaggcacgggggcttctgggcctagtcctttgtcttcctggccatggggaagtggaaaaggccttaccccacca

SEQ ID NO: 222958 - DNA, 244 bp, Homo sapiens
tcaaacgcctaggaatagaagtatacctaagaatggctgaaatgtcagactgttctcttcagcctcatgaacttatggaaaagccttcatagaggtttttggttttttggtttttggtttttgttttttggtttttttttgagacagagtcttgctctgtcgcccaggctggagtgaggtggcgaaatctcggctcactgcaactttccgcctcccaggctcaagcgattctcgtgcctcagcc

SEQ ID NO: 222959 - DNA, 560 bp, Homo sapiens
ggcgggtgtgcgggcgcgcgagccgagccctttgttcaggagaacattcctcagcgccagcctccccacctggagagcctgtggttcctgtttcaggctttgccttggagaaactctcgccgagtatgcagctctcaagcctggcttctggcgcatcctacttcatggccttcaacgggtcctttgacctccctgaacctcaattttctcacttgtagaatgggaaccaaaattctgacgtcgaatgatcgctgtgaaattaaattaaatgccaaaacacaaatgtagagtatctgcaggcataaggtgaatgttagatacttgcgtttggaagaccttcaccgaaagaagctaacatttttgtattgagttcaccctactcccccatcccgctttgtatgggcaatttgtagtcctcccaaatctttgaaatctcactttcttagtaaagactttccctgatttttggggcacaccctcatggagtcaccctctggcatatttccatagcatgctgtaacgtctattaaaatatttgcagttactttttttttaattga

SEQ ID NO: 222960 - DNA, 472 bp, Homo sapiens
ccaatgcttcatttctttttttgctgaataatgttctgtcatctggatgtgccacattttgttcacccattcctttgttgatggacgtttggattgtttccacctcttggcacttatgaacagtgctgctttgaacattggttacaggtttctggtgtggacgaacattttcttttatctcgggtataaatggaattgttggctgggcgcagtggctcacgcctgtaattccagcactttgcgaggccaaggtgggtggatcacctcagatcaggagttcaaggccagcacagctaaaacggtgaaaccccatctctactaaaaatatagaaattagccaagcgtggtggcacatgccacccagtgcggggaggctgaggcaggagaatcacttgaactcaggaggcagagattgcagtgagctaaggttgtgccactgtactccagcctgggtgacacagcaagactctgt

SEQ ID NO: 222961 - DNA, 541 bp, Homo sapiens
gtaggttagacattgtggaatgaaatatctgtgacactgaagacatagcaatagaaactgtcccaattaaagcagagagaaaggaaacaaaagaaacacagaaacacagagcctcagtcaccttaagatgatattaaaaactggagtcctcgaaaaggattaacggtgatgatttgaaggccaaaaacaagtcccaaatttcatgaaaattgtaaacgtatagcgccaagaagctcaacaaatccaaagtaggagaaaaacaaagcaaaccatatcaagcgaggcactttgtaattaaatcactgaaaaccagtaataagtagaaaaaaattaaaagcagaaagagaaaaaaagacacattttatacagggaacaaagacagatataattgcagacttctcttcagaaataatgcaaactagaacttaatgaaatcgcgtctttaaagtgataaaagaaaaagaaagcactgtcaatctagaattctatatccaccagaaatattctgtaaaattgaaggtaaaataaatgtttgtcagac

SEQ ID NO: 222962 - DNA, 221 bp, Homo sapiens
ttggggcgggggactctcgccccagttgagggccagagagcctatgactgttccaggcctgtttcccccgctatgcaaagggagaagtggaggaggtgggtgggaccgccctccacactggtgcctgctgcacccctttcctgattcaagtcccgcttagctggtggctctgggcaaatgacaacctcttggagcctcagtttccacctctgtagagccgg

SEQ ID NO: 222963 - DNA, 264 bp, Homo sapiens
ccagatgggcttagaagcacttaatgagaatttgccagaaataaatatagacttaacttacaaacagggacgattacaattcaggcccccttttgaagaaatccgggctaaatattatagagaaatgaagagattcatcggcattccaaatcagtttaagggagtgggtgaggcaggagatgaatctattttttctattatgattgatagaaatgcaagtggatttttgacgattttcagcaaagcagaagatctgtttagaag

SEQ ID NO: 222964 - DNA, 409 bp, Homo sapiens
tgatggaaatctggatctacctagggggatgaaggacaggaaatattgactacttggatatgtatacaagatatttttcttcatgtaaatctctaaaaagtatattgtctttatacaaaaataacatcaaatgtattgtgggttttataacatttaaaatatatgacaaacatagcctaaaaaggctgtgaaaaagaagtaaagtatatactattggaagatccatatatgtactatttctgaaaagtacactgcaaaagcttttataaacattgatgatcacagaaaatataaatggtctaaaacaccccatttaaagacagagatttcttgataagataaataaaaataagatccagtcatgctgcctacaaaggaaacatgttagattcaaagacagataaacaaa

SEQ ID NO: 222965 - DNA, 426 bp, Homo sapiens
actccttcttcccagtaccctagaatcacgtagtccttgagtggggagaaggccagcatgggatatttcattgtatatatttatgtatgtcatacacccctcatgggcagagccaggacctccaggatctgatcgtaaattgggcactgtgtgatattgggcaggtcgccctgtcctcagtttcccgatctatagccaggatctccccagctatgaaatcagtgaccagcactgtttctttgcctgtctgtgcaccgtggactcacatgcagagcagggctgttagattgtaaactccagacaccagacatctctgacaaaggagctctgtgcagatgacaagcatcgggcagacgcgtacttaatggtttttgacctgaaggtgataatggcttaataataaacggatggttttacccccaagaa

SEQ ID NO: 222966 - DNA, 480 bp, Homo sapiens
acagaaattactgaggccaggtgcggtggctcacgcctgtactcccagcactttggaattgagtgctgaggcaggatcacttgaggccaggagttcaagaccagtctgggcaacataggaagaccccaatttgtacaaaaaatacaaaacttagctggcctggccgcacggtgccagtagtcccagctattggggaggctgagatgggaggctcacttgagcctgggaggtagaggctgcagtgagctgtaatcgtgccaatgcactcctccaccacggatgacagtgaggtctgtctcactcagaaaaataacaaaaaattttaatttaaaacattactcagttgacattcactgaagtcctatgtgtctggcaacctgttcctgcagcagtggttctcaggctgagtgtggggagcagaagcacttgaacagcttcataaagcagatgccagtcctgatttagtagggctgggatcct

SEQ ID NO: 222967 - DNA, 417 bp, Homo sapiens
cttaccacgagcctggtattgtgctgggcccacagcacagtatctcttacaatcttcatctcagatctgcgagtgaagaattattattcctatcttcaggtaagggattaaaattatgtaactttcccaaggtcaatagtaagtgagagtgggaatatgaaatctggttagtccacgtataacataagtgtttgtccagtgtatgtctcactatgtctttcttccaacttaaaatcttccatgagtctggaacaagcctgggagtgtggcttagacctgtacttatcaaactctctttggctaagagccagattttttaaaaattttaatccattatggatcaaaattttttgtaaaatataaaaaaagaaatacttggaaaatgaaatgaaaatataataaagatatacaaaatac

SEQ ID NO: 222968 - DNA, 514 bp, Homo sapiens
gaactttggcacatgacttgacaaattcttaagaactgcctaggaaagaagagagtccaggcttcagctcttgtgagtatgtgctctctgtctgactactgcagatgaaacaagccttctgcccctaaggggtgttaggtaaaggggcttttccagttacttttgaactaggacatatttaattttgagcatcttataatatcttgctatgttttgttcaaaatttagtctgtggagtaaaagcaaaacacacatagacatatatgcctaaatatctgtatctttattcatgatctcctaattggcttagtttattggtcaaggcacatagactactcctgtgctgaactctgggtaaattaatttgtcccttttttgtgatattttccaaaatgactgttagtgccttttcactggtaaagagtatattcttaccacaaaaatcaaatacatgatccaaacacaaatgatgaaagcccataaatctaaaattgattacatttgagtagtgggt

SEQ ID NO: 222969 - DNA, 451 bp, Homo sapiens
gacttgtagctagaatgaatgtataagtcactcctataactcaaaaagacaacccagtctgaataaccatttctccaaagaagacatacaaatggccaacgagcatgagaatagctgctcaacatcatagccatcagagaaacgcaaaccaaaccacgagtccacacaacttcacacccactatcgtggctatcatcaaaaacacagaacatagcaagttttggtgaggattcagagaagctgcaacccgcatacactgctggtgggaatgtataatgctgcggctgctttggcaaacagtttggatgttcctcaaaaggttaaacagggttaccatacgacttaacaactccattcctacgtattcacatgagagccataaaaacatatgaccacacaaatgctgtgaggtcacactgtgagcagcactgtttccaacagccaaaaggtg

SEQ ID NO: 222970 - DNA, 483 bp, Homo sapiens
attcaaacacatataaataatcatgacccaataatagctaacatttcttgagcaagtaattatgtacgaagtactgaagtgttcggacactgtgatttagctcatttaatcctaacagtcctgtaagagggggtgcctttattgcatccgttttgcagataaggaaagtgaggaatggagaaattaaataactagttagtcttgcagctagtaagtgaaaaagcccgggtttgagcccaagccagtcacaggcctgtgacataaccaccgtgctattaatatattgcccaagaaaagaaagtgttgtagtgggtcaaagggagagctcaggtgtaaactgtggacgtcgaaaaagggtttgtggtgaccgggcgcggtggctcgcgactgtaaacccagcactttgggaggccaaggcgggcggatcacaaggtcaggagatcgagaccatcctggctaacacagtgaaatcccatctctact

SEQ ID NO: 222971 - DNA, 1341 bp, Homo sapiens
gcctcccaaaatgctgggattacaggcatgagccaccgctcccgaccagttgtttctaattcttatctattgtgaataatgctgcaatgaacacggaagggcaaatatcttccatgtcctgatttcagctcttttggataaatgcccagaagtgggattgctggatcaaatggtagtttttatttttaatttttctatcaatctctatgctgttttttttatagtggcaacatcattttatattcttaccagtagtgcacacggttcaaatttttccacatccttgccaacactttatttttttaatttttaattttttataatgaccatcataatgagtgtgagatgatacctcagtgtggttttgatttgcatttctctaatgattagtgaagaatgtcttttcatatgcctgtcggtcatttgtatctcctctttgaagatagttatttttatttttattttctgctattgagtttcttgtatatttttatattaaccccctgtcagatatatggtttacaaatattttctctcattctgtaggttgcttttgtactcggttgattatttccttcactatgcagaagatttttagtttctggctttttcatttgatgtaaatccatttgtctatttttgcttttgttacttgtgcttttggtgtcatatccaagaattaattgccaagacaaatgttatgaaaattttgccctatgttgccttcttggagttttataaattcatgtcttatgtttaagtctttaatctattttgagttgatttttgtgcatggtataaaataaggatccaattttattctttttgaatgtgaatatctagtttttccagcaccaattttttgatactatccttttcccattgtgtactcttggcatcctgtcaaagatcatttgactgtatatgtgtgggtttatttctggactctcagtattgttccattagcctatatgtctatctttattccagtaccatggtcttttgatgactatagctttgtaatatgttctaaagttaaaaagtttgaggcctccagttttgctctttttgtcaagattgtttaggctactttggggtcatttgtacttctgtacaatttttagaattgttttgtcaatttctgcaaaaaatgtcactatgactttaataggaattgcattaaatgtgtagactttgggtggtatggacatttgaacaatgtcttctaatccatgaacgtgggaagtctttccatttatttgtgtcttcttttctttttttaacttttttgagattatgttgtgctcttcattgccaaaaataaacacttttaaaaacaca

SEQ ID NO: 222972 - DNA, 467 bp, Homo sapiens
actcccgagcgtcctttagaaatgttcagaccaggtctggagttcgtgaaggcgaggcagtggtcaatgagcttgggaggtgggggaggtcatgagcacctggaagttgtttagaacactttgtgtatatgcatgtttctaggggaggggtatattatcagcttccaaagtggatctatcacttccctggaaacactaagaatattttaatagcttgggatgctggacctgtggcccagccaggctgctgattctgattttgtctccatttggcatataccaagtgccccagatgtaaatcctctcatggtcaatttgaggaatggtcttaagatagaagcagagagaaacgaaaagattgagccatagttagcaggaaaaaaaattaatttcatgaaaattgatttcctaatgagaatatgataaactggttttacaaaagcagcaaacaaaaccagcaaaaacca

SEQ ID NO: 222973 - DNA, 327 bp, Homo sapiens
ctttgatggcatggatttaaaaataagtagccaattcatataggatcattttcatacaaaaaaagcataaaagcgaaacattaaaacttccttttaaactcactggtcccttctacaatgactttctctgctacaatgactttaactttttttttctgaacactcattttctgttcaacatacctccctatattattctacaaaacgggataatggttagtcaaccaacagtcatcatggttagtcaaaaggcaggtgctttcttttttattttattttatttttcgctttgtttgttttccagattaagcatagaacagtaggata

SEQ ID NO: 222974 - DNA, 195 bp, Homo sapiens
ccatgcccggctaattttttgtagagtcagggtttcaccatgttgtccagacaggtcttgaactcctgggctcaagcaatcctccacctcagcctcccaaagtgctgggattacaggcatgacccactgtacctggccttcaaatgttcttcatttgctatttcttagaagtctttaaagcagaacgccgtacac

SEQ ID NO: 222975 - DNA, 441 bp, Homo sapiens
ccagcattatgtctgttgagaagtgaaatgcgtgctttgttcagaacacaaaatgatataagaagtgtcttagggaggctttgtactgtggtttttgtaggtacagagacatgtgtgaccttgatttatatgttggatatctatgaggcaagagattcgtggagttctgtactccaaaggcagaaactctgggtaagaaattgttgttcctgccattggcaagactagaaggccagatgattggcagtggtccatgagtctgtaaaggtgtgtggacgggctgattattagccaaggcatcctgggctaagattacttcctgaagttccgccaattgtgttaacctttggatcctctcctttttcaagaatgtcctggttagggatggaatgcagcagctttctagcaagccccatcacattgaatgtggttaagatctcg

SEQ ID NO: 222976 - DNA, 240 bp, Homo sapiens
cgaactcctgggtgcctactatgtgctaattaatgtctgtctcttttcttctctgccaaggcctggggaagggcttttcataactccctggcagctgaaagaagagcgtcattaagcagcacctaatagcaagatgatttccgttcttagctgctgagtggtaggctgcatgatgagagtggagagtgggcttggcgggcttctttgtcagtgggttgatgaggagacggcctcatgctg

SEQ ID NO: 222977 - DNA, 388 bp, Homo sapiens
caaaaaaaaaaaaaaaaaaagattgacctttgtttttttaagtgactgatgaaggtaggaattattagtgggctttgtttgtttattgtttagaaaagaaagaatttggccagtcacagtggctcacgcctgtaatcccagcactttgggaggccgaggtgggcggatcacttgaggtcaggagttcgagaccagcctgaccaacgtggtgaaaccctgtctctactaaaaatacaaaaattagctgggcatggtggcacacgcctataatcccaactgcttgggaagatgaggcatgagaatccattgaacccgggaggcggaggttgagatcacgccatgcactccagcctgggcgacagagtgagacactgtctcaaaaaaaaag

SEQ ID NO: 222978 - DNA, 976 bp, Homo sapiens
acggtgtttttcttccatatctataaatattacacttttcctgctggttcttgactttttacttttctacattatcacttttctttattaattattatttatcacttttatacattttcttagttcacatgtctcagaccttccctcctttctcaactcaataataattgatttactatttttagtttcattattggttgcctttttatacttggtctttatatcttcttttatcatctatagatactctcttctgacttccttatttgtaaactatcatttgaggtattttcttgagtctcttttctggaaaactccttcctggagccctttccctcctgctgcactctactgtttctacatcagccttttactcccaactgtcctttggggaacttccttttaccactttctttagttggacccactgtttcttggctcttgccctgccccccccttttttttaattatttttattttttctcttaatttactccttagttttgatggagtacattctcaagtaattttataagaaaagacacctgaaatgtaaatttgaacccttttatttctgaaaatggcttatttctgcctttatatttgctagtttatctccatatagaactcagttctttgtaatttgccttttctcttctctgaaagtttttcatttttttttcaattttctttatctcttttggattctaaaatttctatctggatttctgtctctaaagtattttgctgagacttgactgcaggtttttcaggatgaagacttaagttcttcagttcaggggaattatcctctgttaccactttgataatttcctcaactcaattttctggtttttttctttctagaactattctgtttgttgggtcttagacctcttgtttttctcttactttgtttttacttaattagacttttgggggtttacttacattttcaactcctcactatagtttt

SEQ ID NO: 222979 - DNA, 1603 bp, Homo sapiens
gatggcgctcttaggcagccgagcggagctggaagcggacgaggtacgatccgatggggattgcgggcccggcccctgaagccctggacaggagtccgggagagaagagtgagcccggctaggacggcgaggccccgcccccttggtcccctctctggggtgggctggcgggcgccgggtgggggcgcccggcttggtaggtctgtccccgctggagctaggagggtccctgcggcgcgcggagcggacgcagtgccgaggttcggagcgccggccccgcgagtcgtggggatggaggacccacgtcctgccagcacttggatgggcgtgagggcgcgggaccataggacccgcagctctgagctgttccgggccggcccagcgacgcctgggctttacgaagtctgaccctgaagtcctggcactggctctctgggtgttcgtggaatcatccctcgacctgggaatctcaccttctatggaagtttcctggtggcagaaccgaaaggcttacgattgatgaaaagagggggcagcctgaggaacaatgagtagaggggtacctgccgcgacagcagggcagggctgccaggggctggggctggagggctagagccgcagccaggctgtggtgcttccctcttccctccagggggcgggacacttcccctagcaggtcctcagagtcggtggtggccggagggaaaccactttgagaaccgactccggcctcctttggtttcaactgtgtttgagtaattagccactccttcagtcgtggcgcgcccgggcctgagcacccaggggctagcgcgccggacctgttgatttattgactattcatttcagcacctggcaactccagagacagcgctctccctgctcttgaagttgagaccgaggctccagcagcagccagcacccacagctgctgttcctgccatcttacctgacttgaattgtgcgagtcgctgcctttagaaggctttggtttcaaatgatgcaatagtggacgatctggaggaggcggttaagtttcccgtccatctctttagtgccaggaatctcctgacaaggaagactatactttaaatgtgctccgtaaaataaacaaaaaacaaaaactgaactacagctcctctgcatgacagagagacaagagggcaagccgggctgtccagacccttgcttacagcctgtcccttgcattgaggatcccaagactgtagaatgaaatatttgaatcccgatctgtttgtaggagatttgctgtgcttagaactatgtaattctctagattagggcattgttgaggcggtgctattattaattaacactgggataataggtgtaaactgggactgtttcggagatactttgacaaatggtcaccccagctatgctcactgcctactagatgaacggttgagatgcattagccgatgaggagggaagttaggtttctgtgggtgaaactctgggtggaagttaggtttcagagtagcagagagcctggcacacagatacttggtaaataaatatttgttgaatgaatgaaagactgcagaaaagatgttgcttaataacaactcagtttttgcca

SEQ ID NO: 222980 - DNA, 240 bp, Homo sapiens
tgccttgatggctgctttagcaaaacactaaaactgaaaaccaaaaacggcaggggggttataactggtcctctggtttctgtaacaattcagatgagtgttatgcataaagaacatgacctggtaaaccgccacactataagaaactaaacaagccatccaacacttctgttcaaaatacaaaaaattagccaggcgtggtggcgggcgcctgtagtcccagctactagggaggctgag

SEQ ID NO: 222981 - DNA, 580 bp, Homo sapiens
ctagtggggtcgtggctggtctaagtgcagcagtattgcaactagttgatcacaaccagttaacagatttttttttccttctccctttccactgcttcacttagcctttaaaatgtatattaaaataaaagactgggtgcggtggctcacgcctgtaatcccagaactttgggaggccgaggtgggcagatcacttgaggccaggagttcgagaccagcctggctaacatggtgaaaccccatctctactaaaattgcaaaaattaggtatggaggcgcatgcctataattccagctacttaggagactgaagcaggagaatcgctgaaacccaggaggtggaggttgcagtgagccaaggttgcgccaacgtactccggcctgggcaacagagcaagactgtttcaaagaaaaaaaagaggctgaggcaggagaattgcctcaacgtgggaggcggaggttgcagtgggcaaaaatggtgcccttgcactccagcctgggcaacaagcaaaactccgtctcaaaaaaaaagaaaaaagaaaaactagctggtcaagtggtagtaattgtaggtggtcat

SEQ ID NO: 222982 - DNA, 533 bp, Homo sapiens
taaaaaaataaataaaaggctcatagacccctgcagcacaccaaccagaggataacccaggatgcaggagtgggagtgagtgtcaatgaagactggaaactgacacagcaggacctgggaaatagatgcctggagagcagaaagccccacaggaaggtacaacagcctctcagtaaacactcagagcctttcaagagtttggggcaagactgaaacatacacccaactccatgagttccttgaaagaaataatagacatagaagaaaatgtccagcacctaaataccctcaaacttttcttgagaaatacaaagcagattttttaaagtacgaatatcattcatattagcaaaacccaaaattgatgatgatgaacattttttatattcgtctttttttttttttaaagaacattgtggatattgaacttttctctttaactacaagcctccatcttatttctgtttctttcccccaagggcattcactatcatgagtttatgcatctttccagaacatttttaatattttat

SEQ ID NO: 222983 - DNA, 382 bp, Homo sapiens
cgagattgcgccactgcagtccgcagtccggcctgggcgacagagcgagactccgtctcaaaaaaaaaaaaaaaaaacaatccccccttgaatcgtgaagctgtgctcgcctgcacaggggtgcagaggtccggtgtctccgcgttgatgctgccagcacctcaacagtattatgggatggtccagcagtcgatagaaacttaccaggatattttgcacaattccctgtcctcctggagtattggggatggtgactttaaaatgacagtactcattcatacacttctacattttctttaacttatatttttaataaggatctggaggcatttcagtttctccaaaagaaggatttagaatttgttcaaaggaaaaaaaaaca

SEQ ID NO: 222984 - DNA, 624 bp, Homo sapiens
caaaacaaaacgtggcctaatatcactataaattcaaaagtacgagacacacattttacataaggtcccgttttctgtttttacacaatgaccagcttaccatatggtatatggaatatctttaccaagtattagatgttctgcattaagattacaaaatcaaataacttgaatatatgcttattttgcgtcccatttccaaaatacagcaataatgaataaattaagtaacataatttcagttagcaaaaggagaagtaagcctaacttacctgcgaaataagtcacgattcactctttcttcttgccaccctacaaaccaactactaacatacagatttctaccaagcaaatgtaactaattagccccatgtcagggctcagtttctctgcttttaaaacaagactggtctgagtctatgtctcaggcataaagctaagcatctgacatacatcatctttttaggtcctcaaaataatcccaagatagatattatcagtgtcctaattttacagacaagaaatggcaattgaggaaggttaggttagcttgtcaggatgcaagcgcaggcagtgtggttcctgagctctggttcttaggcactgttgctttctatcctatct

SEQ ID NO: 222985 - DNA, 521 bp, Homo sapiens
gcattatctatttcattgtttttccaaagaaattgcttttgtaaatatttattctttataacacattttgttttctagtctgttaatttcagtttttactcttttatttcagtttttcactcttcctaattttgttgaatttttaaaaatttaaatttacatatggtaaagtttacttttttggtgtacatttccatgaatatttacacatgcatagattcttgtaatcaccacagacaggacacagaatgatttgaacaactccaggaattcccaagtgctgcccctttgtattcacactatcctgccaccctaacccctggcaaccactgatatgctttttgttcctttagttttgctttttccagaatctcatacatagacttaatgtagtatgtaaccttttaagacgggattttcagcctgggcaacaaagtgagacatctctacaaaaaattaaaaaaaaattagccgggcatggtggcacacatctgtagtcccagctacttgagtagctgagg

SEQ ID NO: 222986 - DNA, 441 bp, Homo sapiens
aatatttggtttcatcacacctcattaaataaaacctgtgctgaaaggagaacaggaagtgtttctaaaatcacatgcagttctgaaaacaaaatatgggtgaggagtctctagacatgatctccagagccaacttccctccagcaggctcaggccagagagtggctgccccaaaggcacagctggctctatttatgcttgctgtgaattgtctcttggtacagtaggtgcatgccgactcccctgacattctccactgcctccctgtgagcaggtgtgtttgttggagatcaggactattacctaagcactcaccatagagttaagtaacacaacatttcccacaagcagtcctgtgatagtcagtggagtatgggcagaaaatatagcccacccgaaaaggtcatctccctggactggggctccattcttaaaagatta

SEQ ID NO: 222987 - DNA, 499 bp, Homo sapiens
attgattggccgctttattacttaggctggagagttccttttatacatagacaacctagttatttattttaattgaggcttccagcctttgtatttcataattccataaggttaaagtttgaaagcaaaaattatttaatcttctctcacctccaaatttatagtccctgtgtttggccagatgatttctgatcattataataagagagtataagaccctacaacaacggtcaggaacaaataggatctaagacttttccttaagtattttcttaagacctaattttttttaatactgagagttctgaatatgttatattttgataattaaaaacattgaaaagcacagagaccaatattcacaaaacacctgggtgtagaatcttagtgaaagccacaaggagttgtgaaaacactgatagctgcatttttttcctctcagtttctccggtacaatgttattggtagtcatacagtctggtgcaaaggtacaacaaag

SEQ ID NO: 222988 - DNA, 378 bp, Homo sapiens
gtaacatctggacttcaaattggaactccctctcacttctcaaacatgacagttaatggtttaattatattccagaatttttctatgtatatacatatgtacatgctggtataggctacgtatttaaatatcacattacaatgctgttgctcattccgagctctgcttgaaatgtccactgaatgacagaagtttagagatttggtgcaaagaccaacagccagaactcgggttgcccaatgagctactgtcgagtgtttacgttcctgatttccacctcacatcagtaatgacaacacttcctaaacaccaccagctgtattttccaagtttgaaaactctaacctatgtgcactttgcaagtcagaaacctagagg

SEQ ID NO: 222989 - DNA, 692 bp, Homo sapiens
agtctttagtcggccttaaaagcaaacaaatcagagatggaataagagcggtaattgcagcaagaccgccttgattcttgcagtccagggagctgagcgcaccgcgcgcatccggcgaggacaggaggcgaccgcgggcgctgccaagggctgcgggactttggcttttcctcagtaaacaaatcttttgattactttgacactgtggaataaagaagcggggagaaggatcaggctcaccttcacccgcttcagggggattccagcttggatgtcagattcctgaaccgtctttgccatcggaggaggaaacacatccacacacgcgcgcgcacactcgcacgctcagggccacactcacacgccgccctccacgatcacacagcaccagacttcggttccctatgcccctggatggtgacggcggattggcatcttggaagcgatgcgagagcgataaggctggcgccggcccgcaaaagctgcaggagcatcgctaggtgttgccgccaccgggaagcggggctgcaggatgagtaagagatacttacagacagcacacaacggaaacactgctaatactcatatccatgtacaccttgtggggcacagttggatccacgctgccaaccctcataccagctcaccatggttaacaacggcgaactcggtgacggtgcgtggccctccac

SEQ ID NO: 222990 - DNA, 478 bp, Homo sapiens
agttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagta

SEQ ID NO: 222991 - DNA, 399 bp, Homo sapiens
cgatacgatcccccaaagatctttgagcatcacccacccctcaagagaaaagatgactctggggaaaaagaaatagctagtaagttaattgttagatcccaaggttgtaaaagatcgaaggatcttaggcttctggagcactgtgtaagagaactggcaaagagtaaatatgaacggtgtgcatacaactgttcaaaaattagcatcaaagtgtaaaatcacatttaaggaaacatttagaaatggtggtaacctacattaatttgcttagtgatgtgtatgtaaatagcaataagtaactgtagggtctgtactaggatataatcaacttcttgatttaaactaggctagcaaaacatctaaggaacagtttagtcccataaagcatctgaaacgaaa

SEQ ID NO: 222992 - DNA, 520 bp, Homo sapiens
gagctgatgccaagggctctgcaggccggctggatgcagcaacctggaccagctcccaggaaacggaaagacatggccccagattcctagaaggctccagatggaggtgattgaaatgagggagggactaggaaccaaacagatgtctataaaactgaccacaaagaaaacatcttagaactgaccactgatgtataagactaaaaatctcagtctatgccttctacttttattgaacattcagtgagcaaaagacagactgaagaactgttcagagtaaaagaggttaaaaagacttatcaactaagtgaaacgtatgatcctagatccttgatgtgggatcaggaaaaaaatgctaaaaaggacattattggtatgactggcaaatggactatattgtatactacatacatttcctgagcatgattatgaaagagaatgcctttacacttgttcttaggcgatccacactgaagtatctggtgttaatagaatgactgtaaattactcttaaatggtt

SEQ ID NO: 222993 - DNA, 439 bp, Homo sapiens
gcttggatccaagtggtggttaggtggctagatagtctataattagtgcattttccttaattttagtctcaagcttgttactggaaaatctcattaattttgagtctactaatttggaatctatgatccttcaggccaagaggctgaactgatgtttagaaaaataaacaaagcaaacaagttttcgaggcaggccctaccacccttcttgtgttggatttgtaagttcaacttgacaaaggtagttgtcctaaagcgctgggcctgcagttgagataacctgccaccaggtgggtgatgaggcctgccactggtgttttaagtagtcattgctcatggacagatgttttaaagattttatattcaatgattctttcttcctcttctccagagatgcaactccttaataaaacagtaagacaaacacagaaaagtggaa

SEQ ID NO: 222994 - DNA, 384 bp, Homo sapiens
actctgttgcccacgctggagtgcagtggtgcaatcaagactcactgcagcctcagcctcgtgggctcaagcagtcctcccatctcagttgcctgagtagctgagactagaaggctcatgctaccacacccagcttccaagccagattgctggtgacagaggctttcctgggaaatgtttacctttctgctgtgaaggagtcttttggaatgggaagatggcagccttctcctgtgagttttggtgatatgtatgaagcggccttctcccatggatttttggtgatatgtatgaagtgccacaagtgaacctcatgtacccttggaaatcttagccaaacaggcaggaagctatgaacagttgcaacagattatataattagca

SEQ ID NO: 222995 - DNA, 422 bp, Homo sapiens
cattagttttattttcatctctgattttatatggacatgtttcaatgcatacagacagttaatattcttttcctcctaattatctattatatatatcatcttcagtatcatcaccattcaaaaaactcttttatatgttctagataatgtggcctattttttacgttagactacctgataaggtgtcaactgaattggctgcctttatctacattctgaaccaaaatttaattctagagtttgtagtcagcgtttttccaaatgtgtaaaactgtaatccttcataaaatgtcatatgtaaaagagtaagcaattctgtgtgtactaaaaggtgagaaagttattactttagctttcactgggaagacttaaagtttatcaaaaaggattatagaaagaacagatttatagcaactgtctga

SEQ ID NO: 222996 - DNA, 450 bp, Homo sapiens
tagtggcgaaatctcactatgttttgcccaggctagccttgaactcctgggctcaaaggattctgaatagctaggactatgggcctgcaccactgcaccgggcttgacaattatggaactcattttatattgtcttgttgaatcttctcatccttggctcctaggcctctctagccatggacagcagacttagaaagtcttggtcagcagctgggctcacgcctgtaatcccagtactttgggaggccgaggtgggtggatcactttaggtcaggagtccgagaccagcctggccaacatggtgaaacccatctaaaaatacaaaaattagccaggtgtgatggtgtgtgcctgtaatcctagctgctcgggaggctgaggcaggaaaatcacttgaacccaggaggcggaggttgcagtgagatgagatcatcccactgcactccagct

SEQ ID NO: 222997 - DNA, 525 bp, Homo sapiens
tgcacagaactgggagtcaagagcttgggtgaagcttcaactcttcagtctgtttcttcttttgtaattatgctaataaaggttgaattaggtgccttctaaagtctccttcaactctatattcacaagacaatgagttattcaaaaattagattttattcaagccaaagaaaatgtattacattcctatgcgtattttatattgtcagtataagtgtatgtatatatatttaggcagactactttgaatcatgctatttgtatcccaaaacagtaaggatatagataaacacatgaaaactcactgtattctaagcagccaaaagttcattccattaagagcagccaaaaaataatctttccctcctctgaaattcttttaaacttgatctgtttctttcttatctttctccaccttttagatgtcttatttctcttaatagcccccttgaaggtgcttctgcagtgccttagacatatcaagtgctgtaagaaacacttgaaaaataaatgacaaagaaaaat

SEQ ID NO: 222998 - DNA, 288 bp, Homo sapiens
tgactttcccgcttgggattggtgattttgctatgtataggcaaatgtgatttccctagcaaagccctagcacatagtagacattcaaatgcctaatcatttgcaagttcctcctatactattatgattttacagtgagtctttaggcccatcctcagcaacagggctatttcctcagtaacaaaatgggaatgacatctgacatatatttcataggaacaaagtggctacacatataaacactctcttctgaataatatcttcaccttttaccaaaaaaaaaagcac

SEQ ID NO: 222999 - DNA, 578 bp, Homo sapiens
ttaaccttggtgaaggaaggggatataaaattacaatttggtgggatgtgatcacaacttcactgtcattctgtggaactaatttcttctgataagtatttataagctataaaagtctctgaaaaatagaaaaaaatagcccatcattcctagaagctcagatcttcttataggttgctgccatctttttcctttgagaactattgatccatcttcctcttaatgtgtttttgtcccaggattatagtaagtagagtgctgaagattgccaacttctctttctttgaactgagtctgcaaaggcaagtgttcaggaggctgccggagcaggaggtacacacgaaggagccgaccgtcatgttaacgtaggtggggccgcgctggtcgcagtcgaagcactttcggttgtgcgggaggccggtcatgtcccgcagcatcttcaggtgcttctcctcctgcttccgcttcgcgctggccgccatggccgcggcgccaagggaggaggccggcagggccgggagccgggcagcgctgcgccgggggcccgcggtcccacgggccgccctggccgcggccgc

SEQ ID NO: 223000 - DNA, 375 bp, Homo sapiens
tgcagtgagtggagatcgtgccactgcactccagcctgggtgacagagcaagactccttctcaaaaaataataataataataataaataaataagtaaatttttaagttgtgataaaatacacataacataaaatttaccatcttaaccatattcaagtgtacagttcagtaaagttaaatatattcacactgccatgcaaccagtgtccagaactttttcatcttgtaatactgaaactctacagccaccaaacaacagctccccttttcctcctccgccagttcctggcaacccccattccactctgtttctccatgaactttattgctctggacacctcatctaagtggtataatatggtgtttgtctcttt

SEQ ID NO: 223001 - DNA, 426 bp, Homo sapiens
gttctacctttaagtgaaaatgtaaaacttcttgaattggtaaggaaaggaaaaaaatatataccaaggatgctaagatctatgctaagaatgattcttctatccatgaaactgtgaattagaaaaaggaaatttgtgctagttttgctgttgtacctcaaattgcaaagttacagccacagtacatgataaggcttcggatggaaatcacattaaatttttgggcaagagacatgatcagaaacacattcttactgaaggcaattgagttcagttctacactgaaattcagttatccactagggggtcttggaatgtatccctcatgaatcaaggggaactattagattgtaaacacaatcacccagcttcttgcttcttatcaatggttgattaggaatattgaatacaggtccttttcatatc

SEQ ID NO: 223002 - DNA, 680 bp, Homo sapiens
aggctgcggcctggccatcactttcttcattagacaggactgagcacccactgctctctctccctggaggggagggactggcagccattgtttctttctaggagaacctgggcttctaatttcatcccgtgcgtaaactgtattgggcactggacaaagctctcagttagtacaagggatggtccaggtgagggctcatttgatcccatcacaaatccccgcagggtcctctcagcagcagggagcaggactgggcctctgacccccggtgactgtaggtcctcctttcctggatgctcagtgaggtggttccctggcaacagcacagcatcctagcagccccaaggcacatgaaccacagacagagggcagatgagacaaaagagtcttccgtgctcactgtgggcattgtgtcagtgtttaccctgggaagctcctggatgtgctgttgacccttctctctggagaactttagcctggcccctgcccaccccactggagccattactcagagctctgtgctacaaaggcccagagaaaggaccctggggaggaggctacatggaggctacattcattcattcattcactgattcattcaataggtatactttgtatctctactgtgtctatctattgagcccatctctgggaatattaagttggttgagatatgggtt

SEQ ID NO: 223003 - DNA, 174 bp, Homo sapiens
gccataaaatgaaatcagctttaagctatgctgctcttcttctgtttcctagacagtctgaaaatcagttcattgaataaacctggtgctattacctgacttctattcatattagttagattacagacttattaattttattaaattcaggaaagctaatatgcgtcatttgca

SEQ ID NO: 223004 - DNA, 637 bp, Homo sapiens
aaaaaaaatgtggatcctcatagttgaaagccaggccagtctgcactaaagtggtaaggatgttttcttttagaggtacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaatt

SEQ ID NO: 223005 - DNA, 270 bp, Homo sapiens
tgttacttagcccaagtctggatgtctctccctcctgttgtctatactgccagcatcagagtcacctaagactctgtgtggctgctcctcgaaacaccaaatagttggccattcattcatttatccattcatttagaaatacacatgcaaggtgagcaacacaaactcagccatggctcttggggtgctttcatctagtcagggagaccttaatgaaaactacttaccccaataaacatctaattaggaattatggttagtgctagtaaa

SEQ ID NO: 223006 - DNA, 468 bp, Homo sapiens
acaggatcctatcaaaagagaacaaaaaagagaaatgagccaattgttgcagaggaaaagcatgcagagatctgcttcaagtttactctgaaccacagacgctccgggaattctacacaccaggagctgtctcactccaggaagtgggcacaacccaccatccacacaatggaaacaagaatggccaggaaatgtcaccgaagtgggacttccatatgcaggatcagcgttcacagtagcacaattctaaccaagttcaagggaaaacaaactctgtctcacacaaacatgggaatacaaaattgttgagccctagccatcactgtctcttaacattatttgctatcaaaaagacaaacgaaatttagtcacggacttttgggtgcctattcagctgcacccgattccaggggcagcttagtgtgctttttcattacaaaaaataaagacattaaaaatgcaaaacaa

SEQ ID NO: 223007 - DNA, 393 bp, Homo sapiens
gctggagatgagaattctcttcaactcagcaattctgttgcagaatgtatatagcctagaaaaattctctaaaatgaacctaagaagacatgcacaataaattcattgagactgggcacggtggctcacacctgtaatcccaacactttgggaggccgaggtaggaggattgcttgagcccaggagtttgagacagcctgagtgacatagtgagacgtcatctctacaaaaaagtaaaacaattagctgagcatggtggtgcacacatgtagtcccagctactggggaggctgaggtgaaaggatcacttgggcccggaagataaaggctgcattgtgttgtgattatgccactgcactccagccagggcaacagagtgagaccctgtgtcaa

SEQ ID NO: 223008 - DNA, 484 bp, Homo sapiens
ggtttcacatattttcaataatgattttatttaatactcatgcagtgggtaaaattaataccagttaattttactggtagaagattttaaatttaaaaagaaaaaatgaaacataatctggatttttgtatgaatccatgttaagctttgccatcagtaccagactggtccctctaccatttccactgcttccctttcagtcaggattgcatttgctctactgccttttagactatcctagaaaattgaggagattctaagtcatcccattcatgacgattactaaggtttttgtcagtctacataaaacttagtcgtgtgccacagataactttaaaaaacccaatgtatgcaaagattttgttttgtttgttgttcatatgtattctttctgttttgtttctgaaatatttcaatatgtaagaccaactattggcatcaggtctatatcactaaacataaatattaaatgttgtacttgaaa

SEQ ID NO: 223009 - DNA, 156 bp, Homo sapiens
tagaatcgtgtgcgttagctgacagatgagcattctcatggtggccccatcagccagccagtatcaccatcttttctgtgtaataatgctgtatgtataataatttggcaatttattaagattataaaataaataataaagatttaataagattga

SEQ ID NO: 223010 - DNA, 358 bp, Homo sapiens
gagatggtttgactagtgtcttttttgtaattaacattacataatttaaaacattgcaatttaagagtttaattgaagtcacagatgttttaatattatattacaattgttgaagctaactagaaatgtgtgtggttgtgttttaataaaactgtattcacaaaaacaggtggtgagttgtatttggcctgcagcctttagttgactgacccctgctttaaactattccctcagaatcacctcccttatcccaagttttacttactcctttgtagttagaagtactaatgtgaaaaagtatgaaaagcattcttcaacaattcaagtaataggaccagttttgcttagctcataaact

SEQ ID NO: 223011 - DNA, 397 bp, Homo sapiens
tctccaactgctgctccgtttatccgttatcctttgcagcaaacctgtgcttgctatctttatctcctaccattctctcttgaaggcattctagttaggctttcacccccacctggatatcaaaactgttcttgtcaccagagacctccaggaattcaagttcaatggccagttctctgctctcaccttaattgccttagcagcagcatctggcatgattgattactcccacctccttaatacactgtttattgccttccaggacaacacatactcctggttttccttctacctcactggtcactcctgattctccgctgtcttcttccctacctcaaacagggttcagtcgttggtccatttctctttaaatacttttatcctctatagactgata

SEQ ID NO: 223012 - DNA, 441 bp, Homo sapiens
aaaaaaaaaaaaaaaaaaaaaatcaaaatcgctaaaatgattagaaatacaatataagaaaaaaatgtaagaaaaagtgaacacaaaggtattgtgagacactctaacacaaatatcagtttttgatagataatatagatcatttatattgattatggtatatatataccatttataagtgagaatatgcagtatttggttttccgttcctgtgttagtttgctaaggataatggcctccagcttcatccatgttcccacaaaagacttgtccttgaggacggagggtggaaggagggaaaggagcagaaaaaataatgggtaccaggtgtagtacctgggtgacaaaataatctgtacaacaagcccccatgacacgagtttacctatataacaaacttgtttatgtgccccgaacctaaaagttaaaataaaatgtaaa

SEQ ID NO: 223013 - DNA, 413 bp, Homo sapiens
agtcgctgaaaagtatgaaagtcactgaaaagtatgaagtcactgaaaagtatgatttttcacacctacaaaaatggggttaattaccttcaggacctcacaagacaaatgattatgacatctgtgtaaatgttggtttgcttggattgagtcactgctctatgtgactttgtgcaagtgaattattagcctgagcaactgtggagggaaggatgaaatcaaatctggaatattttgagaacaaacaaaaaataaaaatatcaccgctgtgaagaaataatttaagaagctttattttaaaaggcaaaggccgagcaaagtcactcacctctttaatcccagacaggaggatttcttgaagccaggaatttgagacaagcctgggcatcatagtgagaccttatctcaacaaa

SEQ ID NO: 223014 - DNA, 395 bp, Homo sapiens
gagaccagagtaaagaagatatggagagggctgtggaccacaagtttaaaactttgccaaagtattttacttcgtgtccatgaaaatcttttattttcctctgagaaattaataggcttttttatgaaagacagtgcaaactatataatgaattttgttaattttagttttatgtcctaatttgtttttcctatgaaggccagattcaaatttgaagcttaattcttaatgaacttatttctgtatatttctaattgaaagtttctccttaatcacttatgttttcctaattttgatccacttagggttttccatcttttgttgagattattgttatctacttttcctgccttatagaataagataataaaataaatacatcatttaaaactcac

SEQ ID NO: 223015 - DNA, 251 bp, Homo sapiens
gacgggcaaagctctccatcacacaggacctgcttcttcaagcctacagtttctcaggccaggttctgtgcagcccagacacagttgttcagatctggggtgtggaccaggtggtgccagaggccctaagaatactctgtttactttgccttcctcatcagtctctttcattcctaactcactgagtttctccacaaaatccacattcagaagattttcagtaatttgactgactgtagcagcatacacag

SEQ ID NO: 223016 - DNA, 856 bp, Homo sapiens
ctagcctttcttgttttattattagaatacaaaaagacaaaaaaaatcaaagaaactttcacttgaggaatacaacaaataaaagtacattttaaaatcacagtagaaaggaacatagtattaaaaggaaggcaatctctaaaaggtgaatcatattgcatgcttgtacattgcttttgtgatgaatctcttcagtatacaaatggaaattctttttgcaatacttcagacaattcaaagaaaatcatatcattttacttatagaaaattgagcttgattatatagtgttattgtagaccaaataatttaggatagatgcagggttgaatttcttaaaaggtaacctggctttcagttgttttctggtacaagaatacccaagtaaaagtcacttgaacaataatatttctggttagctcagtggcccatgttctctgagattctccccatctttctcttacaggggcaagatggctgcagaagctccaggaatcttgtcctctcatgacattgtccaaaaccaaaaaaagggaaaacattttcttcacatttctctctccttttgacaggaagcaaaatgtccttagatgtactcagcacaatttccccaggtgtgggtatttaggccaggctctacccgaataagagactagaaatgggagtgtgtggaatttctagcctctatcctgggtgataggctctgccagtagtgagaagggaaagaaaggggactacgctgtgtcaaacagctactgataaatggtgtgtagcagagatgcttaaaaagaaaaaagttacattcttattaatatcaaattagtgtgaccctaaccagatgctgaaataaactatatt

SEQ ID NO: 223017 - DNA, 246 bp, Homo sapiens
gcaaatctacaccttggaaatagtagtaaatgacataagcatattaatatttatgatgtgatttatttttgttttcaagtcatatactggggaagattctcaaatattaaaacaatgtatctttacatttatgtatgtcgttcttgttctgttttagaaggcttgtatttgcatttttaacattccaaaaggtaaacctgtaatcataatgttttcatcaattcaataaaaccattacgtttgtaa

SEQ ID NO: 223018 - DNA, 638 bp, Homo sapiens
agggaatgcagaatcacactcaaaatggaagtaaatttctgatgaactggttataaggtaaatcgagaggaactggttttaaagactcgtttacgtgtaattttcatttttttgcttgcaataactatcaagggaactgtgacatctagtcagactaaagtgtgcaaactgcttctcacatgttccctgtgcctctttttctttcttgtcctatgattgtacaggactctcccagttggggttgcagcctccacggaaggggagtcattttgtattgtttggcttgggttttttgtttgtttgtttttttgaggttgctcaccgcaacctccgcatctcgggttcaagtgattctcctgcctcagcctcttgagtagctggaatctcaggcacccaccaccatgcccagcttattttttttgtatttttagtagagatggggtttcaccatgttgaccatctgtctggttggggtgcatgctaggtaggagaacctggccctcaggtggagcagagtctggaactcgcagtcatttttcaggaaagccgtggtggtggccgaagaggcaactaaatgtgatcaatcctagagacacagcacatacaggagatcacgtatttgagtgtgattctcggcg

SEQ ID NO: 223019 - DNA, 420 bp, Homo sapiens
ctcatgtgtgtccagggatacatcatttaatcaagaaacactaagaacaaaatcttgcggagaaggatctcagtaactggtgggtaaccaggactggtttcacaagtgtaggacttatacagtaacaccagtaacacagtccccaagcacctctccccgacctgccccacatccctacttggtttaatgctctactgtgctaaaaaaattcttaatacattttgaacaaggagttctgcattttcattttgtatcaggcaataagtttgtagccagtcctgaggttaacaatgtaagacctggattacagacctctcctttctgggaaatcccttctgtctgggcaccttattactagttgcaatatttgtcagatgtttttcaaaagggaacataattaaaataaactgctactcccta

SEQ ID NO: 223020 - DNA, 582 bp, Homo sapiens
caggaaggagccatttcactgaaaaggaaacgcaaatggtagtcaaaggcaaatttaaactttttttatcataaaaaaaaatttaaatgaccttgagaggatatgggagaaagaaatgctctcagtctcactggtgagagtgacaagtgacaattgcatcttccttcatccttaacacctactcagcatgtaagctgagcaatatgtagagtgtattaaaatacatttccaagaaaccaaagagtacaaggtaacacgggaggagactattatcttcacggcctttgatgcttaaaaggtatttgataatattcgacaagtattcctcaataaaatcctagaaaacaaggatccgaggaatactttcttaacattaaaaagctatcagtaattatacaggcaagtccaatgctgaatgcattacaattaaagtcaggataaaaaatagatacctgctttttctgtaattctagtataattacactaaaagaagaaatttaaaaaacattaaaacaaaagagacagcgtgccttttagcaaggtaatatgctatatacttgaagcacatgtaacaatccactg

SEQ ID NO: 223021 - DNA, 449 bp, Homo sapiens
aacagcatcgccttccacgccgccaaatgcacgctcatctcccgggaagacgtggaagcgctctacacctcctgcaaaaccgagcgcgtcctcaagaccaagcgcaggcgggtcggccgggccctggccacaaaggcgccgccgccagagcgcgccgctgccgccagcccccgcccgggattttggaaggacaagcaccaactttggcggggcctgagcggagccgcgcggcccctgccaatcagcgcgcagtcccagcgcccgggcgccgccgccgcgcgccccgccgcccatctacctcagatttttagcaaataccccggctcgcactacccggagatcgtgcgctcgccgtgcaaaccccctctaaactatgaaactgccccgctccagggaaactacgtcgccttcccctcggaccctgcttattttcggagcctgctgtgcag

SEQ ID NO: 223022 - DNA, 368 bp, Homo sapiens
caccatctcctgagctcaagcaatccacctgtctcagcctcccagagtgctaggattacaggcgtgagccaccacatctagacggtttcctttttttaaaatataggattttacagctagaaatttccctttaagttctcttttaccacatccatatatttggatatgttgtatcttcattttctttcatctcaaagtattttctaagctttttggtgatttattctttgactcactggtaattgaggagcgtgttgtttagttttcacatattttaattttccaaatttctttctgttattgatttcttacttcattctattgtggttggaaacatactttgtatgatttcactccttttaaattta

SEQ ID NO: 223023 - DNA, 485 bp, Homo sapiens
tagctatcacaaattaattcacttgaaaacaccccatttttaatacttaaacatacacaatcatatgtacacacacagacacatatatacaaaaaatggggtttgaaaaacttttgtgtctagtctcttctgatatgaagtttcaagtgattttgcccagcttttgctgctatcttataggtaaaattctccaagcaaaataaacttgccaaatcaaaacatagttatcaatcactatggaaaaaaagaacattgatacaatttattgatttatttatttactcattcattcactcatttaacatatatttaataaatacttgctaaaatgccagacaccaggctaagtgctagaggtaaaatgctgagcaacaaatgaaacatgatccatgctttcatagagcttacaaactaatgaggaagctagacattaacatattacacacaggccaggcgcgatggctcatgcctgtaatcccagcact

SEQ ID NO: 223024 - DNA, 555 bp, Homo sapiens
tgtttcatgaatatttagtttgtatgctatcttttgcctttgtcagtaatgctgttgcaatcaatatccttgtacacgtcaattcttacaagtaggagtataaatacaggatgaaattccaaacgtagatttgctgtgtcaaggggtgtgtacctttccaattgataaggtattgccaaatgtcttcccattgaggttgaaccaatttatatactcactagccttgttgctaacattataacacaagaagcattaaaattgatttttgaacaaaatcaatgtatatgcttttaagtgttctttctttttaaaaaatcattattggaaaatgcaagcaggaatacatggcaagcagagcccatgcaatggccagaattcctacagcagaaatgacttcaacatttgtttataaagattttctccaaatgatttgttgaaataacttgagtcttcaaggtttaattttccaaatgttggctcaaacctgcactgaaattctggcctacggtgtcctagcaaaaatctccctttgcaagatgctgaggtatattggca

SEQ ID NO: 223025 - DNA, 412 bp, Homo sapiens
ctggctgatggggacatggggattcttaatcctgttcacctacaacgtgccatccaaagggaacctcagaagtagtaattgcccacctttatgggttgtgcatgcatgactgccaagcagctttccacaggcatcacagactctggtgtcagacaagccttggagcaaaagctacagatccagtgtctgggctgaggcaaggtcaggttatgcctgtgtggaactgcttgccttcaccagtgactggggtaagtggccaggccaaaaggatgtgaaatggtgctcaagagttctggtcccctggaggccctgactggagccaagtgtcagcacacgaaacatcatcagctcattctggagcatttactttaactcaagtattaataaataaattggaagtcaattcacagat

SEQ ID NO: 223026 - DNA, 375 bp, Homo sapiens
taacactgttgtccaaagacatttcaccataatataagcaaccttgtttcatgaattggggatatcctggaactattccatgtaaatgaaatttttggaaatagcctcacttaaaaaaaaatcaacatactgagatatacatttcagtcatctcctaccccaaccactaaccctggacaagcactgaggtgttttctgctaggctaaactttggttttgcatttcaagtaaaggaataagacagaagatgttcctttgtttctgaactttaatttttgctaaaaattatttacattatatatttttagaaatgtttattttttgactaacaatttttagaaaaacttttaggttcaggggtacatgtgcaggttt

SEQ ID NO: 223027 - DNA, 395 bp, Homo sapiens
ctccagcctgggcggcagagcgggactttatctcaaaaaaagacacaaagaggttgagccaggtcaacccacaggaccatgaatatttaaaaagtggtattctaggccattacatatgtggttgttggcgacacagcaatagataactgaaacagttggtaatttaacacctacacagtcctctggggtagacgttattgttcccatttatcagaagaggaagtaaagcccagagagagatgtgactcagtaaggctcacctagccagctggaggcagcaggtagggtttgacctggcaggttcatctgaaaccagtttgttttctttacagagcacatgcctggctgcctgaagcagttgaccagaacttgcagccaaaccacgtggttttggt

SEQ ID NO: 223028 - DNA, 481 bp, Homo sapiens
aatctcaggccatgtaactgggttctgccacagggcctccacccagctgggccttcctctcgactatccacattcaacatctagcaaggggagtgcctggcactcgagtggattccatttccaagccagccatcacctctaatgatgtgcacatctcctgtgaacctggatgccttcctagataaacaacaaagtcttacaaacacaacttactcccaggcccagagagttcctaataagccaatgttggtgtgtgtgggtgtgatgagacccgcgagaagtccccagatggagattgaagaagtggaaattcggtgctaatgctaattcttcatttagcactgtttcagccatagttaaagcgtgcattggggccttaaaaaggttatgtttataaggaagaaggaagacagtccatgtctgacttgctgaacatgcaaaacgaaaacaacaacaaataaagtaaccctggaactcctcc

SEQ ID NO: 223029 - DNA, 339 bp, Homo sapiens
gcccagaggattaccaggctgagtacactggtgcaatcactattgctcacagcaacttcaacctcctaggctaaagcgatcctcccaccttagcctctccagtagctggaactacaggcgtgcatcaccatgtccagctgattttaattttaattttgtaaaggcagggtcttcctattttccccaggctgatctctaactcttggcctcaagcaatccttcctctttggcctcccaaaatgttgggattacagatgggagcccccatacccaccaatcacaaggatcttataagagaaggaggtaggagagtcagaattagagaaagtgatgtggtaa

SEQ ID NO: 223030 - DNA, 540 bp, Homo sapiens
cctgggcttaatgctgttactttccattagaaaaagatcaccttatcattcatcagacactctacagaatctcagaattatggttctgcacaatgtaagtgagggcatacatccacctacccaggaactgaagtggaatctcccccaccccacttgtggcatctccccacgattgctcttcagacaaatcctcatctgtttagttgtcattctgctggggacaatgcaatctaagttatttcatttagttattttcatccccttcccctctctcattgtatccttcaccacagacagctcttccagtttccaataattgtttatactccttatttctttttctttttttttgagatggagtctcgctctgtcacccaggctggagtgcagtggcgcgatctcggctcactgcaagctccacctcccgggttcatgctcttctcctgcctcaacctcctaagtagctgggactacaggcgcgtgccaccacgcctggctaattgttttgtattttttttttttttttttttttttttagta

SEQ ID NO: 223031 - DNA, 370 bp, Homo sapiens
tattcatagagttgtacagccaccatcataatgaattttagatcctttttatcaccccaaagaggaaattaatatccattaacagtcactccccatgtcccctgccctgactctcccagccctatgtaaccactaatctattttctacctctgtagtttccctgtactgggcattttatataaatggaatcatgtaatatttgctcttttgtaattggcttcttttacttagctagcattatgtttcaaagattcatccattttgtagcatgtatcagtacctcattcctttttattgccaagtaatagaatggacatttgggttgtttttgttttcggctgttataaaaaataaaaaattactctatga

SEQ ID NO: 223032 - DNA, 548 bp, Homo sapiens
tactaattttggatttggtttttacttggatttctagatccttgaggtgcatccttcgattgtttgtttgaaatctttctactcttttgatgtaggtgtttattgctctggacttccctgttagcactacttttgctctatcccacaggttttggtatgttgtatttcgatttttatttaaggcatttttatgttttctccttaatttcttccttcacccagtggtcattgaggagcatgttgtttaatttccatgtaattgtacagtttctagttgatttctagttttaaacattgtggtctgagaaagatacttgacatgatttcaatttttaaaaactttgttgagacttgttttgtgtcctaacctgtggcctatcctgaagaatggtctgtgtgctgagaaatgtgtattctgtagttgttggatgaaacgttctgtaactgtctgtttagtccattgtcctaacgtgcagtttaaatgtaatgtttgttcattttctgcctagatgatctgtctaacgatgggagtggggtgttgaagtcct

SEQ ID NO: 223033 - DNA, 666 bp, Homo sapiens
gcggcccacaataagaaaggctgaaggggcgggaagaaatctgagctctgtgatcctccagagcaagcctctgggacagggcccctcaggaggaagaactgcaggaaatgaaatcacagttgagctggatagggacacaggaaaggaaggatgagatgtagaccaatgtggggaagaggaacaaagacaggaactcctgaaagccatctcccacgttttttaacaccacacagaaacaagggagagttctgagcttagactttcctgagcctttcttatcaggaaaactcatctcacctaaaaataacagaaaagtatttgaagtgaaattgcatacagttgttatataagaaacaagaatatgcaaaataacctccctgcggacaatgagagcacattagaaagacatgcccacataaccgagccaagctgtaacctgctatttcaaatcaagccaggtgacattctaacaatacaaaacaagagagaatagtgtaaatcaactttttaaaaatcagaaataaggtgacagaactcaggaaagaattagaattaaaaatcatttcagaagtaaagaaagactaagacgaaatgcaagtgtcgatgaacacagcagatcctgcctgaaaaggataaacagtgtgaaaaaggaaacatttcaagagc

SEQ ID NO: 223034 - DNA, 442 bp, Homo sapiens
tgtggtttaatgtgcaaaaattttcttgactccaactaaatacagtcccctgtagcagtggctgtttagcccctcagttccatcccaaggaaagtctttctacctattaaagaacaaaaatagctttaggttgcggcaagataacccacactcggtaggagtgtaaagtgatacagtcttttgctacagtaacttggaaatatattaccacagggcaaaaaaaaatcttatttttaactctttgaacaggcctttatttcatgttgtggtcactatcccaaaggaaataataagctaagtgaataatgaaaattcatgtgaatttatctgtggggtttaataaaatctccgtttgttgtgagtatgcattagcaagccaaatagtgtctttcacctaaagaaaatgtatcccactatctccactacaaacactgaaaagttc

SEQ ID NO: 223035 - DNA, 441 bp, Homo sapiens
acatccctatttcccacaatagcctatagcattttgaaagaacaagatttattcatcttttttctttggtaccaagtagttgatagggactcaataaatgtttattgaataaatctgtcacaactcacaagacagatctaaaaatccatgaatatcctatttaattattttaagataaattatgttattataccataagatattcaataagacataaatattttagttattaattattgtttaaaaaaaaagagccagaagggaaaagccacctaacagcacaaaaaatctgtaagactcctttaaggtttttatgttttgatgacaaacagaaaccaatcacctttaaaaggaaatgaacacaagaggcagcagataaaaagttaaaaactacagcttatattaataatcaacaacttttacagcaattcattaattaga

SEQ ID NO: 223036 - DNA, 390 bp, Homo sapiens
cctgcattttcatctcacacagtcaccattattctgccatatccttaaattttcttctgcaacatagtctctaacccgattccattgtttcatgtaactgactccttttctttaaaatgcttaattgtggtaaagcacacataaaatgtaccatcttcaccatttgtacgtgtgcggcttagtagcatgaattatatttcacactgttgggcaactaatctccagaatttttcatcttgcaaaactgaaaaccaattcctgcctgacgtttgggcttcttacattaaagaaatatttttagcaatgttttaataagcgtctttgtagctaagtaatgggaaccacctgaacctgcttcagtggctttcaggatacattcttagaagtggg

SEQ ID NO: 223037 - DNA, 471 bp, Homo sapiens
gaaccagggaggtggaggttgcagtgagccgagatcacgccattgcactccagcctgggtgacagagcaaaactgtgtctcaaaaaaaaaaaaaaagaaaaagaaaagaaattaaatgacaacccacaaaatgggagaaaacatttacaaatcctacatctgattaaagacttctatcaagaacatataagtaactctcacaactcgatgaaaatatgacaaataaccaattaaaaataggcaaagaatataaatagacatttctcctaagaagatgtacaaatgttcaatatgcacatataaaatggtcaacatctagacccaaagtaaatacaaataggaacctaatgcgataccaatttacacctgctaggatggctataatcaaaaagacagaaaataaaaagtgtttgtaaggacggggagaaattagaaccctcttacactgtccatggaaacgggaaatagtgc

SEQ ID NO: 223038 - DNA, 442 bp, Homo sapiens
gcacgagctagaaaggactgtctactataacaaggttcttctgttaaacatgactttcttaaactacaatgtgccttgttcgtgagtaaacaaaagcatacaaaatagtgcctaattgccagcaactgagatgggtaggactgtgtagaaagcactaacatctggctgggcgtgttggctcgtgcctgtaattccagcactttgggaggccgaggcaggcagatcatgaggtcaggagttcgagaccagcctggccaacatagtgaaaccctgtctttactaaaaatacaaaaattagccaggcatggtagtacacacctgtagtcccagctacttgggaggctgaggcaagagaatcgcttgaacgtgggagatggaggttgtggtgagctgagatcacaccactgcactccagcctggaaaacaaagcgagactatctca

SEQ ID NO: 223039 - DNA, 680 bp, Homo sapiens
atagaaatgaagaataggtttttatgttaactttttaaaataatttatgtttatataattccaaacttgtagaaaaattgcaagaaagtacaaactcctatatgccccagttaacattttgttctgtttgttccctctccctcactatatatttatgtgcttgtgtatatataaatatctatatccattatcattattctttttctgatccatttgagagcaaatcgtgaacataatgcctcctcacctctcaatactccagaatttatatccgccatgcaagattactcccttacctagctatccaaatcaggaaatcaacatcagcagatactaccatccaaaccacagacccaatacacatttttacgagatgttccaaaaatatcttttttatttctgacttgagatccaatccaggatcatttattaaatctagttgccatgtctctttagtctccttcaatctagaagagttcctcagtttttttccttttatgactttgacagttttaaagagtagagtccttggaaccaacccaaatgtccaacaatgatagactggattaagaaaatgtggcacatatacaccatggaatactatgcagccataaaaaatgatgagttcatgtcctttatagggacatggatgaaactggaaaccatcattctcagtaaac

SEQ ID NO: 223040 - DNA, 734 bp, Homo sapiens
tcaaactccagacctcaagtgatctgcctggctccgcctcccaatgtgctgggattacaggcatgagccaccacacccggccaaatttgcatgttattaaaagtaggtataaatgtggctgccagactgcccggagctgctcctgtctgcctacagggtaaacctgctctgcaggagcagtcacagggttgtaacactaccgcttcaataaagctgttttcttttaccttcagcttgcccttgaattctttcctgggcaaagccaagaagtctcatgggctcagccctactttggggcttgcctgctctgtatcagattgatctgtgcttgaagccaagcccaccttttttgtttttgagactctcttgctctgtcaccgaggctggagagcactggtgtgatctctgcttactgcaacctccacctcccaggctcaagcgatcctcccacctcagccttctgagtagctgggactacaggcgtgccacagtgcccagctaatttttatatttttagtagagatggggttttgccacattgctcaggctggtcttgaactccgggactcaagcagtctgcccacctcggcctctgaaagtgctgagattacaggtgtgagccaccgcgcctggcctgcggttcctggttctatgagccagtggattcctttttctcttcagcttgtgcgagctggatttctgtcatttttaactgaaagataggttttctaaca

SEQ ID NO: 223041 - DNA, 338 bp, Homo sapiens
atcatagtctgctggtgtcgttattttaccagttggagtgaagagtagaaatctcacctccatttatgccctcacatttagaattatcttaaatatttcctttacatacatttagaaccatatcagacagtgttataatttttgtttcagccaccaaacatgattaagaaaacttgctcgggagtgttggctcatgcctgtaatcccaggactttgggatgccaaggcaggaggattgcttgagcccaggaggttgaggctgcagtgatccatgtacgcaccactgatcaatgtatgtgcactccagcctgggtgacaaagcaagaccctgtctcaaa

SEQ ID NO: 223042 - DNA, 426 bp, Homo sapiens
tccgcgcctaagctgccctcggggtctcctactgcgggaagggcacagcaggtggcagcccctgtcccagccgtgggattccttccccgaaattgtggggggagaacacaaggggtagtgtcaccaagcggccagtaggagaccctcccaccctcctgcgactgctggttcgggtccaccccgggcggagggggaaggggccaccggagcgcaggtggtctcggcgcagcctcctggggctgggacccaggggcgctgatggggtaccccgaggcgtaggccgcgcccccctaaaagctgagcatatctgggctcccgagtaatgctccaagcgcagagctcggtgtgacactgaccaaattgttacctcagatattaattacggacagatattaattacggaacaataaaacggtgagaaagcac

SEQ ID NO: 223043 - DNA, 514 bp, Homo sapiens
gattccaacatactttaaagaatatttatctaataatattcttaaagaatagaacacatattccgattagcattgaatgtttcttaatgaataatattacaagaaatgaaataagactattattcatggttaaccaataacaagagtgtgtttttctttcttcacaacttaaagttataaagtggaaagtgagtataagtttagaaatttttaaatattttggtagccataaaatctagaagtaagaacaaaagttgttcatagagtattataatgggaataaacagctatgtgaaaggaaaaaaatataaactttttttcattttaatgtaaaggtgtgtacctatctaaaattcttaacacttatttagtcccccaaattatttctttgtatttccttgtaggtctccttgggaaacttgttccaattcaactattagacatattgttattaacattaacttactttcttaccctgtaaatataactttttttcagtagttttatcatctgt

SEQ ID NO: 223044 - DNA, 415 bp, Homo sapiens
gatatctagaatcactataaataatgatctactgacagtaactgctttgatatttccaggtcagattggctttcttgcctctcaggaggagatagacttttactctaacaaagtgatgacctgggggtttcagggcatgcttcctgaggaagtgacattcagacctgaaggatgagtaaagctagtcaggggaaagtatgagggaggggataaggagatgacggagaaagaataactacactctgggaactgaaagaagcttcatctagatggctgaatgttgtcatctgaaattgattgcttaatcctgttaatccttttgattttaattcttcatggaagtgatctattaacattcctttatagcaacaattgaatagaatttattaacatctttttttccttatctagcaca

SEQ ID NO: 223045 - DNA, 534 bp, Homo sapiens
aaggtctgggtagacattttcgtttaatacttgccaacgttgttaggctggtgttagcaacacttaggaatgttggaattaaggcttagagaacttaaatttcctaaagagatagtaaatgacaaaacctttcagtgatgccatatcgtcactgtataatgtgaatttagtactactgttagccatttatatggtggttatttatcaagtatttattaaatgggcatatgtatagctcatatcgtaaactatgcgtatgagctccctgtcctgaagaaattaggggtttccatgagaaagtaaatggcagtataaaacaacttaaggtacaagaggtgttacaaggtaccatctgctcatgcctggacaattgcagtagccgtgagcatagctttctgcattccctttatttctctacatagttgcattcagcagctggagtgatcccattagaacctgaatatgccactcctctgtgcagaaccttttagcggtttaccattttactcagattaaagttcaaaattcttaccc

SEQ ID NO: 223046 - DNA, 270 bp, Homo sapiens
gacatacgaaacagttgccaacaacccgtggtccagttgtgcctcctttgtttgctgctttgtcagagtctcactgtatgcttttttttttggcctttggcgctgtgagcagagtcacctcatcctcctttccgtggccaactcaaagacttacaacctttctccctcattcctatgtatctacagaacactcactagttgctaactagtggatacatgtgaattatgttttgatgccatagggctgtctagtggaggatacaaacatta

SEQ ID NO: 223047 - DNA, 298 bp, Homo sapiens
tctatccttggaattgtgaagaaggaaaaagatatttgctagttttgctgttgcacctcaaactgcaaaagttaccaccacggttcatgcaaagtgcttagttaagatggaaaaggagttacatttgtgggtgcaagacatgaacagagaggcattccaatcaatagcaatcaggttcagggggtaccttcctcagtttcaggcatccacagggggtcttggaaagtattccccatggaggggggcggggagggctactgtactccatacttgttctaataaaactttttagaaatct

SEQ ID NO: 223048 - DNA, 431 bp, Homo sapiens
agagactgactgttgcaggttgaactgtgtcctccaaaaagatatgttgagtccctaatctccagtacctgtgtatgtgaccctatccggaaatagagtttttgtggatgtaatcatactggatttggatgaaccctaatcgaagatgaccagggtccttctaagaagagaatagatgcatgtgcgcgcaagcgcgcgcgcgcacacacacacacacacacacacacacacacacacacagaggaccatgtgacagctgagagattggagtgacgtgtctgcaagcaaaaaatgccaaggattgccagcaaccacctatggtctcctcccctagatcatctagagagaacacagccatgctgacatcatcatttcaggcctctatcctctggaactgcaatataataaacttctgtagttttaagccactc

SEQ ID NO: 223049 - DNA, 440 bp, Homo sapiens
agccagtttgacattttaagttatttgcaattcctacaaaagtgctcatactcagaaagtctctcttctaaatattcagctaaaatattttaaaatataaaaatatttcataatttacccttaaatatgccgaaatgtaactcaaagataatctaacttttcttatttaggaatatgtatatattcctaagtgtgctacaaaggagaaaagagagaaaataattttaaattaaatatgtattagatatgtagatgctcacgtacttctacacttgaagttaaaatagtcacttgtactcacacatagaaaactatagatacaacatctacacttgcaaactgtagagtggtgtgctgataactttaatgcaatgagctttattgtcatttgtgagataactgtcttaactggtgaacaattcttccttatgttgtggaaa

SEQ ID NO: 223050 - DNA, 546 bp, Homo sapiens
gagcagaccatatggatccttgacagacctgtggcttttattcagtgagatgtgaagccactggacagtttttaggagaaaagtagcatgatctgatgaacattttaaagaaagtgatcatataatttatcactaaaacaggtacaccttggtgagtgaggaagggtgatattaacagttaccttaggacagtattaataagacctaattttttgttgttattgttgttgagacagagtctctccctgtcgcccaggccttatttactattattttttaagacagggtcttgctctgttgcccaggctggggtgcagtggcaccatcacagctttcactttccagattcaggccattctcctgcctcagcctctcaagtagctaggactacaggcgcccgccaccacgcccggctaattttttgtatttttagtagagactgggtttcaccgtgttagccaggatgctctcgatctcctgaccttgtgatccgcccgcctcggcctcccaaagtgctgggattacaggcgtgagccaccacgcccg

SEQ ID NO: 223051 - DNA, 960 bp, Homo sapiens
ccgcaaaagagtcttctaaagaccactctcagccctcaagggtccttgcaagtcagtgacaccacaggaaatgggaaccttgccaagaattagggaaattcaggtgtctgcaagtccctaaaccctagggccaaaaaaaaggatttggcagatgtttgtgtgtcctggaggcagatggatgaaagtatcagtaggctccgtggcttaagtgctagtcagtgctcgccattggtcttttgcagtcttgtcacttctgtctggaggcattcagagagctgaaaggtacacagtgcagtggtaacatctggaattgacccctggctccatcttcatgattagtaaagtcactaagcccctttgagagcaagatcaaggcagtcacagtcacaggggcattatgagtatcacgtaaagtcatgtattcatatatgggaatgctttgtaaatagaacatttctgtataaatcttgctttcagttagtgagtttgtgtattttttgagttggtctctctgtaaatgtgccttctttccctagtacatttattattactgagtccaggtacgttcgtgtattagttaaggtataggctaaggtactataatagaccccagaatatcacagtttaaacatggtagaaatttgtttctccatgtaacagtctagagctgcaccatccagtgcggtggccactaagcacatttgattatttaaatgtaattcgagcaaaataaaaagttaactgcctcagttgcactggccgcatttcaagtgcttagtagcctcttggctagaggttactgtattggacagcacagataaaacatttccatcattggttgggtgtggtcatcctatgtgcttatgcgtatcagcactttgggaggccaaggtgggcagatcacttgaggtcaggagtttgagaccagcctggtcaacatggtgaaaccccatctctaca

SEQ ID NO: 223052 - DNA, 104 bp, Homo sapiens
ataaggagcataaggggatgaagagattgggtagaggggtattttatataggatggtcaagtggtcaagaaaggcccccctgtggaggtgatatgtaagcagaa

SEQ ID NO: 223053 - DNA, 430 bp, Homo sapiens
cactggctagaagcccaagtgtggaagtcagaggtgtgagtgctgtcagattctggacccgggaaaggccaaggcgcacagccggttgggggcgcacagccagtgggggacccactgctgttcttcctgtgaggcttgggtgtgagctactgtggggctcactgcaggagaggtgggggcagatgagctttgaaccccccatcctcggagacacaggagaatagagttgggaaagccaaggcactgattgaactgaaacctgggacagacaagttcctcaggtaacaagcgtcagaaaaaggatgggtaaggccagacatggtagcttgtgccagtaatctcagcattttgggaggctgaggggggaggatcgattgaggccaggaggtcaagaccagtctgggtaacttagtgagccctcctctctgcc

SEQ ID NO: 223054 - DNA, 429 bp, Homo sapiens
gaactgtgagaaataaaattctgtttttcagaagccaacaaaaaattttttttctcctctgtgctatctagtgggacagtccctagccagggtcgctgttgagcatttgagatgtggggagtgtgactgaggaactgaattttaaattttacttaatatgattttaaatttagatggtcacttgtggctagtggttcggctgttgggtagtgcagatctgaagcatacacaggtgaccctggaacacctcggggcatggggacactgtccccccatgcagtggaaaatctacagaggacttttgactcccccaaaacttaaacactaatagcctgctgtggacccaaagccttaccaataacatcaacagttgattcacacatattttatataaatattatatactgtgtttttacaataaagtaagct

SEQ ID NO: 223055 - DNA, 314 bp, Homo sapiens
ctcacttattaacattactttgcttaattcttgcgtcctccttctcactatccctatagttagttgcttctaatctgcttaggaaatcagctaagtaagcttgttagatttgtttccaaagggtaagtaaaaagacaagcagcctcctaaagttcggtttaaaaagccctacattggctgctcagtatgccctttcctccttctcttttttatttgaaacggagtctcgctctgtcacccacgctggagggcagtgagccaagattgcgccactgcactccagcctgggcaacagagtgagactccatctcaga

SEQ ID NO: 223056 - DNA, 430 bp, Homo sapiens
tgtctgacagtgttagtcgtgcagttgacgctggttggttggttgattgaatgaaagactataaggcagtgtgtactgtttaatgagttctgttaggcacttaggaagtgctagaggagttcagttagggttgtagttctcgccctggctgtgcatcagaattacctagagtgtgcttttgaaatatgaaggcccaagctccactttcatgtgcttatcttggtcttagtagaacctaagtgtgtttatataacatttaaaagatgaccataatgtacacccaggtttaagaatcattgccttagaaaaatcaggtttgggctggaggcctataatcctagcattttgggaggccaagacaagagaattgcttgagctcaggagttcaaaaccagcctgggcaacataatgagaccttatctctacaaaa

SEQ ID NO: 223057 - DNA, 629 bp, Homo sapiens
tgacaaggtatctctgttgcccaagctgaagtgtagtggcacgatcatagctcactgtaaccttgaactcatgggctcctgcttcagcctcctgagtagctaggactacagaaatgcacaactatacttggctagatttttgtttttaaagtgttttgtagagatggggtctcattgtgttgcccgggctggtcttcagctcctggcctcaagtgatccttccactttggcctcccaaagtgctgggactacaggcagaaactaccacaccgaacctactaactctacattttacatgatgagttcagattttaaaaggattagtttgctaataaagtgtcgtgagcaaagtgaaaaatcaaaagattacttgaagtatttacatgatgatccaaatttaaagcgacctcaacaagcaaaatttactgtttacaaaaaactgtatcacggtttacgaataggaacacatatattatatataatgggtataatgcgaatgcattttatcaatggaaagtacaaaacagcttgctgatgaaagaggaaggaaaaagctcacagtgaacttggaagcagatccttcagccccagtcaacccttcagatgtccgcagccactgccgacatcct

SEQ ID NO: 223058 - DNA, 369 bp, Homo sapiens
tctggagtgcagtggcacaatcctggctcactgcaacctccacctcctgggttcaagcaattatcctgcctcagcctctcgagtagctgggattacaggtgcgtgctaccatggccagctaatttttgcatttttagtagagacggggtttcaccatgttggccaggctggtctcgaacccctgacctcaagtgatctgcccgccttggccttccaaagggctgggattacaggcgtgagtcaccatgcccggcctctaccttcttctaaaaaagatttggggtggtctgtaattaaacacacacacacacatacaacaaaatagttcagactgacatcggattgtagaattgtttttaaaagcaaaaa

SEQ ID NO: 223059 - DNA, 458 bp, Homo sapiens
cctgtgtcccatcctcttcccatctgtatatgccaccagtaagctttaggaaacgccccacgaaatcagtcagcgctcccctcccatcttgctcagtggaggtggcaaagcccctctttttcctcctctgtccccaggtgctctcctctagcagcacaggaaccttctttgttcttgtgtgtcactgggtttctcaccaaggttgctttagggcccagaagtggcacagagaacatggccagtctcttactgggctgcatctaagctgagccctctccaggggtttcccagaatagtaaaccaggcacacacaggcagaaaagtctgagaagcagagaagtaggaatgcagaagaggagttggggagacctaggggtggaggtgcaagcctgggtcacggggggcggtggtaggggggtctgcttgttggtattaaaggaacaggacagtaaaccaaa

SEQ ID NO: 223060 - DNA, 236 bp, Homo sapiens
tggtgaaacccaaggtgattttttagtcctcatggcaatggtggaaactgttaactgttccctctttgttgtaacaatattattctactgctttggaattttaggctaggtattcatcttctcactgtatactcattggggatgtaaaaatctttaatacctttaattaccaattctttacctttcctctcaattccaaatctaatagcctacctcacatttctactttgtgtgtt

SEQ ID NO: 223061 - DNA, 307 bp, Homo sapiens
ctggtattagctagtcaatttaaagatgcacataacctgtgcaattccactcttaggtaatatcttacagcaatatctctaaacaggaacaggagtattcttagcattgcaggagattaggtatttagctactgaccattactaccagtagcaatgcttcccaactccccatcactgtgacaaaaagaaacatccacacacacttccaaattggagcagggggaagatacacagctccgagtgaggtccactgccctagagaagggtgtttctctacttgagtactactgacattctgaactgaata

SEQ ID NO: 223062 - DNA, 446 bp, Homo sapiens
gtggaggaagcgcatggctgcacggatggcttggagcaggtcaggatgaataggcatgcgcatgtatgcatgtgccaatacctgtatcgaaatgttttctacattaacgtctggttttagattttgaaatatacaggcataacaataaaaagaagaggccttggaaaaagcagcacccacctgctgggaacccctccctggccgcacagaagggaaagggcacttgtttgggtcctgtggtcttccctctacctctctagggaaggagatttgaaactcctacacagtagggtggaatgttaaatgcttgcttttccttctctctaataaatctctctaaaatgagaaaatctattctaatataaattctgggttggttggtttgttttaaatttttagagataaggtcttgcttccagcctgggtgacagtaagactccgtctcc

SEQ ID NO: 223063 - DNA, 512 bp, Homo sapiens
tggcagcagtgaggataaagaaaatgcatctgagaaatatttagaatggaaaaccacctaggcatgattttgtactaagggtgggtggaacagtagctaaaagagtcagatggttttatctctaactttgttttcaccaaacaagacaaaagaagagctggtttcgataggggttgatgatggggaaagaaatgtttcaattttggatatactgagtttaaaatacctgagaagaatatccacatgtaaatttatacatgaagttgcccattctggcctgcagttcagggaagaagtcacgataaatttcattctgctgaatttatcagagctgaagacatgtaaagaatgtacggggacgaagggcagaaaggcacgttgttagaagcttggagcagatagagcaaaaggccttggtgaaaacattttgtgtctaatttctctcgaccctgtccagtattgcacataacatacaacagagtgaaatatatgaatgaataaatttatgttat

SEQ ID NO: 223064 - DNA, 452 bp, Homo sapiens
aaatgtatgaggcttttctccgtcactaaaccttcatcgagacaggctggaagttcagtattccaatcacacacactagcagcaatctctttgtcttcaacatttcagaaatcctcaacttaatgttctcatactcaatttcgggtaacgaagaggagaagtcaataaagggtcagaaaataagttgtcagagaactaagtagagagacaggaagaaatctcaaggggaatttggtctcagtgaatatattttgagcacttactatttctcaggggctgtggtccataattcatagacattttcgctaaacacttacagcccaacgacatcaatcttatggggcctgttaatgatgaggagatggaagtcatgaacagttcaaggtctcgttcaaagtgccagactgaggacacaattgagccagctcaaagctaggccctgtgaatctaag

SEQ ID NO: 223065 - DNA, 1326 bp, Homo sapiens
caggcccatcgtccccagctgatgtcgccctgtctgcacgatgcctgggcgcctactccacactcctcactggcctcaggccccaccagccctgcctcgagctagcccctccacccgtcatcactcctgccagactccagatgtcgaaggtgctccttggctcccacaagctctcctccgcctctcaagtaaggcacaccaccatacctcactgttttcccagtagctcacattctaaacatacaggaagggttctcaaccccattttgcacatgagtttaaatgacctgcttgaggtcacacagtcatgagtgatggaacttgactgccatatgctcatgcctcccatctggacaccatgttgtatagattaggaacaatgcaaagtttaaatcaaagcagtcccttctaaattttagcccttttcaaaaaaatcctcttaaatatatcttattcttctgtgtcttatgataagccttgcaatacccattttacttgagacagatgctgataaggggagaagggaatggaggaacggtttagggcatgtggccaaatagtgatattgaagcccggagggtaggccctgtggtaaatggaaaatctgcacggtgccaactgaagcaagcccagcttccctccttttctcaggcctgcaaggagctggggctacacaagaaaccaactgaatggcccctgaagcttgttcctcaacaccgagctgtagggccttgtctccttaaacatcccctgtgctttcctctggccagctgctcaggccaactgcccaaatcatttccttgaaggttcctgtattaccaaactgcactgacaacccttgagtaatctgggaggccttgctgagagtccagaaaggtccaggtgcggtggctgcttcctcagcagatttggctccagctgtctggactctagggcttttgggtgactgcagggcttttgggtgactgcagggcttttgggtgactctagggcttttgagtgactctagggctttggggtgactctagggctttggggtgactctagggcttttgagtgactctagggcttttgagtgactctagggcttttgagtgactctagggctttggggtgactctagggcttttgggtgactctagggcttctgtcaacagggtcagaactgcctcagtgactctgagcagcccctttcaagagactgcagaagaaaagatccactcaaatctggagtaggagcaaggaggtggcgcaccatgaacaggaggatagctgacagagaggcagagggaagaagagaactgaatgagcctggggcaaaaaaaa

SEQ ID NO: 223066 - DNA, 463 bp, Homo sapiens
agttccagatactgctgctggatttactcaaggcccacttctattcctggtgccatacaagctgaaacattctgtgactctccatcaaatgaagcatgagcagtaaacacaacaatccaagtcttttgccaatgatatcgtggctctctctagtctcattttcccttgtttgtatcctaagcttcatccaacgtagacacattcttcttaaatatgtccttgattttcctccctccacagtatttcttctacctgttccacctccctttccacttgcagagtcctcaatcttctcctttaggacccatctgaaatgtctactccttaatgaaaacttttctgatctctctaatggcatgagatttctctatcctaaatactcattagccctttctttatatttcattgtactagatccagctatttaactgtaaatatttttttatcatccctaagaagtaaa

SEQ ID NO: 223067 - DNA, 518 bp, Homo sapiens
cagctcagatgtgctgtcgacccacaaagactctctcacttagacacgaagacacccgtatttgcacagacaccgggggaagagacacaggagggagagcagggtggaggttgtggctttgcgcctgcacacccatgaagaaggagtggactcgaggcacagttttgagaacatggtccgtctctttctctaggaaactcacaagccctgcacaggtgactcctgagtctccacacacacacactgacagccattcgggggtgtgaggttccgtctagaaaactaccactgccaacacctgcagcaaggggcccgttaacgcagatcacaggtggagggaggcgcagcccaaggccttccactgcgcaggaaacaaccgtgttattctgagctttccttccagattgctaattcctgtttctgaaaatcttcctgattcttcgagtgctaagaagcacttacctcatgcctccatctgttcctttatcctggctcctctttttggatcacacggccgc

SEQ ID NO: 223068 - DNA, 849 bp, Homo sapiens
ctcgatgctttactatactttgccttgccaagcgcgctcaccacatgcctgcggactgagcatgggacatcctgtccttggacaaggtaagaaggaggttaagtacaatcttactaggaccatcagccctcctccttccgggtctctccagcatctggcccggacgacctgtgccctctgctgggcactccctctctcccagatgtgctgtgaggctcttccttgtctgaagctgaactttctcaggcccagagcccttgcctctctgcgggcactcctcgtgtgctctggattcccaggctctgcataccatcagtagctgatgaccggtacactggggccatctgcctctcttccgagctccaggctctgacaacagactgactgctcgatgcctccacatggctctccatttggcatctcaaactcaacttctccaaatcagagctggatctcttccctaagtctcctagatgtcccctttgcagtaaatggcaccgtggttcaccctgcaccctcctggatccctttcctcattaagtccaccagctagttctgcccttcagtttccagcactcacctgcatggctaccccagcccaacccaaggcaccccacagggtctctgccttctgcaatctactttccctgacaaccacatgcttggagcctatggctgggatggctggttgctgtagctgaaagaaaacccaagttccttgctgtggtcttcagccctgggggtgtctggccccactgacctccctcacttctttatgagcactctttctttccccagccatgcttagtgtctcctcctcctcctcctcctcctcttccttccccctcc

SEQ ID NO: 223069 - DNA, 547 bp, Homo sapiens
ggaggctcttataacatgagagattatgagaccttgaaataaaatagtggttgtagcattggggaagaagaatttacttgagagatatttagaaggcagggttgaaagaacctactgactgggtagcagacagagaatttaaagtaactgagatttctactttaggcaactaaacagatgatgacaccattaattgggaaggtaaacataggagagaaaagttcttaaattgtaggggtagggcaataaggcattttctttggaatgtcaagtctgaagtacttgtgggacctctgggtagggaatgacgttcaagaggcaagaccatgctggtagtaaaaactgtgaagcctgttcacctaggcagctgtgaagaatcagatatgtagcttcaaaacagttaagggcaaaataaacagcacttcctaccagttaacaccagtttctctattctaggaaaaaaacagtcacttacatgccccatgatacaaggtaccctccccttgaactaattctatatctgactttccacctgtctagactaaag

SEQ ID NO: 223070 - DNA, 510 bp, Homo sapiens
tttgcgcatctgtgtcaatgagctgaaaggtaatttgatgttgataaaaagcagaagtcagagaatgatccactaaggtcttagcactgtgctgcaaggagggtgtgcttgcttagacatgtcgaggcatataaggtgttctatatttagtggcattagatggtttttttagtggttagcattctgtttgctcctttttgaatcatataaataaccataatcattgcttacatctcttctctggaatcttggctctcaaacggtttgtaccacaacttgacagataacaacactactgttttttaatagagctctgagcttcatttccttatgtacttataagcagattttacacagatttcaatctacgtagaggcccatgaatcatgcatattagttgggccatgggaaaggatatctgattcagatacagagtttgcttatgaaactgagatttttcttatttactggaaatgattctctgcattttattgaactctcagaaaacat

SEQ ID NO: 223071 - DNA, 494 bp, Homo sapiens
aacacgtaaggagaccgaggcaggcgaatcacttaagcccagcagtttgagaccagcctgggcaacatagtgagaccccatctctactataaataaaaaattagccaggcatgatggtgcatgcctgtagtcccagctacttggtaggctgaggtaggagaatcactcaagcccaggaggatgaggctgcggtgagctatgattatgccactacactccagcctgggtgacagagcaagacccagtctcaaaaaaaaaagtaaataaaataaaatataattttctcattgtttctggtatatagacttgccattgatttttttttttcttaaaactcctatgacagattattgcagttgattttgagatattgattttatatccccccaccttgcttaactcttatttattctgacgtcttgtagattcttttggatgtggggtcatccaacttgatcatatcattgatgaataaagatactttttggttgtaa

SEQ ID NO: 223072 - DNA, 787 bp, Homo sapiens
tgacaattgtatcatcaagagcaaatactcagctttgagaccttggatctaaaaagctaaaactctgcatttctgttaaacatgtattgatctggcagttgacagcaggttgtcaaagtgccttatggtggaagttgtaatagatgatatctacgtcctcctctaatgagtgagtctaccaaagaccatggagaggaaaatgtgcctcttattgcctgactcctgatgaataagacttcagtgaagtgcagaaaacaggcctctgctaggtctatccatgacaggcaagttacccaaatgaaaaccttgggctctgtctcagctgtcaccctaactttcaagtgacagcagctagcctttcaaagttctaagcacctttgaagagtttctgataacacatttaaaagtattatcacagatgaaagagaattcattatgtcagacctacctcaaaagttttaagtttgttcttaagtcctttcagagaaattaacaatccaggaataaatcttttaatttaccctacctattgtggttactagtacaaggcacctttctgataatgaaacagaaatcctttcattcctggaatttcctgttgggagtgtagagttttctgagcaatatgtaacgttggttagttacgcaatatgttggattttactgccagctttgtttaaaaagggtgtgagaggctttgaccaacaggaatgtgaagtcaaagttaagtatggcatcatcttaccacctgtcacatgaataaacccggattcataagcaaatatgt

SEQ ID NO: 223073 - DNA, 397 bp, Homo sapiens
cctaaacattgtgtttaggtttgttattagttgctttaaatatatacacatctgtaaacattgaacttttttgatgcctcatctgtgttgcttatagatcattttccatcataattattttaaagtccttttaagaagtttaaggcctatctcatatatgtaatatattaatagtagataatcaggcctttggaagcataaatgatgtaagtaagttgggttgcagttttttcttatcaagaatctgcgtgtgtttaagtggcagtggagataatatttttatttgcgttgttatagtgttatctttatcatttagtttatattttctgccatttaaagataaaaaggttttatcttttatagctatagagtcatcttctgagccttaaaacacttg

SEQ ID NO: 223074 - DNA, 388 bp, Homo sapiens
ttttattatgcacaaactattactctatacttacatatttcatgttcttatcaggtattataagggttaagagataaactaaaattgaatcaagtatatttactctccacctgcacatcacaactatcaagttagaggaataaaattaaaaagcaattcacaagtcatattacactgatgacatacatgtatatgtacacgcatttgcatatatttataatttgaagagaaagtttatatacttaacagccaacagatttagaaaaaactatttgtcctactgaataacagtatatatgaattatcagaattcttcattactagtattcaataatgagctttttatgcaataaatttacaaatcatttgcccctattttcagaaaaaa

SEQ ID NO: 223075 - DNA, 403 bp, Homo sapiens
tcgcagcagaacttttttgaaaaaagcacttgacccatgctttatttttgtcattcattcactttcacccaattactggctttcatctcccccatcctattgaaactccatgatttgactgttgcattcaatcagcacttttcagtgattttgacctctctgccacatttgttaagagttgactgttgcacaagcattgaaattctgcttccctgaactcgattccacctctctccttttgttctcctcctacttctttgctgtccctagtcaatctgtagactcattcatccttaagtgtggttctcttggcatcttccttgccatttttttccttatcacactatacaatctttctagatgatctcatatactcatataaatgacaccaggtgagtacctt

SEQ ID NO: 223076 - DNA, 368 bp, Homo sapiens
ccagattcatgtcttagctttacatgaccaagatcctcaatctctcacagttcccctaggaaacttctagaagaacagtaatatgtacctcccaacattgttagggaaaaaatatgtaaagccctaatacggcatcaacatataatagtgggagttattgtcactttattggctcactatagaaagacctttcaaaaactttaacaatttgccttcagcttttattcagaattcataccctccccaacacccacaagctgtatttatgtatcttcatcctttgtactattattaattacctaatcctctttacagaaatatccttacactatactccctcttagaattttgtcctagaagaataaaga

SEQ ID NO: 223077 - DNA, 432 bp, Homo sapiens
ccagaagcccccaggtggcctttcttctagctcagggttcacagtctggctgtacagggcggtcacctggggagatgtttaaatctttaagactgtaccccacacaaattaaatcagaacctctcagagaggggatttcaagctcccagttggggtctcatgtgcagccaagggcagagcctcactgcctgggtcgcagaaacgagggtgtccaaggggctcccgatcaaaaggaggcagctgaggagagcagccagggagctttgaaacctttgtcctttttaggctgggtgcccatttgccttgaatatctcttctttgggttgtatggaacagctataattcatcccaaattcaggtgggcaaaaattagaactttattttttgcagtaacttcatttctgactctcagccctcattctggcatattga

SEQ ID NO: 223078 - DNA, 338 bp, Homo sapiens
taaattcgcggccgcgtcgactgttcttgtttttttttgagacagggtcttgttctgctgtccaggctggagtacagtggcacaataatggctcactgcagccttgatctcctgggctcaagtgatcctcctgcctcagcctcccaagtatccaagactacaggaaccaaagaaagatcttgcattttctaatgaattctgagcccacagtacaactcatctttggaaatcactgctccagaatccaaagcatggtgctcaggaactccaggtacaacgttgaataaaggtggtgagaatagacatccttgccttgttcccaatgttggtaagttcag

SEQ ID NO: 223079 - DNA, 549 bp, Homo sapiens
tcacccagaccaacttccagtcctccaagcttcattcatggtaactgccctatacaggtgcaccatttttttcttttgtatcatatttttactgtaccatgtttagatatgttgatacacaaatacagttacagttacctacagtatccaggtacagtcacatgctgtacaggtttacaatacaggaggaataggctatatcatatagcctaggtgtgtggtaggttataccatattggtttgcgtaagagcactctatggtgtttgtacacaatgaaatcacctaacgatgcattcatcagaacctatccctgtgattaaatgacacatgactgtatttactaaaaacccatcagaggccaggtgcagtggttcacacctatagtcctagcactttgggaggccgaggtgagaagaccgcttgagcccaggagtttgagacacgcctgtgcaacatagtgagttctcatctcaaaaaacaaaaacaaaaaccaaacccattagaacccatcagggtctcaaacaaggtgaaggtttaacaaatattat

SEQ ID NO: 223080 - DNA, 599 bp, Homo sapiens
ggtagaaaggttaatttccactggattctgaattgggcagaaaatggaaacattaacactttttgcataacgccattttacatcccctgcagcagtgtaaagatttgatcagttaattcccatgggaagcatgggaaagcaagggagccttatagacacgggtgttatttttaacaatgcttagaggatgtaacaatgactgataagcatcaaaggaagaccctgtttccttaagggtcaccatgatttatgtcatacttttattttatcattatttcttttaaaatattagttatcttttataggctccaagagtagagctgaaaaggaaggaaaatgtgatagaagtgtggcattgcagccactgttttaatgaggaaagcattgttttttggaaatactgtggtagaaactattttaaaatatcatgccttcccagccgtatacatctatatgctcttcacatacaggccattatatattaggagccttgactgaaatcaaggaaccaagaatgccttgacctcagtggccatcatgctaatgtaactggctgattggtttttttcttcagatagtggcactttaaaattcacgca

SEQ ID NO: 223081 - DNA, 5111 bp, Homo sapiens
cacacacacacggaccgcttactccgctctgcctgctcgctcccactgtccccaagcccgccccgcccgcggcaagtgcgtgcccaggcgcagccaccggcgagatcaggagcgcagcgcccgcagcctgagggaaccggcgcagggcagcagcggctgcagctggattcgcgcgccccagcgctcagtggcggcggccgggacaccctgggcagcaccccgcaccgcagcaccccagactacgagcaatcgtgcccgtccccgccggggctggagggcgcagggccgccaccctgcaagttcgtgggcccccggccacccttatgagagaaggcgaagccgggcgaaggagcaggacgctcggcagcaggactcctccgcaagccccgcgggccctctgttcccgcgccccccgggcgcccaagaagcaaaatgcaaccaccgcgctacagctgagaggggaaggggccagcgccatccgctcgcccggaatccggtccccgcggcggctgcgcgtcccggccgcggcccctccggcccgggagtgagcagcagcaggaggagaggcagcggcccggggttggccggggctggggaggagggacgggacggagggagggcgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgtagaagacatcgtggccataatgattcctgagccaaaagggaaggagatagtaagcctgctggaaagaaacatcaccgtgacaatgtacatcaccatcggaacccggaacttgcagaaatatcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggccttagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttgcatctccctaggagtccaatgcttcctgtaatgaaatccactctctatgtgtgggaaaagaggcagggaggaatgaagagagctctgaatcgagaatcctagatgaaccacacgctttactaagcctcggcttcttcatctataatgtgaagggtttaataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactatggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagttt

SEQ ID NO: 223082 - DNA, 800 bp, Homo sapiens
gttttatgttactgggactctctccttaagcccgatcaaggacagaattcttcaatgggtctgaaatatgagagagtttcctggaagcagagaaaccacacaaatttacttcacactgtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggctgactcatccacagagttctttgcatcttcttggcataaaaactgtttcaaaaaatgttccagtttatcatctcccttcactcacactttttctgtggcctcataactgctgacattcttggtgcatctcttcactattgttttcatttagaatgtctttccaaattatactcttgtgtcacaactttttcaaaatcattttatcgcttgtctctttctgagacccatgaacaaattatgatgaattattaataaatgccttcctctctttattt

SEQ ID NO: 223083 - DNA, 910 bp, Homo sapiens
gttttatgttactgggactctctccttaagcccgatcaaggacagaattcttcaatgggtctgaaatatgagagagtttcctggaagcagagaaaccacacaaatttacttcacactgtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagttctgccatacttaaagtgacatagccagaaggactgttgccttgtaggaattggaaaaaaatacctttcctca

SEQ ID NO: 223084 - DNA, 599 bp, Homo sapiens
acaattatcacgtatccctggttccagaactcctcggttattctgttgttaaacaagaaagatcttccagaggagaaaatcatgtattcccatctagtcgactacttcccagaatatgatggaccccagagagatgcccaggcagcccgagaattcattctgaagatgttcgtggacctgaacccagtgaccaaattatctactcccacttcacatgcgccacagacaccgagaatatccgctttgtgtttgctgccgtcaaggacaccatcctccagttgaacctgaaggattacaatctggtctagttgtgcctcctagacacccgccctgcccttccatggtgggctattgaagatacacaagagggactgtatttctgtggaaaacaatttgcataatactaatttattgccgtcctggactctgtgtgagcgtgtccacagagtttgtagtaaacattatgattttatttaaactattcagaggaaaaacagaggatgctgaagtacagtcccagcacatttcctctctatcttttttttaggcaaaaccttgtgactcggtgtattttaaattctcagtcatgcactcacaaa

SEQ ID NO: 223085 - DNA, 779 bp, Homo sapiens
agaaaagatgcacttacgaatagacttttgttataatataaaatgtgcttcttgaattaacagcgtttttcatattaggacttagcacagtgcctaacacatagtaggcacatagttaatatttgttgaatgaatgaatgttaataaatcatagtttgtatttagctttattctgttaattagatgtttgctaacttaaagggttttttctgcaataacttcagagataaatgaatcaaaactttaaggtgacaatgacattttataccagtgttaaaaccaaagtatgagatctatcgagtattcattggaagtcacttatttataaaccactaagattataaacctctataggctatagcttactctaacatgttgcaagtatacacttgaaaaataattttttaataaatattcttgatagccatgagtgtgatgtttttgtttaatagatgaaaataaggtcatggaattcttattaaaattttttgttataaataatttatttttaatagaaaagttgggaaatgcagaatctagaaaacaaaaactttctacaaatcagagataatcactgttaatgttttattatactttcttgcagccttttttcttcttttacatttgtatatattttgttttcaagaaaattgagagcattttgtacgctccttttctgatcttctttttccactcaagattgtatggaaagcatttttctgtattgttttctccagaagtgtagtgtcaaagtcaaataaaatagagacaaatctctg

SEQ ID NO: 223086 - DNA, 683 bp, Homo sapiens
gcacgagcttataccctacatctgtagattttaaagatatatgtgtttgcaatgcatatttactgaaatttatgctgctggtatcaggcggagggaagttgagggagagtaaggaaatatgtaccatattaaatcaaatctaggataccattgagtgtaagatatagtattattttccatattgctcgggcaaaactgtcaattaagttatggcctaatgctttcatatcacttagaatttttatttgatatttattgaaagagctcaccgagacctatttaatgttggatttttaaaatcttgagttatttttatatacatacaacaaaattaccagtgaaatataatggctaaggtattcccaacacttcttcacattcagagaccatgactgtaagaaacattcctatttcagacatattaagatgtaaagaataattagtttgtaaagggattcacgtgataaaagcaaatatgctgtggaaaacaaacatctgatgagtttgcgaggacttgaggaaaggctgcagatttcaaatatcctgaaacaaaggaaggaaaatagcagacgttttagtcacaaacaactgtagaaaatttgagttagaaaaaaaacctttatggaagtttactatcacttctgccatctagtagcagaagttgtcacctggaagtcaggaaa

SEQ ID NO: 223087 - DNA, 565 bp, Homo sapiens
tcagtatctatcaagaaggtcttgcttcagtaatgggggataattagccctatactaggcactgctaaatctgtctagcaaattgtaaaagaaagacccaaaaggatcaaactgtttgcaaataacctaaccatcctaaaacaaagcttaaggaaatttatagtactataaaaatatccagcatccaatacaataacattcacagtatctggcatccaatcaaattcaccaagcatgcaaagagatgaaaacatggcccatagtgaggacggtaataatgatttgaaactcatccaaacttaacatagatattattattagcagaggaggatagtaaaacattagttataactgtatttcgtattgctaagaaggtaagtacagcaatagaaagtattaaaaaaaattgagattctagggagaaaacctatattgcctgaaatgaaaatataccaggttaacagaagattagatttccagaagaaaagttgggtgaacttgaaggcatagcagtaaaactatccaaaatgaaatgcagagagaaaaaagaaaccagaaaaaaaat

SEQ ID NO: 223088 - DNA, 452 bp, Homo sapiens
gggatcataatggatgttgtgcccgtgctggaggtgcccaaactcaaggtgtgtgcattgcatgtgagcagcagatctacagccgcatcctcaagcctgggcaaaaccctcacctttgcccagctggccctggccttcccaaggcctgtggcttcagcctgctctcccatacttacaagggccaaggtgtacaggcatttcggccaggcctggggaaccccacacagccacaccaaaccctatgtccaccccaagggccagccccagctaaaaaaaaactaaccctgggtcatcctctcttatttaaatattttaggaccagaggcaatggttcattccagtaatctcagcactttggtatgctggggtgagagtatcacttgaggtcagaagtttgagatcagcctgggcaacatagcaagacctcgtctctatgtctctactaaaaatta

SEQ ID NO: 223089 - DNA, 548 bp, Homo sapiens
ctcatttcctgagtcagatgtgggcattctttcttggcatgggtacactgccgtggcttgtgctgaaggctgcataagaaacagaggttggaaactcacagtggaatttattgctgagatgacgttaagctgttcgcattccacccaggacctccacaggagaagcccagagaggatgactctcagactccagatccaggaaatccatgcctctctggagcaatggatgtcttacagacactgtgactcttcaaactgattattttcttctttgtgcttggactccaggacacttagaacccaatttgcatctaaccactagcagtttggtgacagcatgtcacagtttgtatttctgtgcaccagctttatacacatttttttttctgccctaacttaccctttggtctaatttctttatctgtttttctatcctgttgtattgtatgtatttttataagcggtctcaaatcttttctggaaacactaggaaatgaatatataaacaaatacaagcaggacagcatttctgaaagagcctgatatac

SEQ ID NO: 223090 - DNA, 641 bp, Homo sapiens
aacagctttcccagagacattgcgggatgagaggagtgtccagaaaccaaggagcagcaagctgggactccctcgggtctgcattgttgatattcccacctgactatgctaggggctatggacagacacagccaccccagagtagatcaaaagcacagttgtgtcccttggacaaatctgagtttttctgttgtgccttgccccagagccggaggagaggaacctccaaaatgcagacattcttggtggctgggattctgtgtgatattcagcgttaaatgctgctgctctgaggctgctggaaacgcgttagtattaatatctgtgtacttctctcacatttacttttgctggaaaagcttgggaaatgacttaacgaagatgcgtaaaccttaatttgtttatatgctccttattagccactgaataccacattgctttctgcttccccttcttctttactgataatctgaccatttccactatgcactttgaaagtcttgctggagtatggagaatagtcagaaatctctggtaagatgctgccccgcgcatctctcagaggagtcactattcatagcctgcatcagagttcacaatgaaccaaagttcaccccacctcccctgtcttcagggactta

SEQ ID NO: 223091 - DNA, 514 bp, Homo sapiens
gctggacaacccctgagagattcatctgagtgagagagcactctccagccccatcggagtgggtttgcagggaaatcataaggaagaaatccttatctttccaacactgagatgcttctgccgaagagtagaatgggagtgaggggacacgcaaaacgggctgctgccggaggaagaggaacagtgttgtggctcatgccatatgaatgggctcactggcctggcccagaccctgactgcccacaggatctttgacagagaaacggaggcacagagaaggaagcggcagttaaagctgcgaagaacctaacaaatttcaagattgtaagtgccttttcccaggatgccagcaagtactgagcctgtattttgagctgcatcaaaccctgttggaataaaaaaggacatttctaggagatcagtcttcgagattggccccagtttccccagagtaggaagaggcaggaagccagagcacatgttctctccagaaataaagttgttgcagtggcct

SEQ ID NO: 223092 - DNA, 484 bp, Homo sapiens
gtattgtataaagatgtttataacatttgtcaagccttcattataaaaagtagtctaacaaagcaatgatgtcgtctaccttcctgtttatgcatgaatatgtattatgtttgcattttaacagtggcagcccatgactgatttgtggccactgatgagtcattttcttgactaattacattaggtctgtttatgatatgaacaataaaactatgatggatagctgaattctacaatttaagtgcagatgttaagagtttgctttcagcctattgaaagaagtaaccagatagtaatttcactatgctgtctttttacactattgccttctaaatgttcagatgcactgaaaaatgttgctttttttgtatgaccagtttagttaaatttcaatcaatcaaatgaaaatttgagtataaaaggctctctttccagagacttccatattacaaaatgaaaatataacttaagtcataatgttgtc

SEQ ID NO: 223093 - DNA, 423 bp, Homo sapiens
cagccccctacttaaaccttagagcttttataaataatattgagaagtatatccttatattcgttattttacacattcttcagtacatctgtagaataaacttctatgtttatatgtacatttaaatattgggagcctaactgttggtctgtgtaaagctagattttgaacatctattgtatgaatgaccagtctttttacagaatttaacttgattaacatggtttctatcctgcttgcatttgtgaaaaagtgcagatcaaatagatcacattctatttaaacattttctcctaaaattaaggcattttagccaaattttatttcagagaagtacagtttaatcattaattaagcctcttccacactttgacagatacagcacatccttttttttttttcttaactttttttttttttttt

SEQ ID NO: 223094 - DNA, 454 bp, Homo sapiens
cagaatagagaaccaagaagtaaagccacatgcatacatctgactgaacttcgacagaaccaacaaaaataaactacggggaaaggacaccctattcagtaaatggtgcttggcagattggctagccatgtgaagaagaatgaaactgcacccctgtctctcactatacacagaaattaagatggattaaagacttaaatgtaagatcgaaaactataaaaatccgtgaagaaaacctaggaaaaactcttctggacattggcttaggcaaaagatttatgagtaagacctcaaaagtaaatgcaacaaatcaaaaatagataaatgggacttaattaagcttttgcacagcagaagaaacaacagagtaaacagacaacctacagaatgtgagaaaatatttccaaaccatgcatctgaaaaatgaccagtattcagaatttacaaggaactc

SEQ ID NO: 223095 - DNA, 118 bp, Homo sapiens
tcatgaaacaactaattccaagcagacgaaatacaaatagccacatctaggcacacagtgatgaaaccattgaatgtcaaataaaatattaaaagtaatcagagataaaaagacaaat

SEQ ID NO: 223096 - DNA, 423 bp, Homo sapiens
ttctgagccaagggccctgcaactacacaagttgcacgctcctgaagtcaatccaggtgggaggctgagaaccctattactcatcttccttcgtcaagcgaataattgaatccgcagcaaaaaaaaacttgaacggcctccatttttgacccattgggactttcttctcctctaagcaagtcccactctgtgaaaatccaccacttcctggtgacgctatcacagctttgaggggagaattcatctgctgatctcttcactgaagccgtggcttagagcccaagccttgcagatgaagcatgggttccaatccccacccaccactttcaagcttggtcccatccaggagataccctgactgatctgtacttaggtttcaccacctgaaagtaataaaatatatttggtttgattcatgaataa

SEQ ID NO: 223097 - DNA, 474 bp, Homo sapiens
gaatatgagctttcaggaccaatgttacaattaaaaaagggaacaagctttaagccctgctcatacctgaatttggagactaggacttccttttttcgaacgaattctttcacatgatgattacactaatagcagtgacaactataccctctgcttgcacaataatgttactgataccgtcctgatttgtactacgcacccctatatacttctgtttgggcaaggtgttcctaacatacagcagaatcaatcttttatagtattaataataattagtaattaataatccttttatagtctcttccagtcgttggtatgctacatgcttgtctcatcgaaatattatacagttaaatataacctatgtcataatcttaaaatggcatacagaattgtggctccctgtaaattttaccaggaactgggaagggattccaccctgcagttatttagaaaagcactgtctcatactca

SEQ ID NO: 223098 - DNA, 478 bp, Homo sapiens
atctaacagatttccctgcctataagcttatcacctccaacccactggctttacaacttctgtattgcttgaccatgctagtctttttcttgaaattttcagtgactctccactccccattgttaatattgtctaggctctttagaagaaaagcatagtcctccatgattgtacctttacctatgttatctcttgctgacacccctcaacagagcctgtattttggcagtcccattacatggagtttcccagaggtgcctgtttcactcttttctgcttttgaacagtatattccctctgcccaaaatgaaatttctccaattatctacatgatgaacactattcattgatcaacacccagtcttttttttctttttttttttttttttttttttttttgggaaccacaaaaaatttttccccccatgtacaattttgcccagtggaatggggcttggggaattaccccgccaacttg

SEQ ID NO: 223099 - DNA, 464 bp, Homo sapiens
catgcttgtaattccagcactttgggaggccgaggtgggcgatcacctgaggtcaggagttagagaccagcctggtcaacatggtgaaaccccgtctctactaaaaatacaaaaataaaccaggcatggtgacacatgcctgtaatcccagctactcgggaggctgaggcaggagaatggctcgaacctgggaggcggaggttgcagtgagccaagattgcaccactgcactccagcctgggcgacagagcaaggctccgactaaaaaacaaacaaacaaacaaacaaacaaaccaaagaggtagaagaaacttggctgactatattctcaaaaacattaaataaataatgaattctatcaatgaataaaaaagacatctgaaaagaagggagagtataaggaaagaaatggcagcacagaagcatttaaattagaagcagcagcagagaaatgaatttatact

SEQ ID NO: 223100 - DNA, 483 bp, Homo sapiens
agcagtctgcaacccagaagaggaccctcactggaacccaggaatgttggcactctgaacttagattttccagcctctagaatgccttatgcaaatcctggaagatatcaattctgagggctggggtgtatcttgatcacctttggaatctaccactgcatggagcacagcacttaccacctagtagttctgtttgtttccaagtttggaagaaacataattgaatcattttgaggaattccaatccctgacaagatgccagtgctattttacagcaagagtagacgaggaaggctatactacgtggtcctgggcaagttatttaaattctctgtgcctcagttttctgaaccgtaagatgggaagaataatagtaactacctctggaggctgttgtaaaagttaaatgatctgatctatgtaaagcacttagaacagtacctggtatataagtgtgtgataaataaaatccaatatgaagaa

SEQ ID NO: 223101 - DNA, 244 bp, Homo sapiens
ctgtggggtctgtattaactccaggtcttcagtgtcagaattgaactgaattgcagaacacccagctagtgtctggagatatggagaattggttggtatgaggacaaaagacacatatttgggggtcagaaatgctgtgagtaaaagagttcagacctatccttgtggactcacattctagctgaggaaggtaaataataataaagactgtgaaacatataatgaagcctgacatgtgagaaaa

SEQ ID NO: 223102 - DNA, 411 bp, Homo sapiens
cttagcatgctgtcctgcatagacaaggcccacgacagcatttgctaaataaaagaatgactataaataaaatcttagtaaacaaaagccacagtgcatctaatcaattctcagaattctttaaaatttaactgtcagaatgttacatacactttgaatgccttcaataaatattgcaagaaaatagcacaaacatgttactccacccttacaagtacacacagacagtggttgttatgtcattattttctaaagacttgcctattgggtagtagaaactaaatgttggttatggtataaaatacatttctaattaccagtgagaatgactttttccatctatttacctaggtagttctgtgtcacactgtttgcaaaattttctattatcatgcctggatttttctctcc

SEQ ID NO: 223103 - DNA, 498 bp, Homo sapiens
caaacaggcaggagaagttgggtgtcccctactttttccttccttccgcacagataactctgtagattagtggggccccggcgcctcagtgacgttgtcgcctcttactgcgctggggcctgggcttctcggctgagaccctgaaactcctttccttttatcctctcagctttctccattccttcctttactctacgtctctgtacacagagtgtgatgtgagggttcaccccgggcgcccgcagatcccccacgttccccagcacgcttgggatgcatctcccgagtgcgctaggaatgggcagccccgtgtcccccgcgcgagtgccgagcggaccggcgggggcagaggtgaattgcacgcctggggggcgggccggggcggggagccgaggttgctgggagctgggtctggagtccgaggacggggagggggcatggtcgccccccgccctgtgaactgtgaagtgcgcggctccggccgagccggtggtttcc

SEQ ID NO: 223104 - DNA, 512 bp, Homo sapiens
gcgatggctcacgcctgtaatcccagcattttgggaggccgaggtaggtggatcacaaggtcaagagatcgagaccatcctggccaacatggtgaaaccctgtctctactaaaaatacaaaaattagctgggtgtggtagcacgcgcctgtaatcccagctactcgggaggctgaggcaggagaattgcttgaacccaggaggtggaggttgcagttagccgagatcacaccactgcactccagcctgggtgacagagcaagactccatctcaaaaaaaaaaaaaaaaagtttaaaaaataaggaaatcttcagttttatggtacctataggatccaggaaagctcaggagaggacctgcaggtagaactcctaggctgaacggtggctttaggaatcacccagcgaggacaatgacacagagtaaaataagtccctcagggataatcacttgccttttttccatgaaaggaaaaggttttggatttgttgtgatttatggacaatgctaag

SEQ ID NO: 223105 - DNA, 264 bp, Homo sapiens
tgcttgatgtactgcaacggggagaataccccctaagcccagggggctggacgctacagaagctgtgtttagcttcagagtttgtaccttaacctaagcttgcctttactcccatgattcaaaacactatcatacaggaaaccatttgttttaaaggagaaaggagcacgattattttaatccagaaaactattaaaatacattctccactgtagacatttaagaggcagatgggacagacaaaagtatttgggaattcacaca

SEQ ID NO: 223106 - DNA, 474 bp, Homo sapiens
tgttgccaccagcacccagaggaacaaagaccatgacattgagctggtgccagacattctcccaggaccccaccttcacccctagtcctgctcaggtgcccaatcctataaagactagccccatccttaaggttcatcatgaggagggggtgacagggggacacttactccagcctcatattcataagaagacttcaacatatttacaaatgaccacatgagtataaaaccacagagatgcactgacactgtcaaaggaaggtgtttgttttccacgttgaaacctgtgcccatcaccagcccacatgcttagagaacacgaggcatttttgtttgtttgtttgtttttaaatagagatgagtctgggcttctatttcgaccgcgatgatgtggctctggaaggcgtgagccacttcttccgcgaactggccgaggagaagcgcgagggctacgagcgtctcctgaagatgcaa

SEQ ID NO: 223107 - DNA, 338 bp, Homo sapiens
cagggcacaatggcagatataagaaaaaactgtaacttctgcatgataaccattaacatcgatagattatttttaaaaagtctgaaatttcatatgaactcttcagcaatgtaagaattatgtataatctgtgtgagggcatttcagctgattgtacagctggagcttcctgatatcaccaaaaggaagaaaacaatactaaagtatagacagagttgtactccatctttcacatctatgcaagcttaaagaaactgtaagatcagagagtttatgagaatattgcagctcattagaaaacttgtctgactcaacagcatggaaaataattcaaatac

SEQ ID NO: 223108 - DNA, 1339 bp, Homo sapiens
catgtaagccctttctaatttctcccccattctaaattacactttgataaacatctttgatttttacttttttctttgttattctagttcatctagtcattctgatgcattttataatgaaaaaaattatctcaaatccttttgattgttatagaaactatattaagtccatgaattattttgggaaatttgatgtattttacaatatccatcattgaaaaacatggattatcttcccaagaatttaaatttttatctagatatatacatgagattttggtagttttcttcaaatgaatgctacaactgaaagaaataaatgacattaacttgaaattatgactttttttagagaatgcttactatgtgacctagatttaattaaaaataaataaattacatttgagggcccaagctagtctcaaactcccgagcccaagtaatccgccaccccagcctcccaaagtgctgagattataggcgtgaggcaccacacccagtccaaagaagaaatcttaacagaaattttaaaatatattgaactaaatgaaaataaaaatacaactatcaaaatctatgcaatgtagctaatgcagtgcttagaggaaaatttatagtatgaatgcatatattagaaacaaaaaatctaaaatgaatacgcttccactttaggaaagtagaaaaagaagagcaaattaaatccgaaacaagcagaaaaaaattataaaaattagagcagaaatagatgaaactgaaaataggaaatagagggaaaaaaatcaagaaaatcaaaagctgtttctttgaaaatatcaataaaataagcaagcctctaccactgggcagggggaaatgcagagttgttcgaacatgagtttcagtttcagttttgcaagatgaaaaagttctagagatctgttgtacaacaatgtcaatatagtttgcactactaaaatggacacttaaaaattgttgctctctcctctgctcgcattttcactctgccatgccctgctctgaagagacacccaccgttacccacagcaaacaggctggtttgcagaggaaggcagcatgcagctccgttttgccccattctctgagcaggccacaaccctgactcagggatccacacaggccacaggctatgacctcaacggtgcctatgatgatacaataccacctatggagaaagctctagggaaaatggacattcagatagctcttccttctggatgttacagaagagtagctccatggtttggattagctgcaaaacactttattgatagatgaagattactgaggaaatgttggtgctgtactgtttaattttggc

SEQ ID NO: 223109 - DNA, 264 bp, Homo sapiens
catcatgtagaagcaactgaaacaagttgactaggtgcatctttcatctcaagttgacaaagatggccctgagagctgtaaagaaaatatcgagtgggtctctttaaagtagttcaaatgcccagacccaggttctgaaagtgattgaaatgggaaaaaacattagggtattactgattcctaaaagggcaaatgtgggtagcttttgtaaacaaaaaataggtagacttagtgtcaacctttgaaagaaaagacgaaaaaaaa

SEQ ID NO: 223110 - DNA, 412 bp, Homo sapiens
aatggagtggtcagaaagggaaatctcattttaattcagaattcacattccaattttcttttgcaagaggactctcacatattttggcatgaatttacataagatgctttttgggagctgtttcacatgaggacctttttcataacagaaaatgaaagagaaggaaacaagtgggaagtgggacagccgttaatctgtaagttagggaactgctgccaatgtttaggtggaaggtgaccgggatgaggtgagtgtgggtggacctgtggctagccttgttgaaacaaacaaacagctagaatgtcaccttgccctccctgggcctctgcagcagtgaccacaatgacagcagaggcaggtcaaggcaggacagcagcagaagcaagctccctcccttcagtcgtcagtcatc

SEQ ID NO: 223111 - DNA, 346 bp, Homo sapiens
tagggacctcatataagtggaatcacacagtatccgcctttagggactggcgtaattcacttagcataatgtcctccaggttcatctgtgttggagcatgtgccaggatttccttcccttttaaggctccctcgtgacttttgatctggatggaacctcatccaattctgaacgggggaagaatatcatccatccatacagttaaggcaacctgccagatccccatggtttctgtctctggttggcatagactagaatccaggtttggaaactgggccagaaaagaaaggggaaaccccctacagatttggggatgagggaaataaagccaagttcatgcggaata

SEQ ID NO: 223112 - DNA, 410 bp, Homo sapiens
ttaaaacagcaatgtgtaaatttttgttgtgttccacaagtaaaattttggggcttatttaactgctgcaactagggttaccctcactaatgtgtggagaatagaggtaccgttaaaagttgatgaaatggctgggtgtggtagctcacgcctgtaatcccagcactttcggaggctgaggcgggtggatcacttgagctcaggagttggagaccagcctaggcaacatggcgaaaccccatctctactaaaaatacaaaaattagcctgacgtggtagcgggtgcctgtaatcccagctacttggcaggctgaggcacgagaattgcttgaacctgggaggtggaggttgcagtgagcccctgtcctccagcctgggtgacagagggagattgtctcaaaaaaacaaac

SEQ ID NO: 223113 - DNA, 522 bp, Homo sapiens
gctacagaagaaagataagtcaattactacaagaaagggccataagaaataaggcaggtgttatggaagcatggtttaatgactgcatcactccactttccccctaactactatcaatttcctccatgatccaacacttccattgttttttcactatgatcatcattttccccgtcaatcacaaatcttccctgaaagactccaaccatggttgtggaaaaaagagatgtagaaagcaatgagttcacatgctgagcagaagtagaaagggaaggctttaggatatagccaaggaagggaataatgaagcaagaacccccaggagacaggtgaagatggaattcaaagaacacatagaagaggctgatgcaggtggaagaaaacccatacgtgagagaagaggaaacagaaaggggttcttatctggtggtctcaaatatttcaataaaatgcaatgtcatatgctaaacatgggagggcactgagagaattaagaggaaacatgaattttgaatgaaatta

SEQ ID NO: 223114 - DNA, 521 bp, Homo sapiens
gcacgagtatgaagttaatctaattagaatttatttcattcagtagttacacactttctttttgatttttattttctatgctaatctcccattgaggaaatgactcaaaccacttggaataatgctataacacattttccagggatgcttttcaattgggtccctataatttctaatttattaaactgtattcttgatattaaagataaaatgattatattaatcccctgaacaaaagaccagtattaagacatttttcctagtgactcctataagctttcaatttaattatgtattatgacttatttaattttgttagcatcttctaaaatgaactttgatatattaatattacatatgatatagaaaagtacatttaaatttccttgataatctgattatcttgccactaaaaaatcttatgatggtaagttttatgcttattactttgaaagacaaaatcaatcaaaagtgaacagctactaaggaacaaagcatgcctgctaagacatggggtttaa

SEQ ID NO: 223115 - DNA, 647 bp, Homo sapiens
gtcaggagtttgagaccagcctagccaacatggcgaaaccttgtctctactaaaaatacaaaattagctgggtgtggtggcatgtgcctgtaatcccagctactcgggaggctgaggcaggagaatcacttgaacccgggaggtggaggctgcagtgagctgagattgtgctgttgcactccagcctgcaagggcggggggaaaaaaacaaccacacacaacacacacacacctttttaaagtgtgcagttcagtggtttttagtatattcacagagttgtgcaaccattaccactctctgtttagaaaattttcatcccccacacccaaaacaaactctgaacctattaaaaggtcactccctgttccctcctccttccagcccctggcaaccactaatcttctttctgtctgtaaggatttttctattctggacacatcacataaatgatcctttgtgtctggcatcttctatttagcacaatgtttttaaggtttattcatgttgtagcaaggtacgcaattgtttttcatttaaagaaaaagtctcaatgctattacaattttccatattctttgcacctgtggtctgtctccctaaatatagcccctttatgaaggaggaatgcaaagctgatccaactaga

SEQ ID NO: 223116 - DNA, 283 bp, Homo sapiens
tgaatacagataagtattatctgtatactatctgtctttccccagagccttacatttctttctctcttttaaaaataattatttattgaaacctttttgtgggccaggctctgttatatatgctgggctcgcaaaagtcaactagatagataaggcttgccctcactgagctgactaacattttagtgggagacagacaggaaaaaaagtaaagagatttgcttttaattcttaaagtgtatagattctttcttcttgaaacgtttaaaaatgatattagtat

SEQ ID NO: 223117 - DNA, 213 bp, Homo sapiens
gcatgtacttttatgaagaaatgatgtcagaaaactgaaggatgataataaatacgaaaagtaacaggcatgtgaaaaggtcttccgattgagaactataaggtttgatttcgttttcagataatgggttcctagctcttgtgtcgtccttttacatattctacatcaatggaagttgtagcacggtgtcagaataaagtagagtgtatttca

SEQ ID NO: 223118 - DNA, 507 bp, Homo sapiens
gggccatactagaaaaacacaggacagtcagaagacctctgctacgtcttgttacgatgaaggctatgacctccagcctacgttttgttgtaaccgggctgtgcaactatgggcaagtcatatccattctggtgcctgtcaaattagaaggaaggaaggtgaagaagagagcagctggggtccctcccagctggagtattctgtactcttggggtgctatacaggcggggagccctagagaaagaagcatttagccatagtgacaaagcagcagattctagaacgaacaccctcacattctgccaggtgatacgatcgcagaggtctggccccaccagctctcacaagcgctgccagctaccccaggtccagtcaccagtgaagactttatcagggcttcccctggctaccctctcttgctaccaccaccctcctttctctccaatcagcccaggacaagggggtgccttgtgacagctgcagctgtggcgaatgggctggctccct

SEQ ID NO: 223119 - DNA, 399 bp, Homo sapiens
caggcaacagtgcgagactctttctcaaaaaaaaaaaaaaagtgtcaaggaaatagaagacaaagactaaggatctcttacagactccagaagactaaagaaaaataactaaatacagtatggggtcctggatagaatccaggaacaggaaaagacatagtggaaaaactgtaaaatttgaataatgtctataggtaatagtattgccaatgttaatttcctggttttgataattttgctatggttatgtaagatgttaataataagggaagctggatgagggataaatagaaagtctgtgtactacttttgcaacatttctgtaagtctaaagttagttcaaagtaaaaaattaaaaaataaataaaagtcctactgccaaaaaaaaaaatggtaggg

SEQ ID NO: 223120 - DNA, 448 bp, Homo sapiens
ttaaaaattattaattagcatagactactagttcctctcatagacctagtttttaggacaccttgtttatctccctgtttcctttagtctcaacccaattacaagcaccttgcaattatatcagtatctaattttgtagcagtcttatttaagaattaaaaacgcggtcaggtgtggtggctcatgcctgtaatcccagcactttgggaggctgaggtgggtggattacttgagatcaggagttcaagactagcctgggcaacatggtgaaaccccgtatctacaaaaatacaacagccaggcacagtggtgcatgcctgtaatcccagctacttgggaggctgaggcagaagaattgcctgaacccaggaggccaaggttgcagtgaggcgagatggcaccactacactccagcctgggagacaaagcaaggctctgtctcaaaaaa

SEQ ID NO: 223121 - DNA, 1253 bp, Homo sapiens
acgtagagacagggttttgccatgttgcccaggctggtctcgaactcctggactcaagtgatcctcccaccttggcctcccaaaatgctgggattataggcatgagccactgtatccagtgacagtagacctttagtttgctcagtgccacattgctttttgaataattcctgcctgtgtgacctttaaaattctgggagagagaaacatatatatggaaggagctcagaattacagttgattgggcttggtcataagcatccttgctgaggcaatacccttccagatccctctttctcaaatagttggagtgcagtattgctatttcatgggcactttgagacaaaagctagctctgatttaactagaatctagtcgtgcaagtctttaaagttgaagctttagaaaaattgcatcatttttggctgcattgcatgagctagcctgcatgttcagcagctgtggaagctgttacaagttgctatgtgttaagaacaagtctagttgtgaggcagaagctctgctgtggttgtgccttgtgccattacctgcctttgacaagcccagggacagcagtgctttgcatgtcctcatgttgaagtctcacttgcaggtagttaccttagaatgccagatacgctgtcgggttgatccagttataaaaggctcatatcacagacgtttatattgaactgtatgttattatgaataaggaattcttatgatagctagaaatcacatgctttggaactaaaaatagaggacttcctctcacgttccctccctgggcctgtgctgcgtcgtcgtgctgcgtatttggatactatccttcggagcgccacactcgagtgatgttgctcaggcagtgtctgaccttggtgagaggagagttgctgttcttgctgctctgtttagagaaaggtgccttccatgctgatattagaatgcttcctataggtggaatgcacgcttcctgtttatcttctaatagccacttaggatatgagcatctaggatctcggcacagagggattcagcgtggtgggagatgcgggaagaaatccgtaatgacagactgttgtcattactgttggaacctccccaggaccaactgaaacttgaagggaaaataagagtttaggttggggagggtatttgaggcagaatgaattccctgtgggctaacctactatgtccaaggcaaacgtgcaggttattgtgaggatgggtgctgtggcagccgggtgtgggta

SEQ ID NO: 223122 - DNA, 214 bp, Homo sapiens
gggaatttttcacttaatgtattatattccaccaatatacaaatatttgtattattttagggcagttagaatagaaaatacattttcagtagaatcgttaataaatgaatagaaaaatgagaactcattggtgaggtagagagcaaacacacactaagggagtgacttgtaattgagcagaaatttcctttgagtttcctaatagccaaagcaa

SEQ ID NO: 223123 - DNA, 406 bp, Homo sapiens
gaggtggagttttacttttgttgcctaggctggagtgcaaaggtgcaatcttggcttaccacaacctccgcctctcaggttccagcgattctcctgcctcagcctccggagtagctgggattacaggcatgcgccaccacacccaactaattttggatttttagtagaggtggggtttctccatgttggtcaggctggtctttaactcctgacctcaggtgatacgcccgccttggcctcccaaagtgctgggattacaggcgtgagccaccacgcccggccttcagggctctctctccctttcagcatcaatgtcaacatgtcagggatggtctttattttgcagtttccttctgagacaaactccttgaacgtgtagacttcagtcccccttctttctcatctc

SEQ ID NO: 223124 - DNA, 279 bp, Homo sapiens
gcaatacatgctaatccctttgagcaaatccacatggccagtttctgtgctcaggggtgagaatagctgggctgtgattggggcagggggagcactaagtgggagggacttcctgtctccggtccctgccatcttgactgacatgctgcagcccttgccaaaacccatgggtcagaatgaaagtaaagtgccgttgaaaaccttgcaatccacctttaaaactgccgggtgtagtaaaacaattgcttgccccaaataaatgacttatcattgctaaaa

SEQ ID NO: 223125 - DNA, 474 bp, Homo sapiens
  misc_feature (21)..(21): n is a, c, g, or t
tgcttgatgtactgcatatantgtaatacctaccaagtccaaccaaggtttaaagtgttatcagcttgggccgggtgtggtagctcacggcaacaaatattttctgggaaaatatatgaatgattgaatattgaacaagatctgtaagggtgtcatgtttggtaaagccatacagaaaaaaagaatagcgataaaaatcttaggaatatttataagaataacaacaatgggcaagacctatgtgaagaaaaattatgcaggttactgaaaatataaaagaatatctaaataaatggagaagggctgggcgtggtggctcatgcctgtaatctcagcattttgggataccgaggtgggaggatgacttgaggtcgggagttcaagatcaggctggccaacatgacaaaaccccatctctactaaaaatacaaaaattagccgagagtggtggtatgtgcctgtaattccagctac

SEQ ID NO: 223126 - DNA, 261 bp, Homo sapiens
gagttccttcctcaggaaaggacccccaggcctctcaaaaagtatcaaagaactgaaactcaccagatcgtagaattcagacagtgagacaccaggcctctcattcatcagattacttccttagccctcccaacttcctgttttcccatacattgttacatttcttctctgctgtaaaaactcctaattttaatcagggagatggatttgagactgatccttggctacagtgcctgattaaagcatttttccttggcaata

SEQ ID NO: 223127 - DNA, 461 bp, Homo sapiens
accagagagagatgacccaggatgttcattgtggcagtgtctgtaacagaaacaagctaaaggtcacggacagaagagataaattgtgggatattcctcccatgaatactatccagaactgaaaacaaagtaactgtttctatgggtgtgggttcacctcataaaccatattaaatgataaagcaagccacagaatgatacattcaacaaaaaacaatttatacgaagtctaaaatcatgtaaaacaaagggattttaaaaactttgtaacagtataaaggcattcaccaaattcaagacatccgccactccccactggcagtccttgctttactcagtacagtatcgactgaaacacatacataacagaactgtggaaaatcagggctatctgcatatatttctattattttctatgtatactacatatagccaataatattaaaatgttacaaattgac

SEQ ID NO: 223128 - DNA, 407 bp, Homo sapiens
agtgctgggattacaggcatgagccaccatgccccaccaagacaaacaaaacaaaacaaaacaaaacaaaacaaaacaaaaacagtatagatgaaaggcagccagcctgggttcaaatcctaccgttgctacttattattaaataaacgtaagaatcttatggacgttactttacctctctagcaccttgactttcaaatctgcaaaacaggataataacacctatttctttataacattgttataaggattaagtaggttaatatatgtgaaatacttagagtaatgtctggtacacagtaggcactaaataagtgttagcagccaggtgcggtggctcacaaggtcaggagtttgtgaccacactggccaacatagtgaaaccctgtctctactaaaaatataaa

SEQ ID NO: 223129 - DNA, 442 bp, Homo sapiens
ttgtcaggtctccttaacgggtctttctgtatcagtctcaccactgtcatttcattaaccataaaaacagcacatttttacacacacacaaaatctatctcaatcaaaatctcagtaggttttgttgtgtgaaaaaacaagcagattcaccgagtgtggtggctcacgcctgtaatcccagcacttagggaggctgaggcaggcaaatcacttgagcccaggagttcgagaccagcttgggcaacacggcaaaaccccatctctataaaaaatacaaaaattagctgggcatagtggttcgcatctgtagtcccagctactcgggaggttgaggtgagaggatcacctgagcccagggaggtcgaggctgcagtgggccaagattgcaccactgcactccagcctgggcaacagagtgagacactgtctcaaaaaaaaaaaa

SEQ ID NO: 223130 - DNA, 359 bp, Homo sapiens
aatccaggggcagaagccaggtctcatgactccagcttcagtgttttctgctgtgaaactaagacttgtaagaagactccacaacacaacttatttccatgccatgttcactgcttgagcgtgtcatacgtgactagtattgtcttgcccctgggtaatgctatgtttctcaaagctggggacacttaagatctgtggtaacaagagagttttaggaggtgctcagggactaacattttaaattttggtaattctgttatctatttattttagtgttcattagaaaaaatatacctattacatcatactgttggtttcatcatattattgtttaggatgagactaaattaatataatag

SEQ ID NO: 223131 - DNA, 395 bp, Homo sapiens
agacctgggcactggtcccagctcgccaccagctcttagttggaccttggacaatccttggacacattggatcttcgtttttcctctgtgaagtggcaggattagactagaagctgatacagtgaaggtgctcagtaaacagctgatgaatggatgcatgcatgaatgaatgaatggcccgtctaagacagatcaagtctttaaggccccacgcttctcagggtgtcacaaagccaagtttgaaaaccactggattgagaaactaccttttgggtaaccatgctcactatctgggtgacgggatcaatcataccccatacctcagcgtcacacaatatactcatataatgaacctgcacatgtaccccttgaatctaaaataaaagtagaaatta

SEQ ID NO: 223132 - DNA, 202 bp, Homo sapiens
cagagtgaagaagataaataggtcattactttgactgtagtatttgcatggagacttgagccaccaggaagccattagtgctcttgaaatgaaaaccaatctattatgaactacagagaaggagggtctgggacactgagagtaggagagtcaaaccccatcagggccagtttgactcttaggaacctccatagttcactgg

SEQ ID NO: 223133 - DNA, 692 bp, Homo sapiens
ctgaatggacccctcttctctgtcaaggggattccaaagaaacctgaaactagttcagaccatgaccagcagtggaggactgagtgcacctcctagttcagactgtgaccagcagtggaggactgggcgcgcttcctagttcagaccgtgaccagcagtggagaactgggcgtgcctcatgatactcctctccttttggggttagacagactcaccagcattaacattaaaatagagatcttggctgggcgaggtggctcacgcctgtaatcccagcacttggggacgccaaggcaggcagatcacttgaggtcaagagatcgagactagctggccaacatggggaaaccccatcactactaataatacaaaaattagccaggcgtgcacccataattccaaccacctgggagtctgaggcacaagaattactcgaatccagcaggtggaggttgtagtgagccgacatcacaccactgcactccagcctggtggcagggtgaaactttgtctcaaaaataaaatagaggttttaagactgacagaacagactctgtagcaataagataccaactccaactgactctggcgtaatatcacatggcagataaggaaatcaagataattacccccaaatttgtttatttttcatatctggaaatggcctgcaaagctgtcttttgtggggcgga

SEQ ID NO: 223134 - DNA, 435 bp, Homo sapiens
catttatggttaattcattctgacaggggactaagttcaatgggaaaatagtgtctccaaatggtactgggacaactggaaattcccatgccaaagaatgtagttgtgccccttccttccactctatacaaaaagtgaactcaaaatgggtggtagacatagatgtaagagctaaaactatagatctcttcaaaataagatataggagtaaatctttgtgaccttggattaggcagtagtttcttagatatgacaccaaacacataagcagcaaaggaaggaaataaactagacttcatcaaaattgaaaacttttgagctataaagagtaatatcaagaaattgaggctagacgtggtggctgacgcttgtaatcctagtactttgggaggccaaagtgggaggatgcttgaggccaggagttcgtcgacaaaa

SEQ ID NO: 223135 - DNA, 409 bp, Homo sapiens
tacctcaccagaaatacagataatattattatctgcctgactataattcatatattattcatctaatacagcaaataaacctatttattcctttgcattttactataggacatattcttgtcattaaataattactagtgttcattttacaattattaaaactaggaggtttgtaaagagtaaaactttaaagtaggaaaagttaaatatttattttagctaactgatatctcataattccttttggtttaaaatattaatattccttttttgtaatcataatgaaatctgtttaaagaaatctactgccctatgtttttgttgttgttattgttgttgagacagagtgtcccccatcacccactgcagtccgcagtccggcctgggcgacagagtgagactccgtttc

SEQ ID NO: 223136 - DNA, 643 bp, Homo sapiens
agagggcaggagggagcagagggagtccgcactttctgctgtgatgctctaaggatctggtgcgtgggggaaagaggaaagatatgtacatggattttggatcagaccaagtttcctgaaacgggctttgggtgggtggcatttaggggacccaaagagaggacggagggtgctctaggaaagggattgcgttgaataaaagtctggtttatgggaagaggaggaggaagactcatgtggccagcactttaaagtttacaaaggttggttgtggacatccacctctttggtgctctcaacagccctgccagagagatgcgttagacccagtctacagaaggggactctgaggcccagagggagtgaagccacttgtctgaatcctcacagtgagctggtggtggggagtagaaggggctcttcaggttgcctcgctgacccatcttgtcagtccctggatcagcccagcacttcctctgaggccccatctggcctcatccaggcactcttggtatacaggtcccacccgtctgtattcttttttagtccattcactaatgcacaatgagccatggtctgtgctattttgttttttgccttttctgtttccttttgtataataaatgtttacacggaattgttt

SEQ ID NO: 223137 - DNA, 373 bp, Homo sapiens
agctgatgagttcaggtatgtctccctgtggcaattatcctaaccagatagatgaatcaagtgttcatgaccccacgttgccttacctgttctgcctgtggtcatctgtccactgaaagaaatttcaaggaaaacaacatgatctggaacatgaaagataaaatgtttctagaaaatgttatgtgtatcgcttctcagccttttggcgaagatcaaatgaaaatactatgtgctttgtagttaaggaaattagtagcttctgtttattaagcatttactatgggccagttactctaataaaagtcctttatatgccttatctacttcaatcttcatatcaacctctggaatgtgggttctattacctccattt

SEQ ID NO: 223138 - DNA, 386 bp, Homo sapiens
gagtaagtgagataatggacacacagtgcccagcacagagcctgacctagagtatgcccttgcgtgagtcaaggtaggctagttgtgtcgttatgacaatcaatgcagggtttaagtatctttaaaacataaacatttatttatttatttttacctaatgttggccgtcagtctgggagattcctccaaggagtggctcaatgataaaggctgcttcgacctcatggcaccccgtctcaatacatacatctgtggttgtgatgtaggtgggacagatggagggtctcactgatagtgagtgctttggcctggaaacgactcacatcactgccactcacagccaattggccagaaatagtcatatgatcccaaagcaaaaaaaaaaa

SEQ ID NO: 223139 - DNA, 445 bp, Homo sapiens
tgatgatcccctgcttgattgtactgccttaaaaacaaacaacaggctgggtacggtggctcacacttgtaatcccagcaccttgggaggccaaagggggcagatcacctgaagtcaggggtttgagaccagcctgaccaacatggtgaaatatcgtctctactgaaaatacaaaaattaaccaggcgtggtggcacatgcctgtagtccagtttcttgggtggctggggcagaaggatcccttgaacccgggagatcagggttgcagtgggctgtgatcgcacctctgtactccagcctggagtacactgggcaacagagtgagacccttgttctcttaaaaaaaattaaaaataaaaaatgggatcaatttctgtataagtcattgtttgcactcaccttgttggtaaactgggagcagctgcggctgcgggacatcaaggca

SEQ ID NO: 223140 - DNA, 444 bp, Homo sapiens
gcccctgcctgatttcatttcagcaagctttactgtgaagtgtttatgtgccaggtaccatgtgtagaagcgctggcccagagatgaagatgaagtttctatccttaaggcatgcaatgtgggagatgaacagagacaggcaagatgagccacagaagagaaagtgatgtgaagacagaagcagggattggagtgatccatctacaagccaagaaataccaatggttgctgccagccaccaggatctaggagagtggcatggaacagattttcccttagagcttccagaaagaactaaccctgtcaacactgtgattctggacagtgagagagaaatttctattgttttaagccatcaagtttgtggtaatttgttatggcaaccgtaggaaacatcacccagtaaatccaaattaaatattatcccaatttttgcttgatacc

SEQ ID NO: 223141 - DNA, 398 bp, Homo sapiens
ggcctctggtcctcagcccagtaagaacacttccttcttcttgggccccaatcccctccaccatggtttcaaatgtgtaagcaaggaaaaagctgcatggagatcaccgtgtgtgcctcccttattcagtgatagtaacgccttcactcttgcctgatttggtttctccccatgctttcaaagactttgaccaattttaataattgtttttggtgagaaggttagtcatagctggaactggaagtgctgtaaaaccactaagaaaaaacagcttaattattatctcgtgaaattgaacatttatggactccatgaccttggaattttatttctctgactatgcttaaaagaaatatttgtgtacatatactagaaaatataaataaggatgttcatag

SEQ ID NO: 223142 - DNA, 578 bp, Homo sapiens
gcgttctagagtatccctcatgtcgctggtggggaagtcaggcagagcttttagatgttgaacaagaacaggaaattgtgtgcgtttttagagagccagctgtcttgagagggaccacgttggggagtgctgagacaggaccctcatgctcaggggctcacagtgttgtgagctaagtggataaacaaccagtcaaggtgctgcaataagaactctgacactggtgcagaggaatgatttgatatgatgtgagatgctatcatatgatgtaattgacgtgacgcaatatacattacaatacatgcagaccgctcatctaagtgcctagcatataataagtacttagtaaatgtcatacactttcttttggggcaggaaacagagaatagtataaacaaggtgaaaggcaagaaataatgtggtgaattccaggaatgctgactagaccagtccagtggaagagaaacattagggaacttgggggcatttttactgactgtctgggaagattgcattctatcttgatctctacttccagataaatctttctaaaacactaccttgatgataaagctccc

SEQ ID NO: 223143 - DNA, 416 bp, Homo sapiens
gtcagctgtgcttttgaggcagggggacagcaaggcctggccaaccccagctccagcctccccagaaagttacagttcacaggacacaccctcaggcacagctcctgtctaatttatatagcaactggcataaggtcagtctcctagaactaactgactttttttaggggagcattattacaagacctgtgttttggagaaggcttgttggactaggatctgaccatctcagacatgctacagattaaggtcaatgccaggtgctatatgaattagacaggagctgtgcctgtcctggaagcccacacacagcccagggccagcgatgcatgcagctgggggcgggactctgaatctgttctgaaaacaggaagttaggtgtgcagggctctcgcccacatcgggaacagtctctg

SEQ ID NO: 223144 - DNA, 328 bp, Homo sapiens
catgaatatttcgcaaaaagaaaataatttttttaaccattaaaattcctggtagtgacttcctctggcaagtaaaaaactctcattttccttaaaaaatgagagttttttacttgcaataggaaaacttgccaatttttcaagttatttttattcttgatgattctcaatgagacataattaaaatacacatagaaaaaacaaccgtaggccaggtgcagtggctcacaccagtaatcccaacactttgggaagtcaaggtgggaggatcactagagaccaggagtttgagatgagcctgggcaacatattgagacactgtctcctc

SEQ ID NO: 223145 - DNA, 308 bp, Homo sapiens
gttcactatttcccaccatctcatctctactagtcatgaacattgtcttagaaattctctattgtcttatcaaattctatgaattttttcttttctttctctttctttctttctctctttctttctttttgtctttcttttctttcatctctctctctctttatttctttttttttttgacggagtctcattctgtccccaggctggagtgtagtggtgcaatcttggctcactgcaacctctgcctcccgggttcaagcgattctcctgcctcagtctcccaagtagctgggactacaggtaggaga

SEQ ID NO: 223146 - DNA, 471 bp, Homo sapiens
gtaattttggaaacctctttgatgtctggcttatagaagacacctgggttcttatatctgcttctgaattcgatctattgtaatgtgttattttggctgaagtatgtgaagaaaatactaccttacaaagatatgtattttcaaaaggaaatacatatcagaaagtttaacaaagccagtaggtgatactaaagttgtcaggataaatgatgtctatctggagagctggcaagaaacaaccaagccccttgaacgctccttacagagcaagaactatgattgatattttcttactcacttgtaaattgcgtgattttagctctatttcaataactttttcagaagactgtagatattcttctttgatactacatcagaactttgcaagtaacttcaagtagtaatttcgtaatattctttttaataatgtgtacttttcctatcctattacagtaaaagccctttatataa

SEQ ID NO: 223147 - DNA, 974 bp, Homo sapiens
ttcccagcactttgggaggccaaagcaggcagatcacctgaactgaggaggtcgagaccagcctggtcaacatggtgaaagctgtctctactaaaaatacaaaaaattagctgggcgtggtggcacatgactgtaatcccagctactggggaggctgaagcaggagaattacttgaacctgggaggtggaagttgcagtgagccaagattgctccattcgactccagcctaggcaacagagtgagactctgtctcaaaaaaaaagaaaagaaaaggcacatttaatttcttgtctttcacaggggtaaggtcaataaatactatatttataatgctagtgagaatttgaggctaaaaatattttaatgtaaccaatagtagaaatgaatgcataattatgaagtactagaaggaaaaaaggacacaaagaaaaggaaatgacaaaaaaaattgtctcccaaaaacatgatgacaaaggtaacagaaagaaggccagacacatgcattattcccaaaaaaagaggacagactgaacagcctaactaaaagactaccagttgggtacaaatatcaaaaattcaatcataagctatttacagagggatgccccacagaaaattgatgaggggagaattcaagacaaagggattttttttttttttagtgttcaatttccactttatcttctttcattacctcttttataattaacgattcatttgcagttttgctgaataaaaaaattatacaaatattctcagacaaaaaaaattaatgccaaacttaaaggtgattactagaaaaatagtacttttaagtactaccaaggaaactctgtataatgtttgaagtgacaatttgaaatgcttaaacaaaaagaaaagaagaaaattaaatgctgacttcaaatgctattaaaattaaaattttttacacaggccgggcacggtggctaatgcctgtaatctcagcac

SEQ ID NO: 223148 - DNA, 144 bp, Homo sapiens
taaacggtagaaccagaatttgtagcacttaaaagtgcaggctctgaggctcaaatatctgggctgatggtgagaatttaatgacgcaatacacgtaaagcaccatgcccagcacagagcgttgacgcggccgcgaatttagta

SEQ ID NO: 223149 - DNA, 974 bp, Homo sapiens
gagatgagtgatgtggttgcacagaaaacaggagacccatgaggagacgtctttggtgtgctggggagagataataaaggcctgcagcaagcaggggaagcaggaatggagacgggcagggtggaagacatgcgaaggaagtggagcggtcaggactccattgtttaattggtgatgacaggaagagaaagagaaagagtagactgtgtgagagagagcagaagagaaggaaagattggtcattgttactccctggttcttggctggggtaactaggtatatgatgtgtgtgtatttgctgagatgtgggacacataaggactagaagagttgcttggtttttgataaccaagtctgaggtgcttttgggaatcatggcccacttaactttccactccttttcatctgtgaaagctctgatgtctgagaaaggtcaaagggctccttggtagagaactataagcaagtacgatccaacttaaaaataacttactgaacattcactatgtgccagacacagtgtggtccacgctaatctccgagggggcagggactctgacttgttcacgtttgcattccagtgcctcatacagaggctgacacacagtggacattcaattaatatttgttgaatggatgacaagacatgaatgaatataacggttaatgggcagtaggaatatagtaatgagaatctcctgatgcctccttttgggagcaagctgtctggttggggcgacaaatgtatagacaaccagtgtccaaagagcatattaaatacttgaatagaggttggatgtaagggcaatggggactgaagagaaaggaggagtgactgagccctcgtgttggatttttaaggatatgtacaagttttctaggcaaagaggaaaagaaatcccaggaagaaggaatagaccatatcaaggcttagaggggtgtaaatgtgtggcatggttctcagaataacaaaa

SEQ ID NO: 223150 - DNA, 509 bp, Homo sapiens
cccttgttacagatggggaatccgaggactggagtgagaagtggtatatccaagatctcagggcaggttagtggtgggactaggctggaatccctgtctccagggtcccttagccagcaggatggtgggttgctgaatgccctatgttccagcaccagactcagttgggtctctgaaggagctcagttggagttcttggtggcccagggaacattttcccagatattcccagcaagaaattcagcgtagtgggaaaaggggaccagctcatcttgatccttccagccctcccctggcacagacagaaccactctgcagagatttcccaaaaagggccatcccactatctgctactgtgcctcgtggactgttccaatgcctctcacactagccaccaggaagctttactctatgtctaacctaggccctgatcattaaaatcacacctttaaaagaataaacatatatcaagaacttagaacagttcctgctatataataagtactcta

SEQ ID NO: 223151 - DNA, 366 bp, Homo sapiens
ccccatgcctcaatgtcctcatgtttcaaatgaggataataacagtatctgggccaggtacagtggctcacgcttgtaatcccagcactttgagaggccaaggcgggcagatcacgaggtcaagagatcgagaccatcctggccaacatggtgaaacctgtctctactaaaaatacaaaacttagccaggcgcggtggctcacgcctgtaatcccagcactttgggaggccaaggtgggcggatcacctgaggtcgggagttcaagaccagcctgaccaacatggaaaaaccccatctctactaaaaatacaaaattagctggggtggtggcgcatgcctgtaatcccagctacttgggaggctaa

SEQ ID NO: 223152 - DNA, 452 bp, Homo sapiens
caactagaataatatgttacaaaatatctggataccatggcctagttaagttgacagatacaattaactatcacagtagacattctaatttgtctatataaaagatttaaaaagggacaataagattctctgaattgctggcagaattatgtctatattttagctattttattataaaaataacacatggaaaattggaaacaacctaaatgtctatccataaaggattaagtgagtaagttataatattctataaaatactactattcagtcattaaaatagtatgtagaagcatagaaaaggtctggcaggttttagaccaaaggggaagaaaaggactttgactttttacttcatatatattgttttaattatttacaagaaagatgtatatgttcaaaattaaacaattttaaaaatagcaatattcagaaatttccagaaaattata

SEQ ID NO: 223153 - DNA, 470 bp, Homo sapiens
agtacaggtgtgagccaccaccatacccagcctgatttcatcaaaatatttacaaaaatcttcctctgcttttcattctttctttctgtaatgaaagaacctgattttatgcactcagtttttttgctgttagataatacttattcttgacttcccatctacctcctacttgaagcattcttgctacaaatacatacctcagtgcttatataatctgcctaaacagcttccaggaactagaaagtgagggggaagatgctgtaataagacttctttttttcctactattttcaatatgttcctttttttttttagtttacttgctgctttattggaaagtgttctggcatcagctctttttaaatcatgcagattagaaagatttctcacaatgttttaatttgatcaaaactcggaaacactcacctttaatgtcctatgaagtttaggtagagagtcttgatgtaaca

SEQ ID NO: 223154 - DNA, 465 bp, Homo sapiens
aaaataggctttaatagtctgtttacaaacaattcatcaagctgaactctgctacatcctgagcccatctccagccatctttccttccaactttaaagatatgctaccttacaatcttggaattttgtaaagaatgggagggattctgcaatatggaagctccctggatacactaacatcaaaaaagaaatagtccattgtgaacataatagctattgaggcaatgtggaacagaataagtatgaataatctgtctacagcctcgtattggccaaactgcactttgaaagccaaagcatcaaaactggctcctgtttctttcattgcccctgaggcttttttctctggaaacacaagcatttgcaaagtaagggggaagcaggagaaggaaggaatggagaccactttgaagtagtatcccacagccaggaagtagtgtttgtgcattttccacatttgtgaatg

SEQ ID NO: 223155 - DNA, 434 bp, Homo sapiens
agccaattttcagaataaagaaacattctccccaggctccagacaccttgcaaataggaaagtggacctctgatggtgattcataagcatttcaatctcattctctaagtcttgtgactggccattccataactccaaatgcctttggctttgaaatttcctcccagggtgcctgcctggcatgtagaaacttcatttagcatagcgcaggtggtcttgtgctggcccagggcttggtaaaaactccctttgctcaccggaatgtttgcctgcaccaagcctgtacacaaagagctcaccctgagaattcgcacagctctttccatcactcaaaaagagcatcagaagagcaagagaagatggcaatcacctgaggtcgtgagttcgagaccagcctgaccaacatggtgaaaccccatccctaataaaaatac

SEQ ID NO: 223156 - DNA, 352 bp, Homo sapiens
aatatatcgtctaaaaggtttgaaatttaattttagaaagccctttaatggcatctattctacagcacctatgttggagggggtatatgagagtagaaggaggaggagtggagtatcctgatggcttcaccagccatgtcaatatttggttacagttcagatcaagtgagacttagaaaaacatccttctatattcctgtatcattttgctttcctatctatccattggttgatcaatccatgtattcatcaatccatgcattcatccaatgtttattgatcatttactttgtgccttgattctctaaagaaacaataaaaactgttggattttcaatttataaaatcgtgt

SEQ ID NO: 223157 - DNA, 528 bp, Homo sapiens
gttgacagctgctaatgagcgtgttggtgttttgctcggcagcttggatcctagcatgactatacattgtgacatggtcattacatatggattagaccaactggagaattgccagacttgtggtaccgattatatcatctcagtcttgaatttactcacgctggtatgtgaattattcttttcctttttaatgtgttggtttattcaggcccttaaatggatatgtaagaaattaagggctttgtctgggtatggtggctcatgcttgtaatcccagcgctttgggaggccaaagcagaagggttgcttgcatccaggaattctggcacagcttgggcaatgtagtgagaccccatctgtacaaaaagtcaaaaattagcttggtgtagtggtgtgcacctgcggtcctagctactcgggaggctgatggaggaggatcgattaagcccaggaacttgaggttgaagtgagctctgattgtgccactgcactcagccaaggtgacaaaaaaggccctgtctccaaaaa

SEQ ID NO: 223158 - DNA, 384 bp, Homo sapiens
tcccaggtggagtggggcttataggggtcaggaacagaggctgggaggccctggggatgtggacacagttgtctgaaagagagctggggaggccgggcgtggtggctcacgcctataatcatcctagcactttgggaggccaaggtgggtggatcatttgaggtcaggagttcgagaccagcctggccaacatgatgaaaccctgtctctactaaaaatacaaaaattagccgggcatggtggcgggtgcctgtaatcccagctactctggaggctgaggtgaaaggatcgcttgaacctaggaggtagaggttgcagtgagctgagatcgtgccactgccctccagcctgggtgacagggcgagactccatctcaaaaagaac

SEQ ID NO: 223159 - DNA, 683 bp, Homo sapiens
aacgcagatagtactcagtgaatctcatctgtaagtcctctacataccctgagcggtgaaatggaaaacaacttatccaaacagcattataagagaaggactaccggtctgacaaaattctgcctctaaggaacgtggtgaatattctgggattatgaaagccaacttggcatattacgaacactgacttttataaataacagatctttataagtgctaatagtacacgtttaatttggtaaacaacaacaacaacaggcatttccagcattaaacagaattaaacaatttggatgtgaaaatacataggaactatgtttcttggctcaataatttttaagtactagtctcacaaggaactgaagtgtagtaattacttatgttcaacagatggcgacctttacattgtagtcagcaaaacagtatttgcataaaacagtatactcaaccagcagaaaatcaaagatcaattacaaatattccatattttgcaagagacaaaaattacttgatcatatacaccattttttgacaggtggtttttttacaggttggcaaacatattttgtgggaatgtatcttgctgttctattttttggggcaagtccaattgctaattcttatctcatgaaaatatgtgcaaatatcaggctagggaataattcctgctttctttgcatagc

SEQ ID NO: 223160 - DNA, 578 bp, Homo sapiens
gcatttctgatgatgtggaaagagcgctagatactgggtctggcatgtgtaaattccagtgccagctccacctcatgtaatatggtgaccaccggcaattctctctccacatctgaccccaagtccctcatctataaaatgaggacagtcattgccttctctttcttacacattgttatgcggatagatgacacagtgcatctgctgctcttactgtttccttgactatcacttttcctcccaccgccccatctccacccccaatcatcccctccccagacccctcatgtatacatcatagagctcccaaatcactccccaggcctgtggtctttccatgcataatttccaccttgtgctccttcctcatgttctgtaggaattcctggagttggtcttctggattatgaattcgttttttaccatgccgctattcctcatctcgattaggcttttcttcttagttttctccaccttgcttttcctttccctgagctctctgttctctaattgcttgcttttcacagcaggctcctcattgtttgctcatgcttcctaatggggacctaaactcaccg

SEQ ID NO: 223161 - DNA, 449 bp, Homo sapiens
gtgaactatttttatttggtttacttactggctttctggatgactaggtagagctttaactaaagaacacttctgctgtggtctgtgatgatgaattttcccgtagtgtcatttctataatggaataggcaaactgaccatttagaatgtgatattcctaaatcacattcaaatcagtcttatcagagacttctaatcaataaaaataaagcaccagatggctagaggtagtttttgacctcagcttgggcctcagcaaagattttttgtgttttttttaactacattaaaacatcagagtttaagacacttttctttgagcatcagaaatactctcagctgaatttagagttgaactatccggaagaaccctggagaaggagggtgatttattttcaactttctgatttaccaccgacttaaatcaaccaatgagttctttctttgac

SEQ ID NO: 223162 - DNA, 150 bp, Homo sapiens
attttacataattaccagcatgtctttacttttcatttaaaataacctcatttacatccttatttattcatctgtcaaatcaaagctattaagtttttagaaacagtgaggaaagaagaggtagaagagaggtctcttcctaacctcccc

SEQ ID NO: 223163 - DNA, 490 bp, Homo sapiens
cagctagattcaaagattttctgattggcaattggttgaaaagttactgactaaagacttaggaatgtctttagagaataaaggggttgtggagaccaaggttttagtgagaatgggataattggtgtggaaaacacaatttggtgtcagaagtgttgtgaatacatagttttccaattgagtttctggatgagattaacatttcaattggtagactgagtatagtacattgtcttccccaatgtgggtgggcctcagccaatcgaccgaagacagaatagaacaaaaaggctgacctcccaggagtaagagggagctcctacagccaaacagcttgagctggaacacttttccagccttgggctcagactgggactgcacatcagtttgcttgcatctccagcttgtcaactgcagatcctgagacttctcagccttcataattgtacgggcaaattccttataataaatcttttatacacacactccc

SEQ ID NO: 223164 - DNA, 195 bp, Homo sapiens
aggccttgggagacagaagggttctatcatgttataagttctagttaccggtttacatttttcctccaactttttattttccaaaatttcaaacctaaagaaaagttgaaagaatgaattttatagttcatataataatcaaatatatactataatagtataatagtctttatccacatcactaatttattaaca

SEQ ID NO: 223165 - DNA, 354 bp, Homo sapiens
ctaggtgttgggataggataagaattattggtagccagagggatttgctaccgggcagcggtggtgaaggtcatcttagtacaaacgaattgtctcctggtttagagtctggcaggaaacttggaatgagtggggaagttgaaagtacagatgcttcttcttctgtgcatttcagtctcatcaaaggctctgcagtgatgagctgcgtctgggtgtagaagcgtgttttcattcctgagatcaggctgttctttttaaatgagaacaaccttgtacctttggatgtattttgcttgatggttgcacaggcatttagtataaaataattattaaaaaaagactcttctctgcccc

SEQ ID NO: 223166 - DNA, 443 bp, Homo sapiens
agcgccccctcctctgctttctgcggggacacttctgccctcgagctgcagtggggacctcctcccctgctctggccctatagccccctccccggccttcagagccttacatcaggctcctaagtacgtggccttggggtcctgcgggccccttctgcttgccgtccctgcccctggtcacgcctgggaaaggttgcagctctgaactggggagaagcttatagtctccagcacgaatgaggcttgaggggcacgaggcagaggcctggacaccccacccacctggagccagtgaccctcacccagtgcctcctttaagacaccactgcaggctgggtacggtggctcacgcctgtaatcccagcactttgggaggcaggcggatcactaggtcgggagtttgcgaccagcctggacaatatggtgaaaccccatctctacta

SEQ ID NO: 223167 - DNA, 306 bp, Homo sapiens
aaaggaattgaagggggtggggggcccttgtagggttccccagagagactgaggctgtgcaataaaaggaagcaggtagacagtctgatcaaatatgcagcgcaaatgatgactgccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatggggcgtccatcatatatgccccatgcttg

SEQ ID NO: 223168 - DNA, 444 bp, Homo sapiens
ggttcattagttcattcgaagagtttttcatttgtaccacacattctgctaggcactggaaacacaatcactgcccttgtggaacataagctaatgggaaacacagaaaataagtaaacatataaatacgaagttatgaattgcgacgggttccgctataccaaaatgaactggatgcactgagaagagaaacatggaggccttggatacaggatgtcaggaggcctttcaggcagaagctaaaggttgaggagtgagaaatttgaaaagtagaacataccaggccgagagaacaacatgtgctgctttcatgcaggaaaatgagcccaagatgaggcaggggccagttcataggcaccgggacccatggaagacttttaagcaggggatggtactgatttctgttgtataaaggtcacctggccagagtacggagactgaatt

SEQ ID NO: 223169 - DNA, 321 bp, Homo sapiens
ccgcacccggccagtgctggagatttgagtccatggtgagatcaaggccaaagagaccaatgcctcggtctttcctttttcccttttatatttaccgaatgtctgtgtcccagcaaccagtaggctttatttttcactgtgaaaagccgtgggttcactgctcagaggaagtgtcgggaaggggtggaagcagctttgcctctctgaccacgcgccccacatgggtgactcaggtagcgtcctctgtcactcatcagctgtctttgtccttcctggcagaaatgcattcgatttaacccggatgccacagtgtgggttgca

SEQ ID NO: 223170 - DNA, 374 bp, Homo sapiens
gtaagcaaacagtataggtatttgtaccccttttttttctttataaaaaagtagcaaactgtgtgtgcttatttatagcttgctttttccttttaaacttaatatatcctggtggtcaccttatagcaatatgtaaagatctttgttattttttcaggagatggatagtactccattgtttgtatccactatatgttcaatcatttctgtatagtaggatatgtgaaatgttatcagtcttttgctacctgaattagtgcttcaacaaatagccttatgcatatatcatttcatatatttgtcattatgcctttgggagatcataggaggtttttgatcagcaaaatgttataaaagcattgttaggaagatta

SEQ ID NO: 223171 - DNA, 539 bp, Homo sapiens
ggtatgaagaaagtctattaaaagtaagctactcttacctacctgagataggggatctatacaagaaaagttttcaactacagcctagatttctatttctgcctaaaaccacatcagaccctacccacaaccagtaatactgctgaatactaaaatactatgactgaagatatatacatgaggatacttccaacatgagcaacataaaacctttcagagtttcagagtaaaatggcacagccgctatggaaaatggcatgtagtgctagctactttggagtccaaggagggaggatctcctgagcccaagagttcactgcatcctcaaactcctgggttccagctatcctactgccccaaccttccaagtagctagtactacaggtgcatgccaccatatccaactagatggtatgatcttatatctagaaatgaattcaagatgtaagatcaacatacaaaaatcagtacatttctatataccaataactagttgaccccaaaatcaagaaggcaatcccacttataatagctaaaaa

SEQ ID NO: 223172 - DNA, 475 bp, Homo sapiens
cagtttattaacttatatttatgggttcataaaaatagaacatgaatacgtattttaatgaaaaaaatcacacttttataaaatttataatgagcctttttttattgtgctttttacattatcactgttttaaaatgagctgattcaaaagactataaagactccctgaaaaacagtacaggaaactcaagaatttactttcccaaaaacagcttttaagacatgaacatgaactgcctaatgaatctcatagttaggcttgtgaaaaggaccaacttgcacctttcagaggtttctccctctttttaaaaattcccatacagtaaaacctgctgacactttttttttttttttttttacaagacccagggaggggggtggaatcttgccacatggtggggggcggggatttgaaatatttgtgagaatttttatacgctggattcccctctccagtgtttagacaagcaaaaaa

SEQ ID NO: 223173 - DNA, 548 bp, Homo sapiens
gttggcaaccatgtatagggttatttattgatgactttgctcattggcagtataaagggcgtgtcacttgtcattagcagtaacaatttcaccacattatgttctctttttattttctctggtggcaacatgtgtctgaacagggccactggctgtgggtcaagaggtcagtctttgaggttaagagtggatggggtcatttgctattaacctaagattagcagctaaggttttttttttctttctttctttctttcgttttaacagatttcctccatttgtataacatgccaaattaatcttgcccaattttagaagaatttctcctttccaatctgcattttatttgcttagatttatcattaaggtattttttttctattcagatttctttctagcccccatcctagtcctcaaaacaatgttaactttttctaaaatttaaaaatgttcctgtctttaacattcatcttccagtgtacaaatgcagctaatattttctctgctcttgaacttttgagggaaaaacaaatacatggcagaattgt

SEQ ID NO: 223174 - DNA, 512 bp, Homo sapiens
ataaaaacatttatcagatgaaagattaagataatttgctgctagcagatctaccataaaagaatggttagaggaagctctctaaatagaaagaaaacaattaaaaagaaggaatcttgaaacattgggaaagaaaaaaggacatggtatgcaaaaatatgggtaaatacaataggctttccttttcctcttgagttttctaaattatgtttgatggttaaaaaaaaatcattataacactggctgatgtggttctaaatatatgtggaggaaatatctgagccaattataaataggggagggcaaaaacacatctagggagataaggtgtcttgaactagtaaaatattgacacgagaagaccatgaagagttaagtatgtattacgtgatgcctacagcaatcatttaaaaagctatacaaatagatacactaaaaaatactacagataaactgaaatggaaatcttttaaaatgttaaagtaacccacaggaagataaagaaaaaaaag

SEQ ID NO: 223175 - DNA, 451 bp, Homo sapiens
gtcctgtcttgccttttcacatttttctgcttgccttatgttcactggaagatgattaaattatgcacactagattaagtgcagatgtgccttccccagcccactgactcaaatgttaatctcttttggcaaaacccaacagacacacccaggattaatagtttgtgtgcttcagtccaatgaaattgacattcagtattaaccatcacaacaaacgtgcatttacattgcatagtgaatgtccttgaacttgttcagtccagtttcaggtgtcttatttcttgggggtagaataagaaaagcagagagaagtcttcttttcccttggagcactggttctcagatacttttattttctagcctcttatggggtaataataattaaaatggagaaaaataaaataatagtaaaatttgaaacaatgcaaaaaatgtaaaaacgaaattactg

SEQ ID NO: 223176 - DNA, 531 bp, Homo sapiens
tagatgtattcttaaatcccaaatatttatttatgacgacagtgatcagctttggctattttagcacttggctagttacgatttggtgaaaatacatatttgatatataaagtaaaaaaaagaaaatcctgattcacagccacctccttccatgaccaaaagtcagctctcctaatagacctctatgtctcattctgaaatatttgcatgcctagaccaggtctaaaaacacacacatttaatttttccatgtcttactaagttaatatgatacacgctatcagtgcaacttgcttcttttcatttactattgcacatcatttcacatcagtatgtcatatcgacttactctttttcatggccaagtaaggaatgggttcagtaatttatgcacatccatacagtgaaatatttcagccttaacaaccgcgttgtgggtatgtaatgatatgaaacaggtgatcgaaattaccgtacatgcaagaaagtagtcaatagggaggcagtgcagtatttggcaaaaaaaaaaaa

SEQ ID NO: 223177 - DNA, 630 bp, Homo sapiens
ctgacactctctgagcttccctttccttcagccaccacctaggaacgtcacacaggctgacggggttactaaatgagacagtgtgtgtggaaggtggaccatcaatattggcccccagtcctccctccatcacatcaagtatgggttttgctctttgtcaacggtggtactttacacctacagacatacacgtgaggtctcagccttttcatctgagtctactggtagaaggttttctgaatggaaatggacaattcaaagaatcggaagaggagcaagtgtttccaccctctgctgagatttcagtccttcttgcacttaagcactgctctaaatgtgaagcgacaattcctcatctgtggcacgaggaagacaaggcttagtaaacggacttaccctgtgcaaggaatggaactggacgggaacccaggtctgaacgtcgaagtctgtgctctttcctgcctcttgctcccctagggtgggtggaaaagagtcttgggtttacacctgcctggccctctcagagcaccatttgcgagccagttctgccaagtccgactgtacttttcctctaccccttctcctttcagttcccctgtgagggaagcacccacaatcttcctcttccct

SEQ ID NO: 223178 - DNA, 647 bp, Homo sapiens
gctgcagttcacctctttctttgtgcatcttcctctacatgtatggatttttttttagacttctggtttagatgtaaaattgttgcttgacaggacatgcatatttacatttctgaaagttctgataatgacaatttatgcaccaaaaaggttgtatcaagctgtatactagccctaaaatcctgtactgttagtcttgtaatttttttctgtttgcaaacctgatgtaggaaaaatatcctgttttcttttttttcatgtttattagccaactgaatttcttcagtcaatcgtctgtctgactctgtactcatttttctaacgggttactcgtattttccttatggatttttaggagttctttacatgtgctagatattaatcgtttgtgtcatgcagcttcaactgttttttaatcccttgattatgtttctggtctctttttccaaaagaacgttgttctctttatgttgttaaaccttttagtacttttcttcatggcttttgggttttatgtcttatttagtctccctaatattctgttattaaaggataggtgggcatggtggctcacacctggaatcccagcactttgggaggccgaggcgggcagatcacctgaggtcaggagtttgagaccagcctgg

SEQ ID NO: 223179 - DNA, 238 bp, Homo sapiens
acaaaaggggccttacagcctatcgaggccaagtgtaaatgttgccaggtttatttctatgtaactacagtgccttaaaaaaaataactggcctagcaacatgttgtatacatcagcagagacatttaagaggtagcaacagttaccacgaatccaagttttcctttcccttatcttgaataactagagacttttaacagcataaaaaagcccaaatacacacaaagacgtattattc

SEQ ID NO: 223180 - DNA, 720 bp, Homo sapiens
gcagtaggtttatttacaccagcatcaccacaggcatgtgagtaatgctttgtgctacaacatcatgaaagctgtgttactaggctgtagggatttttcagctccatcatagtcttaacgggactgccgtggaatatggggtacgttcttgaccaaaacatccttatgtggcacattactatattagtttatatcatatatgtgtgtatagtttataagttgatacatacttagtttatattatatattttaaagatatatgtgtatattatatatgtatatattttatatatatacatgtgtgcatataagtgtatgtatgtatatgtacgtatgtatgtatgtatgtatgtataaagcctgaccagcaaacttgaaaacattctgtacacagaaacacctagcctggggctgggtgcaatggctcatatctgtaatctctgcactttgggaggctgaggcacgcgaatctcctgaggttgagaccagcctggccaacttggtcaaaccctatctctactaaaaatacaaaaattagccaggcctggtggcaggcacctgtagtcccagctactcaggaggctgaggcaggagaatcgcttgaacctgagaggtggaggttgcagtgagctgagatcatgctattgcactccagcctgcatgacaagagcaaaactctgtctcaaaaaaaaaaaaaaaaagaaaaaagaaaagaaacaa

SEQ ID NO: 223181 - DNA, 825 bp, Homo sapiens
ataaataatcatctgataacagccatgatacaaattagtaagaaagtgtggcaggagcacagcagatgtacaatagggaccctgagccttggggatctaggacatttgagctgaggcctgaaagacaagtaggaagtaaccacatggtgaagttggaggagagctccaggcagagggcacggcatgggcaaaggccctgcggtaggagggaacaagtagatttccaggaagggcacaggggcctgcagggtaatgtaagtgaaatgagaaagctggagatgcagctggagcaggacagtacaggccacagaggctttgcgactttatccctgggcaaaaagaggagatgatgaaggattctgagcacaggacacaagccagtatgtatttagacgcgatcctgccctgtggctgagcctcttctgagaagtgcaggccctgtgtcacgtcaccctgaacctcagtcatcagggttttggatgtgagtttccatatccctcttcctaggccaagctctcaaaggcaaggctgacctctggtcttcagcttcatcctcatcagccaggccagtgcccagcacaaggagctgctccaaaaacatacgtgggttgaaccagtgaccaggacaagacgcttatcagcatttccctgcgaaggagcagggctgcctgtaaagccttccacattctctagaaattacaaagttcaagggttttagtgaggccacgactcagggagcccttgagagccaagctggcatcccactgctgtgcacacccagcctgggcacacagtatgaccctgcccaggcatctgcctgcggcc

SEQ ID NO: 223182 - DNA, 405 bp, Homo sapiens
atgaaacccctgctcttggcagagtgaagagagggccttctttgagtggaaaaacctatccatcatgatggttggttggtcagacatgattccctattactgtttcatgttgcagctaatcttctgtcttctgctcctcatcacattagtgttacgcatggtcttccaaatttggaaacaacattgaacaacttaacttcaggagatgaaagattttcaaacttagtggatatctgcaactttcagaagaagagaacaaagaatgcactcaaagggaaaaggacatgtacttcattaccattgtcttttggaacataataactgactggtttcattcacagaaccatggatctccatgtcatttgggatacaagcagaaaacataaagatacagcaaatttcctg

SEQ ID NO: 223183 - DNA, 414 bp, Homo sapiens
ggcattaagccatccatgagggatccaccccatgatccaatacctcccactaggccccacctccaacactggggattacatcctaacatgagatttggagggggacacacatccaaactacacagtgactaacagcaaagtggtttctgttgagtcattccttcagtaatttctaaaatgctaaaaaaggagaaaagtaaagtgtctgtgcatgagaaactcagaatccagtgattcaggaaaactgtttacagggagtagagcaccatgtctatgatatgactgtggtgatgtcatcccggaagctcccttgacactctccagctctgcccacttaggttaggatggttgagagatacttggcattttgtcctcatgggaattgttcgaacagagatggaatgactgcttgtc

SEQ ID NO: 223184 - DNA, 463 bp, Homo sapiens
gaaaaaaaaaaacaagttataatctaaaatgtgtatacatatgtacattatttggggccaggagcagtggctcatgcctgtaatcccagcactttgggaggctgggtctacacagggtcaggatcataaatatcactcacttttgctcatcttgtcccacaggaaggtcttcaggggcaataacactcatggaactgtcatcttctgtgataacaatgccttcttttggaacaccttctgaaggattttcctgaggctgttttgcagttaatctttcttatttcttttaaataagcaggagtacaatctaaaataatgacaaaaaggatagtatagtgaatacataaaccagtaacatagtcatttattatgattatcaaggattatgtattatacttaattgtatcttctggactttttaaaggctagtagtacaatagtttgtttacatgggcatcaccag

SEQ ID NO: 223185 - DNA, 1024 bp, Homo sapiens
acaaaaatgaacatgagaggtttctgctaagataaaatattggataagggaataatatctttgtttggaactggtaaatattacctactcctggagtaatacatttaaggaaactagagaacagatcagagataatatttaaaagtttaaggaactaacaaatttatagtgacagaaagcagataagtgcttgctggggaaagacgggggcaaggagagacaagaagtagaaattacaaaggggcatgaggaaactattgggtgtgacagatatgttctttttttattatagtgattgtttcacaggtgtttacaagtgtcaaatttatcaaattgtacattttaaatatgtacagtgtatgtcattgcatgtcatttaggtcattgtatgtcattttaatgtatgtcatttataactcaataaagctgttttaaaaaatcaagaggctgggtgtggtgactcacacttgtaatttcaacattttgggaggccaaggcaggaggatcagttgaggccaggagttcaagaccaacctgggcaacacagtgagacccttggaaatagtgagaccctgcaaaggaaagaaggaagggaagaaggaaagaaggagaaaggaaaagagggaaagaaaaaaagaaaagaaagaaactcctggagtaacacatttaaacttaccagttcactgttaaaaaaaaaacttgaaggtttaatcattacagtgacttacagcatatcttactccaaacgtgtgatgttaactatggtccatctatttctagaaatttaaggcaaaggatgattttagtaatgaagtttccaataatgccatcttaaacttgttttaggtttccaaatataaaaatacttcatgaacacagacaggaagggcaataagaattaaacgagataagatacatttgataaatgttagcccagcaactacttttgttgtcactatttctgctactacagttattataatcaaaaacttcattcattcctgagaggtatgagaaaaaaaaa

SEQ ID NO: 223186 - DNA, 546 bp, Homo sapiens
caggctttctgggccctgtcattccttcttctatcttctgggttgagcaacatgcaatctccccttgtgcagaagcccaaatagctactgaaaatgtgtcctctctgactttccccatttcttgaactctgagagactttttctagtatcagttctgaggagcattgctgttttccttcctatcatctggaagacctagactttaaaactcaaaacctgagaaaaacttccttttttttctctcttttgtctggatcatcactaccttgaaatactaaattagcaaagtcctaactagaaactgaattggctaaagagtcaaggagcaacaggtaattccaagaaaaacaacagcaaacttacatcagttaacatttcaaagctattttcctttgcaattttgtgtatctgtttttatggaatgcaagagataataggctaaatgctattttgcatatgtgttacattggatttctcacatattctactacttaactcaagatgttgagtaaataaatgagttaataaactggaatttctatatca

SEQ ID NO: 223187 - DNA, 466 bp, Homo sapiens
gttttgttttatagattcctctggattttctacataaacaatcatgtcatctgcaatgggaacagtttcatttcttcctctacgatctatctgctttttttcctccttgcctcatcacagtagctagaacatccagtactgtgtgaaataacagtggtgatgcaaatatcttttccttgttcccaaactcagagggaaaacattcagtctttcaccattaagtatagtattagctatagggtttttgcagattttttttagcgaattgagggagttcctctctgctcctagtttgcttaggttttgcttcttatgaattgttattggattttgtcaaaagctttttctgcatcaattgatataattatatttttcttctttaacctgttgatatggtagattgtattgatttatttttaaatattggaccagccttatatacctggaataaatcctacttgatcat

SEQ ID NO: 223188 - DNA, 461 bp, Homo sapiens
cggatcccttgacggaaggggagattggctccagcctcagagagggctgcagaaccctggatggatgggaagtctggagtctccaggattcatggatgggaaaccctacttggctgtgcttcctgctaacacgaggccctgcgattgctgagaacaacagccccgagactgcgcggctccgggggaaaaaaacctggccccctttcaagccttgacagaaaacctttcagagccctgaactcccaccagcccgaggacggctccgatagctctgacaaatgagccgggactgtgcccagggctcccaggctgggaggggaccccggctcccttgttccttcctaaggtcggaaaaaaaagcgcgtgtcccttcctccaccacagaggaacagagaagtgtttgcattggtggatttttaaatacttgtttatttttattaaagtgcaattcacatgaaatt

SEQ ID NO: 223189 - DNA, 495 bp, Homo sapiens
agaaatttcaactatagtcaaactatgcaactgacatgacccattacagactgtgaagaataacttcaatttgtacccaaatcaaggaaagcggtgagatttgacaaacatttcctccaaatagtcactccgtgccatttttagtgagtaaacgagatgttcctgaaggcccagaagcaatttgaaatgtgaagaaataagaactgggacctaggtgcaccacggaaaaattaagaaatacaccctggggttcattttcagacgttaaggaaggtaggactgaagaagagaagatgtatcttgcatttttatttattttcaggactcagtttgctgacccatgactgaaaattgggaagtgaagggaggctgaagggttaacagtgacctgcaaggcagacctgcaaccgttgaccaaagtaaactgagcagagtaaataagcactagaagattaaaatcctatgacaggccagacctcctgacactctcaaact

SEQ ID NO: 223190 - DNA, 506 bp, Homo sapiens
cctccaactcctgggctcaagccaaccttccacttcagccaatcaagtagctaggactcccggcatgtgccaccatgcccagataatttttggagtttttttgagacagggtctcactcttgtcacccaggctggagtgcagtggcatgatcttagctcactgcaacccatgcctcccaagctcaaaaaatcctcccatctcagcctcctgagtagctgaaactacagacacatgtcaccatgcctggctaatttttttttttcttttttactggtagagacggggtttcaccatgttgcccaggctggtcttaaactcctgggctcaagtgatccacctgtctcagcctcccaaagtgctgggattacaggtgtgagccatcacacccagccttttcaaatattttgtagagatggggtctcacttcgttgcccaggctgctctcaaactcctgacttcaggtgatactcctacctatatccccctttatactaataatcttata

SEQ ID NO: 223191 - DNA, 414 bp, Homo sapiens
ttttttaaccgactgtcgctctattgccaggctggagtgcagtggcgcgatctcggctcactgcaatctccgcctcccaggttcaagcaattctcctgcctcagcctcctgagtagctgggactacaggtgcaagctgccacacctggctaaattttttagtatttttagtagagatggggtttcaccacgttggccaggaaggtctcgatctcttgacctcatgatctgcccaccttggcctcccaaagtgctgggattaaaggcgcgcccggccaagaatctccatttttaacacactgctggtgattccaatcaggcaagttaaagatataacggtatacaataaagacgaggaaatgaacgtaaatataattatttcaagttagcatcagttgtaaagttgtttcaagaa

SEQ ID NO: 223192 - DNA, 761 bp, Homo sapiens
agagaaaggctaagaggtaacatatataggaaagaggaaagtatagctcaagcataggaaaagtaatcaatagaaactatccataagaaaactcaggtgttggactaactagataaagactttaaatcagctgttataaatatgttccaagaactaaaggaaattatatctaaagaatagaaggacagacataggaatgatgtctaaccaaatagaaaacatcaatagaggtataaattatttaaaaagtgtgaagaaaaatgaagagaatctaaaaagctccatggggtaccatcaagggcaccaacatacacatgatcatagttctaaaaggagatgagggagagaaggggacggaaagaatatttaaagaaataattccagcaaattccaaaatttgatggaaaacaattatacacatcaaacaagttcaatgaactccaagtaggataaactcagcgatccatccctagaaagaccataatcaatctgttgaagacatctttttttttaaaaaaaaagatgcatcacaaataaagtaatcctcaataaaactaatagctgatttctcattataaaccatggagacttcaggcagtgggatggcatactcaaagcgtagaaagaaaatgactgtcaaacaacaattgcatatccagcaaagttatcctccaaaagtgaaggaaaattaagacattcccagataaacagatatggagaggattaatcactagcagacctgctctatgagatatgataaa

SEQ ID NO: 223193 - DNA, 603 bp, Homo sapiens
atctgattcagctgaaaaacaatgcaggtcagtcaagcaagtgacaaggaaataggctgactggtttgaatgaggaaagggtgtcttttctctactctggactattggatgggaaacaacatacatattgcccaatgaaactcttttgccatattttagtttctctaaaagagaacactgtgcaattagtagggcaaactttattattattcttaaaaatcatatatattgaaaaccagcctattggattagtgcctcaccctcatggcctcatttaatcttaattccctccttatggaccctgtctccaaatgtagtcactctaagggtttgggcttcagcatatgaattttgggggaacactattcagttcataacactgctaataagcaagaagctcagaattttagcccaagtagtcacattactagtagatactctctcaacctctagtctctggtgcatcactgagagtagacgagcaaaatgtacccactgtggaatgtcaggagtatatcataagatcaggattttcactgcagtagtagaacaaacaaaagtaatgttaaaattgaggggaatatgtttttagattagccattt

SEQ ID NO: 223194 - DNA, 631 bp, Homo sapiens
atattatagatatataatagatatagatatatataatatagatatagatataatatatatacactcaccctaccactttatacatgtaaatatatatattatacatatatttacctagataaacatttaccttttttaataagaacatttaatgcctagttcaccagctgtgtgacctctggtaagttattcaaccttgctacacatcattaggactattgtgagaatcatgagatgtaattgtacaaatatatactcgataactattagctataataatattttgttttaggggtagagtttgggcaggtataaaacactataacaagctgataagaacctatgttgtaagatgtgcaccttcctgtgtttgttggtattctaataccaaggaagctgttcctactgagacagaaagtcaagaaacttacatcctaatcttacctctactggaaattcacttaatctctctggatcagttatttgctactgattctcagttttcccatttgtaatgagggttggggatgttagtaccagtctctttttggggtgttgtgaggtgaagtgagctaaacggaattagagcccttaggaaaaaaaaatgctaatattaactgaaggaagctgg

SEQ ID NO: 223195 - DNA, 290 bp, Homo sapiens
ccggcccacatctcatctgctaggaacactgaatctggtaccacagcttcttctagttgcctttatatctggtgagtagagttaggctatcacaattgtttctaaaccttctttgtgtcattgctcaccacttaaatcagcaacagaaagatagcttccattatcacttctgctttacaaatctcataagaggctgtctaactagcagaaccttgtttgcatttccaatactaactgtaaaggaaagtctgggaaatgtagcttttttttttttttttggttggggggac

SEQ ID NO: 223196 - DNA, 483 bp, Homo sapiens
ttctgatattcaataattgtttaagtgaattgtggtatatacataccttggaaaaccatgcaaccatcaagatactctgatatattaaatgaataaattacattataaagtagtaagtaccgcatgatctcatttttgttaaaaatgtttgtatatatacatacaaaatagaccagtaggaaatatattttagaaaagtggaattataagtgatttctattttcttcctttccatgtttatattttctaaatttttattttattttattttattttatttttgagacgaagtcttgctctgttgcccaggctggagtacagtggcacaatctcagctcactacaacctctgcctccctggttcaagcaattcttctgtctcagcctcccaagtagctgggactataggcgcatgccaccacacctggctcatttttgtatttttagtagagatggggtttcatcatgttgtccaggctggtct

SEQ ID NO: 223197 - DNA, 421 bp, Homo sapiens
ggtcatttttatgaatatcagtgtgctgtatttgtaacatggtgatacctccaagtgctgtgaagtattcgcatgtttgtttgtttgtttgttttgagacggagtcttgctctgtcgcccaggtggagtgcagtggcgcgatctcggctcactgcaagctccgcctcccgggttcacgccattctcctgcctcagcctccagagtagctgggactacaggtgcccgccaccacgctcggctaatttttttgtatttttagtagagatggggtttcaccgtgttagccgggatggtcccgatctcctgacctcgtgatccacccgtctcagcctcccaaagtgctaggattacaggcgtgagccaccgcgcctggccacatgttcgtttttatagtcattagtcatatcttcaattcacgca

SEQ ID NO: 223198 - DNA, 626 bp, Homo sapiens
tctctgctcaaaaccctgcaacctttcatcatttcaccagaataaaagcaagtccttacaacgggctgcaagtccccatatgatccactcctccccacatacccgttacctctttgacctgatctggtactatcctccctcactcactctgccccagccacagtggccttcttgctctttttcaaacagaccaggcatggtcttggccttagagtctttgcacagacaattccctttactaggtgtcaccatagctaccatcttcatctccttcaaatgttgctttggcattgaggcttaccctcacttccttatttaaaattacaaccagctgggcgtgggtggctcacatctgtaatccccagcaattcttggaggccaaggtgggcagatcccttgagctcaggagttagagaccagcctgggcaacatggcaaaaccccgtctctgtaaaaaatacagaaaaagcttagctgggtaatggtggcacacacctgtagtcccagctatttgggaggctgagacgggagaatcgcttgagcccaggagatcccagctgcggtgagtcaagatcgcaccactgcattaccaggctgggtgacaaagcgggaccctgtatcaaaaaa

SEQ ID NO: 223199 - DNA, 449 bp, Homo sapiens
ctaaataggtagtagtaaagctactctattaaattacacagtcacatgcaatgtatttatacaaataaacataccatatatttctatctcccagactcagaattgacagacactattttggcttctttaattaaaaaaaaaacactaatatttgaattactagcaatgtcatattataatatgaactcaaattgtacactttggccagggtcaccaaaatgaataatttcaaacaccaacaatgacccagcaattcatcctcaagggaaacatgtgtctgcacaaaaacttaaacatgaatatttatagaagcattattcatcatagccaaggagttggaacaacccaactgtgtaatgtggtatgtccatacagtgaaatactatttgacaataaaaatgaataaagctctaatacgtggcaaactgtagaaaaactgcaacagtcat

SEQ ID NO: 223200 - DNA, 332 bp, Homo sapiens
tcatgcccttctcccccatccttttccttctgctttccttcacccatagaaagtaccttggaatagtatagtcagtccttgcatgtgcacaagctatcatttcagtaaaggtatacatggagtaaaaatcatatgaaggatcagattcaacttatattttctattttttcttcttcctctcccttcccccaccttctgctgggcagaattatatcttaatcaaatgtgtatcctgtgtcacatatggaaatgtgcaacatatggtatttgttaatgtttgttaattacatttgcttttttattgcagagcaaaaataaaattagaagcaata

SEQ ID NO: 223201 - DNA, 239 bp, Homo sapiens
aagagggagctaagcctggagagctgggttaagtcagacagacccaaaatctcttacactgagtctcaacttattgtcccttgtgactccaaggtcaacttcccttccctgttggctgaggatccaggtgtggagccagtcagccaagatgggccctggagggcctctcctcacccagggaaggggagtggtttaaggagtttggctgtataatcaatcagacctgagttcaagtcctt

SEQ ID NO: 223202 - DNA, 306 bp, Homo sapiens
cctttcctgatttctgctcctcacccacgaccacttgaccactcctcctgtttctcactcacggcacccctatgcacatacctatgaccacagctatcggaagggctagtgttgcctcaggattaagctgtgcaaccttgggcaagttacctctgtgtatcttggtttttgcattttaaatggcagtaataatagggtggtgaggagtgagtgtgaaggacttagaacactataggacaaggtaactatttagtaaatatggcagtcctgtgtaggacagactctctttgactccctaggatttac

SEQ ID NO: 223203 - DNA, 541 bp, Homo sapiens
ggctaaccatgcaaaggtcagaaggtagagtcttgccagaaggtacagcaaggactagaaagaacttgcatgttgtagaaaccaaaagatagccagtgcggctgaaacatgtggcaaagagtggaaagagattaggctgggtgttctaagacactttctgtttttagtgtggatattgagatgtaggtgatcacttctacctgtttcgtactcttcataaaggttcttccattacagaatctctaagactctatatacttatgtacctgccctacccagcaatttggcaagagtacaaaggaaataaggtatcccaatttatctaatgaatgagatcctttcctcttccatgcacttgtgccttttgttccctgtactaacacttacttatataatgctatattctggagtaatggttacaagtactgtttagtgctctgtgcattctcatttgtcctccaacagtaggtactactatcctcatttatggatgggaagattgaggctccgagaggttaaggatcatgctctagagggatgg

SEQ ID NO: 223204 - DNA, 486 bp, Homo sapiens
cttttagatgcgattgtaaatggaattgctttcttaatttcattttctgattgttcgttgctggtacagtagtcccttcttatccacagtattgccttacgtggttttacttacctgcgtcacccgtggtccaaaaatattgaatggaagattatataaataaacatttcatgagttttaaattgcaaacaggtctgaataacatgataaaaatctcacggcctcctgctccgtcctacccaggacacgaatcatccctttgtccaacatattcatgctgtatgtgctccccacccgctagttacatactagccatctcagttatcagatcagttgttggagtattgcagtgcttgtgttcaagtaacctttattttatttaaaatggcaccaaagagcaagaatagtgatgctggcagttcacatatgccagagagaagccatatagtgcttcctttaagtgaagaggtgagtttttgacttagg

SEQ ID NO: 223205 - DNA, 442 bp, Homo sapiens
tctatcagactaactggggatttttaaaaatacatatagcaaaaatattacaggtcaggagacaatagaatgatatattcaaagtgattaaaaaaaaaactgtcaacccagaatacaatacccagcaaagttgtccttcataaatgaaagaaaaataaaatctttcccaaacaagcagaaactgagggaattcatcactgctagaccagacctacaagaaatgatcaagggcattctatacctggaaacaaaagaatgatatctaccatcatgaaaacacatgaaagtataaaactcactggtaaagcaaacccacaaataaggaagagaaagaacccaaatgttatcactacagagaaacaccaaaccacaatgataaacaacaaaagagaaagaaagaaaggaaaaaagaaaggaaaaagatagaaaacaaccagaagat

SEQ ID NO: 223206 - DNA, 391 bp, Homo sapiens
tgtttatcattccctttcccctttcagaggacattttcacagagattcatgaaataaaagtttggttaatgacagaagtgggaaaccttagtaggatggaagaaaagaaagaaagactgaggcttttgtgccatggtaagatggtaaaacaataaaaataacatctgcattttattgagaacatactctgtgtgtacaggcactgtgtttaagccgtttccatgcaacaagcttaatagttggagaatcttgctcataagcacctaccctgcacagccagaaccactatggataacttcgacaaacatctcctgagatttttgagaattcccgtttgcaaagtctgctgaagttgttcccataaactgcaataaagtgtaatttcacgaga

SEQ ID NO: 223207 - DNA, 406 bp, Homo sapiens
gtcccctctggtttggcatgccaagagcagcttgcctatggcccagctgtggtgtctgggagccctgattcccagaagcccacatgagcctgtgtcagccgagcacacgtgtgacattcatgtttaagaggaagcatggtctttaaaaatgtctaggtacaaagaagagccacccatgggttctgctggcacaggaagcacagggtctttattagttctaatgttctaagataaacagggcagtaagaagcagttgccagcactgtgacatcggaaacatcacctccatcctcagcacctcggttcccacatcgatgcaaacttagcagtaaggtctaaccagcccccctttctaagaatgttgtgagattagaggaggctcaggaagctgagagtgaaattcata

SEQ ID NO: 223208 - DNA, 406 bp, Homo sapiens
cctcagaggattctaccctgaatcacaccctcgcttggcttcttgcctttccctgttctacttcttgccacgctgtaagcagtttttcttggaagcccttccttaagaaacccccgcttgtttgtctgggcgctatggctcatgcctataatcccagcactttgggaggctgaggcaggcagatcacctgaggtcaggagttctagaccagcctggccagcatggcaaaatgctgtctgtactaaaaatagaaaaattagctgggcgtggtagcaggcacctgtaatcccaaccactagggtggctgaggtaggagaattgcttgaacccaggggttggagattgtagtgagctgagatcttgcccactgcactccagcctgggcgacagagcaacactctgtctc

SEQ ID NO: 223209 - DNA, 205 bp, Homo sapiens
gtgttgtttttgcttagcattatgtctgtaaaatttgtctatattgttagctgcagtttgtcattctcattctcattgctgtgtggttctctgttgtttaaaagtaccagtggtaaaattatcatttatgtggtttatctctgatggacattagaggtatggtggtaccactgataggcaccaaaatcaagtttaataaccactg

SEQ ID NO: 223210 - DNA, 297 bp, Homo sapiens
cactccctctcactcttccatcctcatccccacctccgccccagctccatggtccagagagatttcacgcttgcagaggcatcagcacggctgccttgaaggacaggctgcagcccgtggtttgagatcaggccttttctctgtggggtgttcagggcctacagggccttattcatccacaacggtggccttagcctcctttatctgagggccccagagtccccttgaaaggtaagctcctgcagaccgtttgcaatcaccactaggtggcgcctcagccaaagggaggagcggccg

SEQ ID NO: 223211 - DNA, 515 bp, Homo sapiens
agtccttgctgagagcttttaggagggagtactctctaatgaataatactaataaaaataataacaataatagatccttactatgccagacctattctaagacttttgcatttagttctcacaaaaaatcctaatattactattcagtttttacttatctttctttccttttattatcttatcctgtatctatatgcaagtagtttgttggtcagcattgaacaaactatttttggtccccaaaacactttgctcacccaagagtcttcttttagtcacagaccactctgaactactgaatctagtttcatcgtcatgttatagttagggctgaagaattcctatgtagtctactcactaaggggtgtcctacctctccttccaaattgctgccttcactgcaatttctggttaggttttcagcagcttcctctgatcagcctcctttttcctgctcccaccaagaagaactcttcccattccagacacagccttgtgttttactgactgcaaga

SEQ ID NO: 223212 - DNA, 298 bp, Homo sapiens
tctccctccctccctccctccctcctctctctctctccctcttgaaagggtaaatattgattggctggctttacattttatgctccatgccatatttccttccctccctcacttcatcgttgatttttctcttgccctcctgtgatgtttgagtgtagtaaaaccataataagccatttttggaaaggcggtggttacactctttattaaaaactgacatctgttgggagagcaattagaggcatcagaaggcggggttgttgcatgtgatttgggggaataaaactttggaaaatta

SEQ ID NO: 223213 - DNA, 329 bp, Homo sapiens
tgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagct

SEQ ID NO: 223214 - DNA, 541 bp, Homo sapiens
gtctacatgatgtttggtgaacattcttgggttatttgtggttaacggaagtaaattctgtcttcacagcatttgtcccaaagtttgggacctaaaatttatccatctattcatccatccactttttaaatatatgtggttaataatacattttaggctgggtttggggctcccgcctgtaatcccagcactttgggaagctgaggaaggtggatcacatgaggtcaggggttcgagaccagcctggccaacatggtgaaaccctgtctctactaaaaatacaaaaaattagccgggtgtggtggtgggagcctgtaatcccagctacttgggaggctgaggcagtaaaattgcttgaaccgggaaagcagaggttgcagtgagtcgagatcgcgccactgcacccaacagcctgggtgacagagcgtgactctgtcttaaaaaataaataggctgggtgcagtggctcacgcctgtgatcccagcactttgggaggctgaggcgggcagatcacgaagtcaggagatcgagaccatcctg

SEQ ID NO: 223215 - DNA, 478 bp, Homo sapiens
accccggaaaatgcccggcggctttccgcgcctttttcctgtggggttccaacgcgacccccggcccaggttttcaaccttgtacagatatacagatttccctgctgaaatcttgaagatcaccttttcttcattgtttgggactaggtcctaaatcgaaaaatcgcggtcttgggttccaaaagaatttggatttggttcattgagagggaaaattgcctgtccagtgatctccgaagccattcacaaagctgcgtgagtagccagtgaacacgagaaaaatgctcaaccagcctcatacctaagtaatgcctgtggtgcgagcgccacggcccgcgcctggagttccatctactcccgaggcctaggcaggaggatcgctggagcccaggagtttgagaccagcctgggcaacatagcaagaccttgtctccaaaaaaaaaatttttttaataaagaaatgcctgttacaatgaca

SEQ ID NO: 223216 - DNA, 518 bp, Homo sapiens
ctgtgctcccattttacagctgagggcaagggcactgtgaggtgagggagaatctggcccatctgcagcccaggcccccgggggcgcgcgccgctctttaggaaggagcagctttgtttcccaccagccctgcactgtggcgagcgggccggggctgccgggcgacgcccggtcgccgtcgccgccgccgccagtgatccatagcgtgagcaggacgaccagcgccccggtgcccagcgcccccacgaagccggtgaggaggccgagcgccagcggccccgcccaacccatggggctccgctcgtacaggggctgcggcaggcgctccacgatcagctgcagggcgtcccagtccggcgcggggaccgcggcgcgccgggggcgcggggccggggcaaagggcacgcgggcggcggcgccgggccgcggcaggaagcgctgcccgaacttgcgcagctgcagcgtcgcctgctggtggaggttcttgcccagctccctggccacgtccgggcggccgc

SEQ ID NO: 223217 - DNA, 441 bp, Homo sapiens
ccacaacctttttctatcgcactcctcctccccctgaccaagcaaccctgacatctaaacctgtcctttgatgccacccagcccggaaggagatggctggagtctagaaacctagtgcaagattaaaatctgctctgccacaggtttatactgtgatcttggggaagccactctctccctctgggcctcagcttccccacatgtcagaagggggatgggataggatgattgctgaaagccctcccaactctgacccatttaacttaagttagatagtcatgagttcaaatctgacctctgaaagtcactagctgtgtaccattgggcaaaccacttcacctctctgagctttaatttggtcatctataaaacagagaaaataatatacttcatagagtaattgggagataaagtatataaagcattaaaattgtacatagc

SEQ ID NO: 223218 - DNA, 725 bp, Homo sapiens
tgtgtacttcccattttgttacacacactaatattgaaagaacatgcattcaaaaggggagttttcataaaatgaataattttatcgcttcatcaagaatattcttaaactagcatttaattttttttttttaacttcaagcacgtggtagtgaagaatacaatcatatcagtacagtttgtttccatggccttcgggtccataagttttacccaccactgtttttgcaccatcatcgtaaatgtcaacatagtaaaaaagtcaagtaacatctcaatattatgataaaaatagttttgacctcatggacaccttgaaatggtctctgggccctgaggggtctatttactgtgttaagaaacactgatataagtctagccgattcaagtaaatttaaagaattagaaaataacaaactcctaagacaggggtaaagttttgttttgatattccctatcacagtgctacttacaaataggtactaaaacatattcttttctgcttagtgataaaaattggtaattattatataaaatatcactaaaatgatcagtttatttcacaaatctaaggtactactaacactgcaataaccaaaatagatgtaaaaataactaataagctagaatacaatcacgctcatgcctagtatccagaaggtcaacaataaaaaagacaacttaaggaataaatccttaaccatcataacctcagaaacgatactg

SEQ ID NO: 223219 - DNA, 476 bp, Homo sapiens
aaattttgtccaagttatcaattttatctaatggaatttaactaaattagaaagaaacctaagtccttcagtcactaacccatagatttaatacttgggactcagacatatgaacattgttgttcttgatggccatattttctgggtcatctcccagaaatagcatattcttatgctaatttgagtgctactaaacccagaagggcccacattcaccccacccctcattcccccatggttcagtaggcctcaagtctcaattttccaattatctaataaattgaaggcttccattgggagtaggatgaggatggaatcttaaggaaattgaaagtgccatttcagagtcaatatagttttagtaggttttagggatgaacctggtacctaaccactaaatataaggcttttaaaggaatctatgtccatgtccctaaaaaaacaatttaaaacccagtctctactgaaaatagtaa

SEQ ID NO: 223220 - DNA, 472 bp, Homo sapiens
ttctcctggtgcatttataacaggtttctttaaaatgtgcactttcccgagagtatcaggaaacaatttttgttaaaaaattaaaaagaaaaaagtccctgccggaaaccttgtcatatttggagactcaatcgtagagaaagaataaggagaaacatgtttaattggatgagtattttctactttagtgggaagtttttctctacttaactaacacttcgtttcccagcgtgatgaccactagcactccccatcccgtcctctctggccctcaggccctggggtagccccatggcctgtctttccagaaattatggaatttgaagagaacctggggtcatggaagatgagggacttcaccggggcaggctgtgcttgcatccaggttgtaatagctgttagctttgtactttggacacagatgtaattatctaacatatgcaacagactttcaaaagtactacttacacca

SEQ ID NO: 223221 - DNA, 669 bp, Homo sapiens
gctgcagtgagccaagattgtgccactacacttcagcctgggcaacagagtgagactctgtctaaaaaaaaaaaaaaaacactaagcatgtagtttctatataactagaagcataggatattctgatctgcaatccatcaatcagtgccaattatgcacttacagatctatagtcaaaaggcctaatttattgctatggactaaattgagtccctttataaatttatatgttgaagccttaaccccaaagtgatagtatgtgtatatggggcctttgagaagtgattaagcctagatgaggtcataaggatggagccctcatgatggtactagtgaccttataagaaaagacacttagtgggcttgctccctccccacacacaccatgtaaggacacagtgagagggtggctatctacaagtcaggaagacagtcctcagcagaatcctacagtgctaacaccctgatctcggacttccattctcaatctataagaaaataaatctctgttatttaaggcactcagtccttgtatttttgttatggtgatccagactgtataatacattcattttttaaaaaatgtactaaatactccccaaagtgagaggtattgctttgggtgctattttcagaaatgtggagtaagatttggaggtggatagggaa

SEQ ID NO: 223222 - DNA, 333 bp, Homo sapiens
aaaggaatgaatgagggggatgggggaactgcaagactaagtgaaggagtttggattttattctgagtgtgaaaaccctttggaaagttttaggccaggagggacatgatccccaagcaccggtctctgtgatcagaggatgtgggggtgtgaccaagggcaggtggtcagcagaaaacttcaggttctgtctctttcaaccctaattcctggtctggtgcagtggcatatgcctgtagtcccagcattttgggaagccaaggcaggcagattgcttgagcttaggagtttgagaccagcctgggccacatggtgaacctcgtctctacaaaa

SEQ ID NO: 223223 - DNA, 334 bp, Homo sapiens
tcaatattatttggctgttttctcagtctcatgtctttctgacgctccacttacacacacaatgtttgatgttgtctatcagttgacatctgctcttttctgtttgtctacttttttacttacaaatttggtgtcagtttggatattttttatggacctatgccaaaggttacacaagcacacacccacagtttgctttttaagtttcctgttgagtaattctaacaaatatgtcattttaataacataattttatttctggtttaaaaataactatttaataaataatatataaattcataattatacataataaaaaattttggtgccgcat

SEQ ID NO: 223224 - DNA, 565 bp, Homo sapiens
acagacaaacccagtcgaatttacagatgcttgtggaaaggttagagaatttgaaagaaataaaaaagagttgggagtgaatatgtgtgtcttactgcttcggttttgtttcctagcatttattggttcaaatagatttgttgctttgctgactctctgctatcttcataaaagataagaaaacctctcagcgtccctctatagtgtgagaaacatgatttataataacattatttcataattgaaagtattgtttcgttgtctgggaaaatgagcgcatcagaattaacttgtagttttagaggccagtgggttgctataacaaccagaaaaacaatggtgtaataacacctctccctgaaagctggagaactcactaaatgacgagagctacagatgcaagcgtttgtcatatgaattcaaacaagaaccaaatacattcatttatttctttcatgagcactgactccatgcctggcactatgctaggaactggtgaaatagacgtggtccctcctgtgatggagtgaacaatctaatggagaagaccgataataaacagttt

SEQ ID NO: 223225 - DNA, 843 bp, Homo sapiens
gcaggttttctttcctttgttctaccacagttctctgatgtggaaagttccagatgagaggaggatctggggctttgtgcaagagtatgtcgggaattgcagtggggagcagctgtaaggagagaattccttgggtcagcagactgaggtagcagtttcaggtaacccttactcataaggaaaacaatgtttaccctttctttgtacaattcaagttggatcatattattcctctgctgaaaactatttagagaccttccatttcagtctgaatcaaaaccaccatcctcactgtggccaacacagcccaaaagattggcatctccatttcttcccagactttcctctcactaccttcctggttgctccttcggctccagccacgctgcctccttgctgttaggcacactccaagcccggtcctacctcagggccatccatctccctcctctgcctagccactcttgcccctgattttcttgcccacatgtcacccctcagtgaggcctcagcttcttctccagaggtgtagggccccagcactgcctgttatctttccccacttgacttgcatctctgggctctgttacctccatttgtgaaatggggttcatagttcctgcctttaggattattgaggggattagatgaatgaatacatgtaaagtacttagcataacgccagacacaaaattagccctcagtccatcagatgtcactgtctcagtgctgctgctttgggaaacgtcatgggatgctttatgtttctatggtgttgctgctgtggtcccagagggacacttaacattagatcctggccttattttcctttcctgcctcttt

SEQ ID NO: 223226 - DNA, 542 bp, Homo sapiens
attagatgccattttagttgagcctcaccataggtgctgtggtatgaagtgaagtatgtgggctatagagacgacctaggttcaggcctgccacctactgcctctgattagccatatagttttaatcctcttttagctttagcatcttcatctttggaaatgttacttacctgttagcaccattgaccactgtgaagatttaaaatggaatgtgttatgtatctcctatttttaaggctatttgtagtaaatatgttaagtgtgggctaatctttgagtttagggagaccccattaatataaattttttttttttttttttttttgagccggagtcttgctttgttacccaggcgggagtgcagtggcgcgatcttggttcattgcaagctccacctcccaggttcatgccattctcctgcctcaacctcccgagtagctgggactacaggtgcccgccaccatgcctggctaatttttttatagtttttagtagagatgggttttcaccgtattagccaggatctttggtgccttctttgc

SEQ ID NO: 223227 - DNA, 734 bp, Homo sapiens
aatgtatcctaaatgaaaaaagcaaaatgatatatgggtgaacatgtttgttgcatttgtctataatggcaaatcttggaaacaaactaattgtgcaataatgagagaatataaattgtgttacacgaacatgagaatataaagtagccataaaatgttaggtaggaagacatgggaaattcctaacaggatattaagaattcacaccactgaaatgctatgaagggattacacaatttaaattttcattttctttgtgtagtgacattaagggtaattttttaaattaaattttgtccttgacagttattttgtcttttcaattactcccaatctcttgaagaaacaacttaatcttttatctaactgtggtattgtctatcatcagtatgtaatgatagtgactattatagtgacctaaatatgtataatgtgcatgtaaatatgtaaataatatatactatatgtgtgtatatataatggtaacatgtatatatattatatatacacacaaagtattggttcatcatttattttatagctattataaagcatttgctatgacctaaaaggccacataatattcttatttaagattttattacgagctgtagagccagatagttctcttttgtttcagtctagttccgtaaccacctattttggctgcctctttggaaaaccaatgtaaagttacaattatgcagaagacacttgggacagtcgttgagagc

SEQ ID NO: 223228 - DNA, 498 bp, Homo sapiens
tatttgttgtttctttttttctttttcaaatgtgtatgtgtgtgtgtgtgtgtgtgtgtgtatatatatatacacacacacatatatatttgagacagggtttccatatgttgcccaggctggtcttcaacttctgggctcaagtgatcctcccacctgggcctcccaaagtgttgggattgcaggtgtgaaccaccactcccagcctgttgtttcttaagcttctaaccaccaatctcccctttcactctacacgtgccctaactaatctcagctactcctgagcttcaacttctacctgcacactgataatctcagtctgtctctctcttgcttgcctatttctcctgaaggccagtccagtacatccaaaaacttactgaaaatttccaccgggattatctaaaagcaccctaaacatctaaaatggaatctgttatctttgttacatcataatctcacaaattcttctaaatttcctattcacaaatagcagca

SEQ ID NO: 223229 - DNA, 1017 bp, Homo sapiens
aatagtatataaatgtataaagatcaatttctgtatattctaataggaattgtatataagcaaaaatgaattttagaaattatcctattattcatgtaattatgtcattcatgttatttaaaggaaaccacaatgcagacaggttaagtacctagtgtgaaggtatgtaaccaattaatggagctgtgcgacatacatctgagtaataaagactacagagaaagtatcttgttaggtactatctgatacaaagtttagaaacatgtcaaacaattctatgtatagttggtgaaagtgtaataacatggctgagacttaataccagatgaagttcagtggtttcagggggaggaaataatttttaaaacgatgtcgataacacttcacatttaaaatcatcataataattctaattctagaattgtgtctaattctaatactgtttctagctttgcttgaataaacagaaatgtagtagggaagagacagaatgtttagcttgcagtatctaattactcatttgggtatctgggaagatagctctccatggccccactgtcactgacctataatgcttctcctgacgtcttcggtaaaatccaacagattacaaagaaactggaatgccttgaagaaatagagctttttgtgtgatgtcagattcaatagacctctaatccttagtaaaacagtacaaaacagtagaataatttttagtgttttctaatatcaactgaggttttatttgggagattaaccagaggtttgcacaaaaacaaaagtgaagaccattagtctttaaagaaactaagactctaggtttggatcccatttgtggagccctacattccaagtcatctaatgttcttgtctagttagcttgtaaaagtctatacaatggaggaaaaccccttttttccccttagtataagtgtattatatgttgatagaaaggatagaaagttaaataacagttcaataaatgtacttctaaatgaaatttaaaagtactttaaa

SEQ ID NO: 223230 - DNA, 617 bp, Homo sapiens
ctaccagttgcctcactcctcctccattttcacatcctttaaaaaggcaggggttttattgtggtggttgtttttgccttttgcctggtcaagtaatctgtctcagagaccagaaatcacctttcctagtagttacattctcctcctccatacaggtaagcattcagctccttagtagaggagcctgaatttttttttgttttgttttgctgtagttgcttgttgtgatttttcaaattaggaaaatgttttcatgtgttctgatgaaactgtattgtgaaacacattgtatttaacataccaagtagtagtaagaataaaggacaactaaaaagcttgaaaatatggatttcagggtctcagtcccagaaagtcgaactgtgtgggtgtgggacaagcaccaggaatctgtaactgagtgcacgtggttttcaccacagtaaaatacgttgatgtacggtaatcaactcacaatattgacctcctaggatatcacctcctaaaggatacagcttttgttacaaaataacatgatatatcagcattaagtataaaggataaatgtattcaatcttaaaaatccacaatatcccatattctaagtcacatacttcaca

SEQ ID NO: 223231 - DNA, 417 bp, Homo sapiens
aacatcctggcttggcaaataatgtatttgatgatgctcacgatggcaaatttgggaacttggaaaggggacatgccttgatttcctctgactctgtaatgagccagcccctttcagctgcccctgggaacagtcaacgattaagtgccaggaagacaaggcacgaagaaccgggaagctatgggaagtagagcgccggcatctgtgcatgtagagggaaggaactcaactctacacccccagcaggcctctaagcccagggatgtgggtctacctgcatgtcccctcctggagggccagccccgccaagcatgacacaaccctctgcctcggatgttgctcctggggttcccctgcttaatggcacagcctgaaactttgtgctccttctacagcgtccccgccccagagtggaag

SEQ ID NO: 223232 - DNA, 674 bp, Homo sapiens
caattcaagatgagatttgggtggggacacagcgaaaccatatcaaaaaataactatctttttaaaaaataaggtgacaaaagtacctcccatgcccagatgtttgggggctgtcgtgtgagcctctggaaccataaatactcagcagcagtgctgcgcggccctcactggggacactttggccctgccggagaagggcctgaactgcacacacagcccatacattcagctcctctcacctgatctaaagatggcaaggaagacaaaaatagcctaccgagaaaattgcccttggctgattttaaaggaaaacgcctgtaactgctcagaaagcatagtgtacatatttttatatataaatcccccaccttaatacatatgtgcaaacatatcctgtgtacagtagctttcagtaagaatttaagtataatttatagtactatttaattttattgcctatttttgactgtttatagattaattaagtttatatgatgggaccccactcactgtttaggaatataacattcatttcattgaagtttatcatttattcagatgtagcaccattgacatgaatctgatcttcttaattaccagagatattccaggtggtttcgtatataatcacaatcagctgtctgttatctaggggcaggttgtcctctctgagg

SEQ ID NO: 223233 - DNA, 518 bp, Homo sapiens
tatggcgatggtgacaaggacgttgactctctacttgggattcaagaagcctggtcacatctggaaaggtaggtcctgtccaggttgacaatctaggaagggaagaggagttcatgcttcatgtggtacacctccaactctcctctgaaggaaagaagtaaattgttataacaaagaacaccagcgaagtcttgtcaacatcactttctgatggcaaagcccggtaaagttgaatacatggtaccttccaatattaatggctacaattgacagagcaattactatgacccagctataacagagatgcacacatattgactcactgtaccctcacacacaatctctgcaaggtagatgccatcatcatcccaattttaagatgaaggacatgaggtgcaggtaggaagtggcagtgctggcatttgaaccttggtaatatatctcaagtctctgtgctctgcatcactggactatgttgacctttatatttgttactaaattttatctcaattggtaaa

SEQ ID NO: 223234 - DNA, 441 bp, Homo sapiens
ctttagattcaaagacacaaataatagagtgaaagtgaaaagatataccatgcaatcaagaatcacaagagagcaggaatagctatatgaacaacagtcaacatggcctttttccccaagttcttcctgcatacatttaactcagcatagactttaatagtagtattaatattagaaacataaaggaacattttatgatgataatggctatatcaatacattatgaagatttagccattataaatatatacactgctaacattagtctcaaaaacagaattgaaaggaaaaatatacaattgaaaatccatgataggcccagtacagtggctcaacgcctgtaatccccgcactttgggaggccgaggcaggcagatcacttgaggtgaggagttcgagaccagcctagccaacataatgaaatgctgtctctactaaaaa

SEQ ID NO: 223235 - DNA, 360 bp, Homo sapiens
gaagagaacagcagatgcaaaggccctgtggcagaaacaatcttggtatgctggaggaataggaaggcagccagtgcagctggagcaggataggttaagggaggatcaaggtgatgagggcctggaaagaggggctggggtcgaatcaccagatcctgttggttgcaatggaagagcctggagtttattctcagagcagtgagaagccactggaaagttgtttttttgtttttctgtttttgagacagagtctagctctgtcacccaggcagactgcagtggtgcaatcttggctcactgcaacctctgcctcccaggttcaagcgattctcccgcctcaggctccccagtagctgggat

SEQ ID NO: 223236 - DNA, 278 bp, Homo sapiens
gaagagaacagcagatgcaaaggccctgtggcagaaacaatcttggtatgctggaggaataggaaggcagccagtgcagctggagcaggataggttaagggaggatcaaggtgatgagggcctggaaagaggggctggggtcgaatcaccagatcctgttggttgcaatggaagagcctggagtttgagacagcctgggcaacatagtagctcgtaagctgtcatcctggagggtgagctggaaaggtcaccgcaaaaggaaaaggcaccgcaaaagc

SEQ ID NO: 223237 - DNA, 570 bp, Homo sapiens
tgtaactagtttagtacatcagattgattgcagctattttctgaaatagtttctgcctttacaactcagttgtttgaagggtttttgttttggtgggtgactgagtcacatatattgagaggtatcctgtttgtacgttttctttgtaattataaagtctttaggcagtttatttctgtttattaaaataaatcagaagaaaatgtgtcatagtttactatatgttatatgaagagaaagttcttttggggatcatagttttatcatagtaataaaaaattatcagcagtaaaaaagatagtcttatctcacttttattatagtttatagcattacgacatactgttagtttttttagtaggtaaatactacatagattgctttaacatatgctttgcaattgttgaaatactgctcatttaagttccttcttagatgtgattcagaagtgtactttaatgtatttaagttatattttcctagttcagttatattgagctttttttttttttaaactgtcaaggcaatttaaaatactcttgccttcagtgacttgaaattgaactctgc

SEQ ID NO: 223238 - DNA, 505 bp, Homo sapiens
agcagcagcaggtcttgcggcagcaggtgcatcagcagcaggatctggcggtacagctcattctggctcagcagcaatatgccctgcagctcccagggcccctggggcggcactctgcctgccagcagcccccgcactgcacaggctgggggcggagggtccattatgaggaaggagccgttcccttcaccactgcacacacatcccacctcggcctccagaagtgctgggatcacaggcatgaggcaccgcgcccagcccccaaagcttcttaagctgataagcaacttcagcaaagtctcaagttacaaaattaatgtgcaaaaattgttatagcatttctatacaccaacaacaatcgagctgagagccagatcatgagtgagctcccactcacaattgctacaagaagaataaggtacctggcaattcaggtaacaagggaagtgaaggacctttacaaagagaacaacaaaccactgctcaaagaaatcagagaggatac

SEQ ID NO: 223239 - DNA, 356 bp, Homo sapiens
gaagttcagcttctcagcctggtcagtagatcttattagtatttatgaagtaatttgaattttaaaaattcccagccaggtgcagtggttcatgcccgtaatgccagcagtgtgggaggctggggcaggctgatcacttgaggtcaggagtttgagaccagcctgcccagcatagtgaaaccccaccactactaaaaatacacaaaatagcttggcgtggtggcaggtgcctgtaaccccagctacttgggaggctgaggcaggagaatcgcttgatccagggaggcagaagttgcagcgagtcaaaatcatgccattgcactccagcctgggtgacacagcaagactccgtctca

SEQ ID NO: 223240 - DNA, 577 bp, Homo sapiens
cagaagtccatcttcaggcaagtccaagtgaaaccaccgcacacaagcctgtgtgtttatgaggatgtgcacatatgtcagtcaagccatgctcactctcagctcagtctcagcaatgaggttgcctcatctgtcgttatacacttagaattgtccacaccccggagtgaccctaatggatcccaatccctgtctcagtcccactgcacaaaagttacaaagggagaaaaataatttattaaacaaaatgtacatgagtccattaagcaggctttccttcagatccaagtgcaaagaagacattggaggttctctggaagctctatggggaattttgtctgttacttcagagacagttgccatggcaactacatttccaaatgcatcttagacaaggcttctctaaagctgtgttacctgatgactcacttcagtacaagcagcaagcaaaaaaaaaacctatctgaaaaaattttttcttcttgtatctatttcatacttaaacgatatattatacatgttacattacagagcatgtgaacatttacatacaataaaatatctttacatatatgtc

SEQ ID NO: 223241 - DNA, 337 bp, Homo sapiens
ctgtatgaggattaatgaaattatgtcccttataaaacatttgagttttttttttggtagaatgccagtatgtgagaataaaggaggatattcaccagtgtcttctaacatttaaaatgttaggagaagcagatcatatttgaaaatgaaatttagtctgtggttaatagtttatttcctcttaaaattgttatcaacttccataaatgtaaattatatatttttattttcatattttttgatagtcaatacttgtttccaacatggacaatattaaactgtaaagtttctgaagtactccaggtttctcaaatactcttatttccaggtaagaata

SEQ ID NO: 223242 - DNA, 437 bp, Homo sapiens
tttgatgatggtagaaaaaaatacttacctcacatgtaagtaaattaaaccaaagtacattaagtagtttattctgtacttgtaaacaaattgtccttagaaaaacagtatatatagggtttaatataaatgaaagtaacattttaagtgaaaaagtagcttggcaagtaacttgcttttaaaataggtgattcaaatcactgtgtactattccaacaaatgtaactataatattctcaaatgtgatttacaatatttaaacataggaccgggataaagaattgaggaaaattggtttttttgtctgttttgttatcaaaaactcccaatcgaaaaaaatgttacatttcagtatgtgccaacaattctaaaatacatactaaagtcaagtcttgtttcttatacaatgccaaaaaataataataaataaaaagaga

SEQ ID NO: 223243 - DNA, 233 bp, Homo sapiens
ataattgtttttaaacatagttctgtccaaacaggagatgtctgcgactctactctagcccatatacctaggtaaagctggctcggggggcaagtggtcagcaatttgagagtcagaaaatccttcagaaagataaggctttcctacattcatcattccgaggttagtttaaggataagtataatgtataaaaacaacaacaacagcaacaacaaaaaaacagaagacttcaa

SEQ ID NO: 223244 - DNA, 398 bp, Homo sapiens
cagtaaaaatactaaaagggattcaatttctttctggttcaatcttggaagggcgtatgtgtccaggaatttatccatttcttctagatttgctagtttatgtgcatagaggtattcataatattccctgagggttgtaacagactaataatgaggtctgaaattgagacagtaataaatagcctacccaccaaaaaaaaaaaaaaaaaaaaacaaaacaaaacaaaaaaaaaacacccaggaccatacagattcacagatgtacaaagaggatgtacaaagaagagctggtatcactcctactgaaactactccaaaaaattgagacaggactcctccctgactcattctgtgaggcccgtatcattctgatacccaaacctagcaaaaagaacatt

SEQ ID NO: 223245 - DNA, 459 bp, Homo sapiens
tttgtacttttaaataatggaatcacactgtgtgtattcttctatgtcaggcttcttctgctcaaaactatgtttgtgagcttcattaatattgtgtgtagttgtttattttcattgctgtgtatacttgattatgtgaatataccgatatttatttacccattctactgctgacaggctgctatgaacattctagtatatgtcttttagggaacatatttatgcatttctgttgagtatatacccaggggcaggattgctgggtcatattattcagcttcagtagatactgccaaatacttttccaaaacagttgtatgtaccaatgtatagtctcactagcagtatctgaaaaatctagttcttaattttaatctatgttaatgtatcattttttctttatgtttagtactttctatagcatgtaataaatctgtgcctatattaaggttgtaaaaa

SEQ ID NO: 223246 - DNA, 412 bp, Homo sapiens
cctgggtctcctgggggtggcaggtctcctgggtctcctgggtttcctgggggtggcaggtctcctgggtctcctggcacatggagtggttacatttctacaagtgtcccagtggcgctgggcaggactgccaggctggcctcaggccccagaccccagcagacaaacactggccctcagcaggtgtctgaggtgccagcgctgggcagcctgctggcattcccgcccccgaagtcaggacgagggactaaacccgcactgttcctctacgagtgctcaggtccacacctagccatgaacaggggcgtcggctgggagacaggctaatcctttccccttgttttccacatctctatgacatgttttacaaggtgctatagcaagtaggcaaataacaataatagaattgtca

SEQ ID NO: 223247 - DNA, 556 bp, Homo sapiens
  misc_feature (18)..(18): n is a, c, g, or t
ggggtgtctagaggtccncttcgacggtgttctgaagaatgagggtgcaacttccaaagatgcacagaacaaagtaatgaccttctgccttagtgactaaagcacacacaatcatgtgggcaaagggactagggccattagaatcctaaacttcaaagccatgctcattaaaccatttaaagtctacacacatccagaaatgggagaaagggagaattacctttcagaattttacttacacaggagagctgttcacaccttgtgtgagtgattgctgtttttctctagcaccacactcccactcagggtcctgagaggattttaactacagcccttattcgtggatgaattcaacacccatgtctgactttaacacgttcccatcagaactaaagcacatgggcacaatgtgtaggaagttgttctgacagtactcaagaataaaaactcaaacattttcctgaagtcctatttaccctctttgcattatactgagagtgaaattctttcttttttttttttttttttgagacagtttcactcctgttgcccaggc

SEQ ID NO: 223248 - DNA, 89 bp, Homo sapiens
tccctcccttcttccctttctttcctattgctaagaatacaaagaacccctgcttattaaaagttactttgagggaaaaatgtgatatt

SEQ ID NO: 223249 - DNA, 801 bp, Homo sapiens
atgcacaatataaaaatattagaagaaaacacatattgtcatatattgtgctactaattcattgtacatggtttataaaattgctttgtagtgtttttcagcttaaaagaacttgtaagttagaaagccattcaagaaatcagaaaaatcactgagaaaataaatcttgccttattcattgttttcttaagcataatctccacacagaagaattgaataaaccagaaaatgaatatttttttccttttctctctttcctacaaagcattattatgctgtttcccagctagacatgcatgtgaacagcgtgattgtgaatgggactaaaataaaacacttagtgcttgattaatattaggtatgcctcttgggatttgtttagtcactgattccttgacacacacctccagtaactttataaaaagaacaaaccacactttctgtataagatgcagtaacacattacttattccagaactacttccatggcaacctctactacagaacacaactaagaacttggacacaagccaagtgtctcctgagcacccaaaatagatgtcactgtgtctatgtcctttggcacatgcacgtttctcataagagaatctcttggaccctcagataaagttattgcctcttattcgtccataattttttataaacttgttcattttctggtgttcttgctcccagcacaaaataatcatgaagaggttgttgaggttgaaggaagttattagagatatgcaaactgtctacaccagtaagtaaagaagtcactcttcaatatggaaggtg

SEQ ID NO: 223250 - DNA, 1191 bp, Homo sapiens
  misc_feature (21)..(21): n is a, c, g, or t
  misc_feature (64)..(64): n is a, c, g, or t
tctcatctgcacatctcgccnttctggacctgcactgggagaaatcaggacaggagtgaactcnaggccatgaactcactggatttccatttttaggcacccatagggatgtttttaggatgtaagtttctgaggagaaagctagctctagcatgaagcttttttggattggcttctccatcgtgttggggtaacattttttttaattttttttgagacacagtcttactctgtctcagctcactgcaacctccacctcccaggttcaagcaattctcctgcctcagcctcccgagtagctgggattacaggcgtgagctactgtggccggccacatttcccttctggtgcgcgtcctcctgtagctgtgggatcaggggaggtagagatgtcttgtaactgactcaagtttggctgcttgccgcaggagaagcgaggtgtggtgaaaggaaagcaacttttattcagatgctagcaggtgggagagtggccaggctcaaggctctaaggaaccatctcagctttttggactgcgtgaagggctttaggaaggagaactcggtgtgggagacatgtgggagtagggcagtggtgcaggtgtcttgagtaattgcccatccggaggtctagttggcatcatcttgaccttggtctggtggtggtggactcattgttcataactcccctagacaggaggattccacagctgggttctatgcctggtttatttaaaaatgagcccctggcatttctaagcaggcacagaatgagataagtgagcactgtggctggtgggaaagggagggaaacaggtttaaagtatgtttcaaggctgcattctgagactaggagggaaaggaagaaaaactttaaaattcttctcaaggctgagatatttgactacagtctcatgcccaaaatgtttctattctacactgagacctgatagataatttggctgcatacctggagtccagtgtgtgcacctgcccctcccatcccatactcgcagccagtggaaaagtctgcaaaaggaagccagctgggagtgcccaccagagtcaaagtctggggcaggctggtggactcaagaggagtcttaaatattggaaatgtcatcacaaaccatctgggaagccccctcctcttaaaaaggacataaagtcaaagtgaacaggtgtgctcactcca

SEQ ID NO: 223251 - DNA, 668 bp, Homo sapiens
cgatgtctcaagtttcacaggatgaaagcattatggagaggatggtggtgatggccacacaacactatgaatgtatctaataccactcaactgtatgctgaaaatgtctaagatggtacattttatgtatattttaccacagtaaaaacattttagaaaaaaacaaaaaactggtatctcagcttccactcttgccctacaatctactgccacacagcagccagactggacctctgcatcagagtcgagttatagccccccaccccacaaactatccagtggcttcccatcacacctggaataaatcttgtgtcacctgccctgactccactgtagcagcactggcctcctggcctctcacactccagcatcttccccctcaaggcctgggcacctgctactcctctgtccaggtgctcttctctacccagctgctgggttccctcaagtctctactcagagagatgttccctgaaccacacgatctaaacactgctctcatcactccccttcatcttagccagctctacttttcttcaaagctttatgttacttcctaacatatttatttatttgcttatttgttgtttatttctcccactaaaatgtaagttccatgggggtaaggacactatctcttcattatctgttttgttcgcttctatatc

SEQ ID NO: 223252 - DNA, 446 bp, Homo sapiens
ggttttaattgacttgggttatgaaaggctctaataatagagcctgccactttaagaaaatgccatagcccactggcatatgcagaagctccttgtgcaagggaggcgtgcctacagctgatgtcatagcccagccttctaatgccatttgcataaagagtattcgattgcatgattatataaagtgaggtttactggtattttcttgtttagttcttgaaagtctaattataggcctaagggaataaatctaccacttgaagaggattgttgtggctactgtcagattccagggagaagacagattaaaagcaaaaatttgaatttcaaagaaaatactttaatgcaccaacacaatgaagtgaagtttatgtcaaaatatagaggtttgcctttcttgtattctaaactggttcttcattaaaataactttatctaaagaaaaa

SEQ ID NO: 223253 - DNA, 422 bp, Homo sapiens
atgatacaaagcattaatgatacatttgttctttatgccccaaaattagaagactgatacaccatcaaggaaaacccccagaaaagggaaaagccttacaatagcaaataaaaagagccctacaaaactagcctttaccaagttctagggactgtctaaggatatcacatatactaccttgtttaattctcacaggcgcctacaagatgcatcctttcattatcctcaatttgtaggagaaagaactcagagaggctgaggaaacttgctcaaggttatatcactagttagcggtggagctggggtgtgaactcagaccactgttcctaacccttgacactacactgtcttgtgagatggacaattcataaaagataacaacatgagtttttttcccttaaaactaaaaattgcttccttga

SEQ ID NO: 223254 - DNA, 396 bp, Homo sapiens
attcaaaaaggtaaacaaattcattttaactgccactgatatttatagacttcctccaaaatattaaaagctcttaaactgggcagattaagaaatacataaatggccaggtgtggtgcctgtaatcccggcactttgggaggccaaggtgggaggttcacctgagatcaggagttcaagaccagcctgaccaagattgcaaaaccttgtctccactaaaaatacaaaaattagccggtagtggtggcacatgcctgtacttccagctactcaggaggctaaggctggagaattacttgaatccaggaggcagaggttgcagtgaaccaagattgtgccactgcactccagcctaagcaacacagtgagactccatctcaaacaaaaaaaaaccaa

SEQ ID NO: 223255 - DNA, 325 bp, Homo sapiens
gagctgaataagtcaaaaaattaataaattgataagtcctagctgaatctcttacaaagtagatacctacttttgagtagttatcaaacaacaacaacatccaaaacaaacagtcctctttcttttcctcctcactaaactggtcaaagactctcaaaagacaccagtgctcagttgtacctaacagtgggagaaaaggcagattaatcaatagtcttattatgtagtgcaataaatatacaacagtcttttccttgagacttgtggtttaagcaaagctgggaaatgcaaaatggcatgtaaaataaaagactcatctaaatgg

SEQ ID NO: 223256 - DNA, 454 bp, Homo sapiens
gcattttagtgagcaatcattgcatatgaatgtttatgggaaaaatcaatgtgtgctaaatcattgtattccagtaaatagattggacttaaaacttgatacagaagttgcaaataagtgggattgagtttgattattatatagaaaataattacatgattcatttaagaataataatatccaccatttattgagcacttactatgagcctgtgtgccaaacatttcatgcatttctcatttaattctcacaataatcctgtgaggtagaagctattaggttgaatcatatgaacttgccaatatatgataatttctaagagttgggaatttttgaggatgtgaatggtaccactttgaattcctaagatgtaatataatatctaacacatagcaggcacttgattcattattttaaattgaaagaataaagatttttttaaagctttccaata

SEQ ID NO: 223257 - DNA, 358 bp, Homo sapiens
  misc_feature (111)..(111): n is a, c, g, or t
tggggattagaggatccgatcagtgcattgtggtatgaagtgggctagggcatttttaatcttagagcgaaagctataatcactggccctgtcataaggggatggtcatgngtaggtttatagatacgtgggtggttggtgtaaatgagtgaggcaggagtccgaggaggtagaagctattaggttgaatcatatgaacttgccaatatatgataatttctaagagttgggaatttttgaggatgtgaatggtaccactttgaattcctaagatgtaatataatatctaacacatagcaggcacttgattcattattttaaattgaaagaataaagatttttttaaagctttccaata

SEQ ID NO: 223258 - DNA, 625 bp, Homo sapiens
tagtggcttatgcctgtaatcccagcactttgggaggctaaggtgggtggatcacctgaggtcaggagattaagaccatcctggccaacatggtgaaaccccgtctcgactaaaaacacaaaaaaactggcgtggtggcacacacctgtagtcccagctactctggaggctgaggcaggagaatcacttgaacccgggaagcggaggttgcagtgagccgaaattgcaccactgcactccagcctggtgacagagcaggactctgcctcaaaaaaaaaaaaaaataaaataaaataaaatcataatcataataatatcgctaaaggaaatgatgccaaatataaaaaaagatgaattcttcttgcttcttaatttatataaaagacaaacgactgttaaaaacaaaaatagtatgttgtgagctgtataatctaaggatgagtgaaatctatgacaaaaatagcacgaagaatgagactacacagaagcagattgttgcaagggcgaaggatcaaagaagaaatcacaagggaaattagaaaatattttgaattaaatgacagtaaaaacctaacaaatgaaaacttgtgggatgcaaccaaagcagtgactggggagaaattta

SEQ ID NO: 223259 - DNA, 663 bp, Homo sapiens
gaagtccaatttcgctatttgctgcatttgcttttcaacaaaaattgtatttagtattttcactaaactatgtaagagcacttagctcgttgataactttcatcaccattgtgaagctatacaagttataaactattttaaggcttttcccatcccaatttaggccttaattattactgtgcagaaaacattttgctgcagcaactgttcttagatgtctctaaatcaaaacagaagtcaggattcaggtgacagcaaataaaatttccaaaataataaaatatcaggtaaatataatctctcatctctcatcttctctccatctccctatgtccctttccttctctctctctctctctctctcacacacacacacacacagtcataaaaactcacatgctctttaacggctctagtgagatataatttacatgccataaaagttcacccgtttaaaaaaaagtgtgcaatccaatggtttctagtatattttacagaattgtgtaatcaccataatctaattttagaacattttcatcatccgcaaatgaaaccttgaatcattaacagtcactcctcattcctccaccccctcttccccaggcccaagcaaacactaatctgctttctgtctatagatctataactctgcctgttctggac

SEQ ID NO: 223260 - DNA, 577 bp, Homo sapiens
ggactagtttatgaataatgaagttaacattcttagaattgaaataatagtttcttttacatgaatagaccatctatttatatatggctgcacaaataaattgagtaaaatatgagttcatagatttcttggctcttttaatgtgaaaataattccaactgtagagtcacccagctcctcaggtaccttgtaatgatccctgaagtttagagtccttattcattggaggaagctattagtacacattcaacagataagtggcaaagatacacgtattgtacttgtagagccagggtggttatcatgtgagtgagaattgggaatgttttcgctacaatatgtctttttgagtgtggccactaatcagtatgggttaatagactgatcgaataatacatcattatttttgtgttttacatcttaccccaatgctagctactctcaggacaaagttaacataaccactgaagcagtgagtggagataagtgtagtttaacaattttttttcatagcaaatgtgttgtgcgcagatgactgtcttctcatatcctgaataaatccaacactatgctatta

SEQ ID NO: 223261 - DNA, 458 bp, Homo sapiens
agacatgaatcttcctctccgcagaacaataaaatgcttctacatgagtgcttcttcccacccaaagaaaccaaaagaaaaagcaaagagtttacagtcaagatagaaaaaaaggacacaaccaaggagcttttccattgtgcatggtggactgagatttccaatccaaaaggcaacatctctgggaatgaccttttcagcgttttgtactctaccagaggcaccatggggcctctgggtggagagaacttgtcctcaaaaatagaggtgggccaataaacatatgcaaaaaaaaaaaaagagcatcggcaggacagagcagctacgtctggtaagacgaggggcggggctgtgtgtttgtttgtcaataactgctggtgtgcgatgtcgaatattaaagaagtctcaaggtattgcttgcctgaggtagagtacctgatgataagctgtgtcgacgc

SEQ ID NO: 223262 - DNA, 256 bp, Homo sapiens
taagtcaaatcagttgagaatggagaggaccacaaattattttcagtccagcaagtgttataaacattaattctataaaaagaaaacaattgaaactaatttcttattatattgcatggcaccaaactccccccacttcctttttgaggatcatgagttgtctgtcattgtttctttttattgatatcaattggttaaatataatctggaattggaataaaagaaaaactattataggctttttccagaccatgta

SEQ ID NO: 223263 - DNA, 657 bp, Homo sapiens
tcatgtggcagtatcactcgtcttcagaaaaggaaagacaagacccctcttgactccacagtgccctctagctatcttgtttctctgctctttttcatagcaaagtaccttgagttgtctatagtgttctattgcctcacctccagttcacccttatttttctttactttttttgaaatacacatacaagacagcatatataattcgtagaatattaccaatgtttttaacactttgtgcatcctttcccaatagtgtgcccttacctccactgcttaagtaaccactctctcaaatttttgccatcatttacttgcttttcttttttcttttttcttttttttttgagacagagtctcactctgatgcccaggctggagtacagtggtgcagtcttggctcactacaacctctgcctcccaggttgaagcaattcttatgcctcagcctcccaagtagctgggactacaggtgcctgccacaacgcctggctaatttttttgtattttagtagaggcagggtttcaccatgttggccaggctggtcttgaactccagagctcaggcaatccacccacttcagcctcccacagtgctagaattacaggcgtgagccactgcacctgacccccacttgttttttgtttgtttttgttt

SEQ ID NO: 223264 - DNA, 535 bp, Homo sapiens
caggaacacaggtgatggccatcatttattgttattgccacacagcaggtcctgattccggctcagatagcgaaagcctggcaccatgctgctgtgtaattccttcagctccttttgaaaagtctccagctgaatcatagaagtgttaaggaaaaggaagctgacatatgttaagcaccattatgtgcactaagcgtttgatatttctgtcgggaggcaagagagcatagagccgtgtgtggactggcggcagcacctagacatttcttagaaatgtacattctcaaggcccaccccacaccgactgaatcagaacttgggggcaggagcctgggttttagcgagcactccaggtggtcctggtgcaggccatggtttgagtaccactggcaccaaggttaaagaggatggacttggccgggcgccatggctcgtacctgtaatcccagcactttgggaagccgaaataggaggattgctggagcccaggagtttgggaccagcctgggcaacatagtgagacccctgtctctat

SEQ ID NO: 223265 - DNA, 442 bp, Homo sapiens
cacgggggctagagaaaacacagcacattcaatgaactacaagtagtttagtgaagttacagcgaaggctgaactttgctttgcttttggtaaaacggggattggctaatggggagacctgaagggcagaggccatgacatggcaagccttgtataccatgttaagaagtcttaattttattctgaaaacattggggaaattttaaagcaagggaataggcaatgagaattattcttcagatttgacaagtgagttaatggtaaaattggcaagagttgtttcaataggagaataatgcaaacttttaaatatagtaaaggtaataataaatgagcattaatttactatatctagttctgcagtttctgttcacacacaaacctagttctatctatgcatgattggtctgacaggaatgagaggatgtaggggatgttggca

SEQ ID NO: 223266 - DNA, 679 bp, Homo sapiens
taaataagcaaatacatgtaaatcatactaaatgcaacagggagtctcctagctcctgaggtcttctttctaaaggcaaatcttgttaatcgtagttccttgcatattcttgcagagatggtatatgtatgtgtattttatatatatataattacagaacctgtatttatatatatatatatatatatatatatataaaatcagagtatatactacataatacacacacatatataaaatgtataaatacataaagtgtgtattaagtatacacaagtatgtatatctatctttttcctacaaaagatagcatattatattgttttgtacatttttttacttgatatgggacaatgtcccatatcagttcatacaaatgctcgtcattctttttaaccaggtctacttttgtatcagattttatttagccaagcttttactggtcagacatttgggttgtttccagttttatgctattaaaaaagatgttgcaacaaatatccactgtgtatagttgtaggaatatttatagagtaatttcctaaaagtggaagtaatcggttaaagagtatgcacataataaattttaatgatatcaccaaattgtttccacaaagaggctcaacaatttctctttctacctacaatgtgggccatgccctctcatgccctccataac

SEQ ID NO: 223267 - DNA, 369 bp, Homo sapiens
tgcctcttttccaaaatgagaacatctcagacaatgaaacttggattgagctaatgtggacctggagggctaggaatatttgttaatacctctcaaggttgtttcagaatggattgttttgctagtggaatgctgaaatagatcagaggtcttctaattttcataagtactaaaaataatatgtatcagcctgaaaaagcgtgactgagaaattaagcctgatttcttttcccacttccttctacgattgcccttctcttacacttcacaaaaaaggggcacccttttcttctatcttgtgttgcaaccattgttgaattgtcttatagtgtagaaaccctactctcagtattaaataaaatgacaatt

SEQ ID NO: 223268 - DNA, 1205 bp, Homo sapiens
gggggcttgagcctctcctcactcctctctgattggtccaaatttgctcagtctgggccaatcagagtctttctcctgggatgcagagagattagcccaggtggatgatgagggagtggcaaaccgaagtctatgcataagcagagaaagccagtctttgaagggaaagaggacagagcgtctgcctcaagaataacaagagagacagtgtcctttgaaagcagagaaggaactcagccatgacattcccattgcagtccagatgaactgggtagtccataagatgttgcaccttgttcaaccctgcgcatcctttctccagacccttggagaaatacctcccaccccgtgttgccaccgcctagggaaatccaaaatccagctgtacaatgtctgtacatttccaggggcttccatcctcaagtcttctctgctcctaggcttggttccttgagtcctgtacctccatccaactgaatatgaaactcagatgcttcactggtttccataacaacagaataaaacaatgccctatcctactcccacaggtcatttgaggagcaatacaatgaggatcacaaaaagggtgtcattgatctcttcacagcagacagcttaaaaaccatgaccagtgacaatcgtctcctggctcaccatgtaactgtccctccagccccagaggactagccccagccacagccctgcaaagaccttgattttttttttaattgcaaaaaaaaaaaaaaaaagaaaaaaaaaaaagaaaaggccaggcgcggtggctcacgtctgtaatcctagcactttgggaggccaaggcgaaaccctgtctctactaagaaatacagaaattagctgggtgtggaggtacatgcctgtaatcccagctattagggaggctgaggctggagaatcccttgaacccgggaggaagacgttgcagtgagccgagattgtgccactacactccagcctgggcaagagagtgagactctgtcttaaaaaaaaagtcaatgttccagtaaagggcatcgtggtatccatatggccataactaggagaactagaaatccacatttgacattcctggttaacaagatctttttcaccaccctgtgccataaggcagtggggtggtttcctttttcttggccttttccacacacggggtccagtttcatcacctctttttctcttctccttta

SEQ ID NO: 223269 - DNA, 361 bp, Homo sapiens
gagtactaagccagtttcccgcttggaccccctatgggatgagatgtagacattcccgtaaagatacagaggccacgtccagtttgtgagccttcataggcctccttctttggctttcatgagagaacctaataacaagggttttaatgctgttcatttcaaggcacaggttagatcgatgtcataatttaccttttctgtgagtagcagagataagctgacagctattagccatgttagcctcatgcttctgtagaaacgtgttaaaagtttattttcaagaaagaaggctctaagtcttccggtcggaattttgtggtgttcagttatttgggtaaccaccagttctagtgtctttttt

SEQ ID NO: 223270 - DNA, 430 bp, Homo sapiens
aatggcgtgaacccaggaggcggagcttgcagtgagccgagatcgcgccactgcactccagcctgggggacagagcaagactctgtcccggaaaaaaagaaaaaaaaaagaaacagggtctcactctcttgtccaggctggagcacagtggcatgaccatagctcactgcagcctcgaactcaaagaactcccagcctctactgatccttccacctcagcctcccaagtagctgcaccaccatgtccagctatttttttttttttttaacttgtagagacagggttgtgacttgttgttcaggctggtcttaaactcctgagctcaagcaatcttcccaccttggcctttcaaagtgctgggaatacgagtgtgagccaccgcgctgggactcatttaattttataaagaacatatattctaccacccta

SEQ ID NO: 223271 - DNA, 723 bp, Homo sapiens
aggatcctaactttaattgaagctgccaaaaacatgcatttataaagccagctttctaaataatacctatcatttgaataggattttctgttttcaaagtgctttgacatgcattgtccatgtggctacacggaaaaagtaccaggtaaagtggtaccatttcattcacagtgagcagaaaaatgatcagacctgtatgcacagcagttctagaatagattgggctggggaagaacttagtggtgtcagcctaggctctttgaccaggctatcatcggttcaaatcctagctcactcagttgctggctgagagatttattgagaaaataaattttctcaaatttctcaaaaattttaccctctctgagtctgtttattctcatctaaaatggccttaatcctacttgtcccacagggcttttttgaaaaagatgatgatgatcataataacagacgcttatctagtactatgtgccaggctctgttccgttgaaatgttaagctgaacccaaggcatgggacataattggagatttcctagatattttaaaaattaagattttatttttttagagccgttttaggttcacagcaaaattgaaaggaaggtgcagagatatgccatatactccctgtccctgcacatgtttagcctctcctgttatcagtatgccccagatttcctagattttcaacaatggatataacctattttccgacctt

SEQ ID NO: 223272 - DNA, 880 bp, Homo sapiens
ctcactccacacccagactgtttcctgactcaattccgtacctacttacagaccctctcagcttgctgacacccccctgtctgtgggactccctattccctagagccagggactgatgcgtctccacagacaaggacttggctcgctggagctctgctgagccgagagaggagggggtagaaaacattcacacttcctatgctctgtcagcaggacagggagcaaaaacgtccccaggcaacgccctcgcctctgggactttctgcctgtcctaaggcctccccaggtaccaaccccgtagctatctgggtctgtttggcactgtggattctcaagggcctagaacccttgcctctgaaactggtccgctggtgcagccctgctgtctgcagctcctgcccatacccccagcccacaccaggccaggcccactccgggctcaccaccctctgcagccttgtggggctctcccagcccctccagaagcccaccccacttctcgccaacccccgatctctaaatgaggcctgagcgtcaccctagttctgcccctttttagctgtgtagacttggacgagacatttgacttccctttctccttgtctataaaatgtggacagtggacgtctgtcacccaagagagttgtgggagacaagatcacagctatgagcacctcgcacggtgtccaggatgcacagcacaatccatgatgcgttttctccccttacgcactttgaaacccatgctagaaaagtgaatacatctgactgtgctccactccaacctccagcctggatgtccctgtctgggccctttttctgttttttattctatgttcagcaccactggcaccaaatacattttaattcaccgaaagca

SEQ ID NO: 223273 - DNA, 550 bp, Homo sapiens
aaacaaaatatatccagaaagaaacaatccataccaaggcttatcattataaaatttcagtatatgaacaatagacagaaggtcttcaaggattccagggtgggggcattacatgagaataaaaggctcctacattcctagaaaaaaactaaagagtcagtaaagtggtacaaaggtagcaaccagaacagattttaaaacttctgatcaagaaatgacagttttttgggtcatggttaacaaagctactataactgatttaaatgattttaatcaactaataacaatttgcctcagaggatatgcttctacaaactaaccaactaatgagggttccttacttctgaaactcaggcaatcaaaaatggcctgttaaacagacacatcccaaagccaaccaatcaacaactgtcttcacttgagtgacagtgcttctatagctaacattaacctgctcctgtctttgaaagtttgccaaccatggaacttcctaattccccaaaatcctgtaagaccagcagtctagcaaggttggggaaattaaaaaaaa

SEQ ID NO: 223274 - DNA, 284 bp, Homo sapiens
gggctgcatttgaatttcagctctgtcactttttttgcaggtgactgagcaggtcactccttttctctgggcctcagtttccccctctggaaaaatgggaataatgaagcaccctcctggccggtttcgcaatgctcaaatgcaatatggttgtgctgagtgcaaagcgtggtcctgagagggcactcaatacacatgaacgattcagccctaagttctcgaaatatgttcaaggtacccgctgcgggtctagctctgtcctagacacaggagatccagcagca

SEQ ID NO: 223275 - DNA, 442 bp, Homo sapiens
aaagcatggctctgaaaatttatccttttgtaaaataaatttacatgtatatattaataaagcaaacaagggatgcaggcagacggtttctctgaggtccttttatttgaatctaggaaagattaactcacaggaaaagaagactaaagacaggtttgacacttttaaaggtctgacagagaaactattaccacaggttaccatctactctttttgagggctattacctgatagaccttctctgcacaatgaaacaacagcctttgttcacagtgcattcttccccttacccttccataacctgtcaccacagcctccaggagcttcaggcctctttttctttctgtatcatataaaaaccttaggcccttctttgagtcctgtattttgtgtagctccctgtgcacgtgcatgtaataaatttgtatgctttttcctgtga

SEQ ID NO: 223276 - DNA, 280 bp, Homo sapiens
accatctacaataacactcagtagaaaacattcttgctaatttgaacaatcgaaagattcctttggtgtaaagatacttatataatttataatagagttatatgaaaaaattcctgtgtagtttgcaaatgtggctaacaaccatttaaaaatgttggtttaggctgggtgcagtggctcatgcctgtaatcccagcactttgggaggctgagacaggcggatcacctgaggtcgggagttcaagaccagcctgactaacatggagaaaccccatctcta

SEQ ID NO: 223277 - DNA, 533 bp, Homo sapiens
agatggagaacaaagaactgaacatatcgacatactgattctttcaagagaaacttagaactcactgtatttatcagttctttgcagtgcaagccctggcaatggctttagaggaatagtttgaattctgggtttgaatctttgctttgctacttactgccttacaagtcatctttctaaacctttttattttctttcctacaggatcacaaacactataaaggcagagacaatgcttgatttattgaccaatgtgtagccagcacttctcatagagctcaatatttaataggtgctaaataaatatgaatgagtgaatgaacgtgtcatacgtgaccttcttaactttatgatcctaagttatcctcatctataaaatgagaatattaattgcatctattttgtagggctattgtagggtttaagtgaaataatctatgtaaaatatttagcatgcagtgagaatgcactaaatgttggttattgttattattggtcaatccatgaattacatgtcaaatgaggcaaaaaaa

SEQ ID NO: 223278 - DNA, 356 bp, Homo sapiens
tccaaaacataagtaaaagctaaacaagaatgctgaaaatcaagcacaggaactaggaagaagcaaagacattaaagaaaaaggaaaagctaaccacatatacactctctagaattacctgttttgtctttgatgggattcatggattagttcctttgttcataattccataattatttttgagcacctgttgtgtcttaggtagcagtctaggtgctagggctcagtgatgcacaggggagcagagttcttgcccttaaggagcttacagttgagtggaggaggctataaatgagcattcatcataggaatgacaaatgctgtgattgcagaagtataggatgctatagaattac

SEQ ID NO: 223279 - DNA, 142 bp, Homo sapiens
acccagagcctgtagttttctaggctctgcatgagatcccgtgtgttggcagatagaagagaatgtctctcctgcagctcatgcactgtgcctggcacagggttggccttctgtaaatgttcaccaaataaacaatgggcca

SEQ ID NO: 223280 - DNA, 186 bp, Homo sapiens
ggtacttccactcatctccccactttctacttccctcctatccaggttggattccatggtccattaccccaactactctcggattccgtggtccattactccaactactctcttgcaaatactctaaactcccttggcccctccttgtacctttgctcttttgaaaatatttactttaggccgggc

SEQ ID NO: 223281 - DNA, 585 bp, Homo sapiens
gttatcagtgaggacatacagatggctgcaaaatatgaactgttcactttctccagggaaatgcaaattaaaagaatattttattcatcaaattgaaaccacctttgcaaaaattatatcagcaagaaaattatggcagcaggggagatctgatctagccaacccccctcttgactttagccttaaagctgccttaattattcttgggattagactgggccgactttgggagacatttagtttatggtttaaatggtaatagctcttccccaaactcaactgccttcgtaaagctaatgagagaccatcaggcgaggaggacagagaagcctgatttctactatctgtaaatataaacaattgccagccattattctggaggtcacaagatatgcaatttctccaattactcctgcaggtaacatcattatcgtagaacctaagattgaccttttgagatgtcttttccacacctggctctgcctggacctgccagctgctcctgtggccacacccagaattgactcagcacaagaagatagcttcagctccctaggattttttttttttcttcgagacagagtt

SEQ ID NO: 223282 - DNA, 421 bp, Homo sapiens
ggcaatctttcaaattcaagacagttttatacacaacagaaaaacatttatttggaaaattgcctgcccttgcaaccatctgagatgtgtattgacagtgtggctttctgagttgtggattaggatttgttataagaatttttggtgggatgcagtggctcgccctgtaatcctaacactttaggggccaaggtgggaggatcgcttgagtctaggagtttgagaccagtctggggaacatagcaagaccccattctacaaaagaattttaaaaattagttgggcatgatgacgcatccatagtcccaactacttggaaggctgaggctgaggattgcttgagtctgggaggtctaggctgcagtgatctatgattgtgccactgcacttcagcctggttgcaaagtacgactctcaaaaa

SEQ ID NO: 223283 - DNA, 416 bp, Homo sapiens
taaaattaaccgtaacatcttccttgtttattttccaaaacttcgtgggtgactattagcaaatgtttttaaatggacattttcctgtctgaagaataaagaaaacaatcacatttataattgcaacaaaaacaattaaatacttaggaataaattaaccgaggaggtaaaagattttacattaaaaactataaaacactgatgaaagaaataaagacacaaataaatggaaagatatctgtgataatgagtcagaattcatattgtttaagtattcatactacccaaagtagtctatagattccatgcaatccctctcaaaatttaaatggcatttttcacaaatagagaaaaaagttctaaaattcatgtaaaactacaaaagactccaaaatagccaaagtaatcttgagtta

SEQ ID NO: 223284 - DNA, 657 bp, Homo sapiens
cagcagcatagatattaccgagataaccctgtacgaactctgccaattcactggactgggaaagatgtacgagaacctaccagtgacaggtctggatgatgacgttccaacaaaggctatagaggttaaaatgagagtggaggtgaggaggtgacagaagtaaaggtggcttcaagagaaatttacggaagtagactcttgagggtccccagaagagataggctgtagggaatgacggaaagggaagaattgggatattaggggcatgtggcgaaatgtttaggttgaatttggggaaggctataccacggctgctagaaataatttcctggggcaaggattgtttgatttgtctctgaacccccgtacccagcacaaaccaggtacacagaaacattctagaaaaatgttgagtaaatgacaagaagctttggtgtccctatcagatggaatcctgggttgagggactccttgggactagaggccatgtgggagtttcatactctgtgtgtgtatgtgtatgtgcctgtgtctgtgtgtgtctgtgtctatgtgtgtgtatgtctgtgtctgtgtgtctgtgtatgtgtgcctgtgtgtgtgtccatgtgtatgcctgtgtgtgtgtctgtctgtgcctgtgtatctgtatgtgtg

SEQ ID NO: 223285 - DNA, 504 bp, Homo sapiens
gcctggctaatttttggtattctttgtagagactgggtctcacccaggctggtctcaaactcatgagctcaaggcgatccatccgccccaacctcccaaagagctgggttacaggcataagtcaccacacccagccataaatgataggtatttcttatgctgtaagctatgcaaaattaaaaactcgtaaccttctatcagttccctttttttcctttaacatcttggtctttaaaacaaaatttaaaaaagaaagaaagaaagaaagaaaactgttgccttagtccttgagagtcagtggctcaaaatgtatcccgtttatctttacataaacttactgcaagtgaagaatctgaattcaaacttcttggatgttattttggtcttcatttaaactatgtgagtataaataacagaatgcacagtatcctccagaaaacaggttatcttcatttcattttacaaatggttgtccataagatagttctagaattgttagaattg

SEQ ID NO: 223286 - DNA, 507 bp, Homo sapiens
atagaagataatcactagccaacataatctgtgttgctaatgagatggagaaaactagagggttttgtgcgaaggaataacatgatctgacattctactagtgatttatgtactaaattatataatacatgaagaacacacaattaaagaataataatagaaaacccactcttattaataaattaaggaacaaaatatttttggtatcacacacctgtttgccacttcatgtctcctctcctctatgtaaaaggtcctatttgatgaaaaggattttgtagactttctttatcatttcatcaccaaagtttgcatctactagcaatataaggtgttgattttctttctaaggtctccatgaatggaatcaaactatatgcactttttgagccctgtatctttcactcagtattatttgtgagatttatccacctttttccatgtggttgttattagttcattttcattgttgtgtaataattccattaaaagactggacttcaattt

SEQ ID NO: 223287 - DNA, 418 bp, Homo sapiens
tgagcttgaatgtgatggctgaaactccagcagccatatcatatcatgtggacaaggtttgtgccttaggggtgaaggaatggtgagcagagagtccaggtcccaacttcatggaattgctatactaatcttgcactacctccctctcaaattcttctatggcagtggttcttaaatcacctggagggcttattaaacagatttctgtgccacaccccacagtttctattttagtaggtctggtttggagcccaagagtttacatttctaacaatttcccaggtgatatggatcatcctggttcaaggaccatattttgaaagccagcattttatgtgttagagaaataaacttctcttttgtttaagctactgctattttgtgctattctgttattaaagatgaatttaatacatta

SEQ ID NO: 223288 - DNA, 406 bp, Homo sapiens
gtggcgacagaaggaacattgtatataaggaaaaatggtatgaacaatggcctagggaaagaaatgtgcctgaggagatcggattggtaaatggcctgacccatctgctgtagatgtagtagcaggacataaaggcaagatctataacgctcaatactgattattcatttgagacagtaaatctcagcctacaatggtgatactctccagttagaggagaagctctttcaactggaattgattataaccctcagttggccatcaaatcaaaggattgtatttaaatggggtatcacaacatttggtatattaaaaattatattataacttcatccataaaattgtaaatcttttaactcaaggccaaggcctttgagtacagactcactgactggatttccacaac

SEQ ID NO: 223289 - DNA, 351 bp, Homo sapiens
gcacgagatagtttcattttcataccacaccccaaaatgtattctggataggctaaaatttttaatattaaaaatgaaagcatatgccggacgcggtggctcacgcctgtaatcccaacactttgggaggccgaggtgggcggatcacctgagatcaggcgttcaagaccagcctgaccaacatggtgaaaccccatctatatttaaaaaaacaacaaaattagccaaggatggtggcgggcacctgtaatctcagctactcaggaagctgagacaggagaatcacttgaacctgggaggcggaggttgcatttagccgagatcacaccattgcactccggcctgggcaac

SEQ ID NO: 223290 - DNA, 432 bp, Homo sapiens
caaaaaatgagttgcgtttgatcttgggtaaattacttaatgtaagtatcatttgcttagctgtaaaacaaggatggtaatatctatgccacacagacatatggcacagagtcagtgtccaaaaatggtagctgtaagaattctgtcaggctgggcgtggtggctcacgcctgtattcccggcactttgggaggccgaggtgggcagatcatgaggtcaggagttcgagaccagtctggccaacatggtgaaacgctgtctctactaaaaatacaaaaattagccgggcgtggtggtgggtgcctgtaatcccaactacttgggaagctgaggcaggagaatagcttgaacccgggaggtggaggttgcagtgaacagagatcacaccactgcactccagcctgggtgacaaagcaagactccgtctcaaaa

SEQ ID NO: 223291 - DNA, 172 bp, Homo sapiens
ccagtgtgcataaattcattaggtttgcttttctgactttgattttattggattgctaattttgaaaatggtattaatccacaagtatattatgatataaatatgttattactgtcactttcaccctgatttctgtggatttcagatgctttttttttttaagtttcatagt

SEQ ID NO: 223292 - DNA, 448 bp, Homo sapiens
tgttaacacggccaaagggacatttaatatttgcagtgtctcagcaccaaacaagtatacaacttcccgtgacagggcaggtaagaccttggagagactgtagacaggtcatttgaaccaattctctggggtaagatgtaggaaatggagcttttgccatctttcattggttccaagatatacatttttggatcgctgaagtcaggaggcatctcccagatgatggtatcatattcttactgttggcccggacagaaggcaggtgctccgggagaggatagtactgtttttgccagccatccagggccacccagcctcagactgttggacattacactctctgcttgatgttcttttggatcacactgatagtgcaaattcagaaagcaaacctgcatgagtaccaccggcttgggactcctgttctcagggaaggatttttcacccc

SEQ ID NO: 223293 - DNA, 431 bp, Homo sapiens
aaggatacttgccaaagtgtaaaagcatttatctctgggaggtgagatttggagcaattatattttctttttgcatatctgtaacttctaattttccacaatgagcatgtagtgtctgtaaaatttttcagggaataaacaatgatgttcacaatatatattaaatgaaaaacacatgttataaaacagtatgtatagtatgacacaatatttgtaaaaaagaaaattatatataaatatatctatgtatgtatatatatgcataagaaagctagaaggacatacactaaaatgttaatagtagttatgggtagtgggattatgggtgattattttttctttttgcttttctgtgttttctaatttttctacaatgaacatgtattacttgtgtaataaaaactaataataaaagttttaaaaaatgaata

SEQ ID NO: 223294 - DNA, 443 bp, Homo sapiens
tggctcttcctatgtgatctctgcatggtggctctccttggacttaggccatgaatgaaagcagcaaaaggccctgaccagaagccaaacagatactgtcatgcttcttgtacagtctgcagaactgtgagccacataaacctcttcactttatgaattacccagccttaaataactaataagtaaataaaaatgtttaaaaagatttcaagtgccgggcacagtggctcacacctgtaatgctaacactttgggaggtcaaggcaagagggttgcttgagctcaggagttggagaccagcctgggcaacatagtgagtcccaattatataaataaaaaacatttataaataaaaataaatacattacccagtcacaagaagatcacttgagcccaggagttcaagacaaggctgggcaacatagtgcgacttcctttccact

SEQ ID NO: 223295 - DNA, 474 bp, Homo sapiens
atctggcctgctgctccccaggtacatggctgaagctgtccagctgcagagagtggtggggcctgactggacatccatgccgaatctgcaccctccaatgtccccctctgctctcaaccccccagccccaacctctgggtccctacaaagcagggaagggacccccggggcgtggtgaggctgcagctctccaggagttccacacgggcccagtgctgcccctgctgctgcaggagcccccaggctaggttcggccttcctctcgcccctgtgcacccggagatgcccacagcaccagcacctgagctcacctccgaacccgcctcctgaacccgcctcctgaacctgcctccttacctcccacttcctgagccctgagtggaagcctttctgtgccttgccctttgcccactcccctggtgggactgccaagaccctcaatgcccattaaatactcttgcctgcctcttacaa

SEQ ID NO: 223296 - DNA, 487 bp, Homo sapiens
aaaacaaacatcaaagtataatttcctggagatattcactggatgagaatcaaagatctggggggcaaaagacagcatctctctgagggtctgtggtccagccctgcatggaaggctggctgaggctgggcttggcagtgcaggccctgggttcctgggggcaggctgtgggcctataggacatgtgggagggagatgctcaggatccatccggcctcctttggctctgccctttaccaatctcctaggacatactgataggcattcacacctggcacaagggatgcagacataaacatcaagtgctaagtgaagaagccacatggtagggtgaaaattgttcaagctttgcagtcagacatagctcggtttgaatctgagctctctcattttctagctgtgtgatcttggcaggcttctttaaatcctggtttcctctcctgcaattaagaataatgcagcctctacagagattattctgggtttg

SEQ ID NO: 223297 - DNA, 521 bp, Homo sapiens
tagatagaaaaaaattattttgaacaattgctgcttttattaggaaaaacacatcagccatttgtggtcactttatttcttggcattttaggtgggatactggagatacttatcaaaaggaggttagcttttgacaatgtaaattaaaaccaagtttatttgaagtcactttatgagcaaggtctctcttttttggtgaaatgtggttgaaacgcaaagtcaaactagcagaggccaaaaggaatctgtgttggaagagaggttcacgtgattctgagatggcaagagcacacccggggctcacagaccaggaatcagagattcagacacagcctggaatcttctctcttcatctcttgtttctcttgcactggcttcttcctaggaactacgccacaaacaaacctaatgtcccccgtctctgttggtcctagaaaacgaataagcctcttgcgccagctctggtttttcaaatcctgagaaatgaccctcactggcctagtgtgagtcatgtgcttacc

SEQ ID NO: 223298 - DNA, 561 bp, Homo sapiens
gggagattaggaaatggagcccaaaagaagagacaactgttacaagaaattggctatgaaaggaaggagagtgagttagaggcatgtaaaccaaaaagtatctgaggccaggtgtggtggcccacacctataatcccaaagtgctgggattacaggcgtgaggtgctgcacccagctgaagctaaggttcttgtcatgtagatgaagcctccggtagctggcttcagagagaattgatggtgaatgtctgttatctgaccttaaaaggtgtcagactttccagaaaagacttagtgtggggaagagatttctctacagaatgcaaatttccccccacaagagagttttgcagggccatttcaaaatatgtcaaagaaatatcttttggggtaaaatactttgatttcctttagggcctgctatctgtcatatggtgctataccagaatcagtttggaatttggtatcttattgctacagagagtttgttttgtcagtcttactatctgtgttttaatgttcatgctggtcagttgtgtctaaactccagaggatcaccagg

SEQ ID NO: 223299 - DNA, 241 bp, Homo sapiens
taggaagcctagattttagtttgggctctgacactaattctatggctggagcacatcccttaacctctccgagactccattttctttattataaaattagaatttggaccagttggcctctaaatgtcttccatctttgactctttgtcttttctgtgcacataaacatcagatctaatccttgttagtggcattattttgaaaacatgggacagaaacataggaacaatattctttattg

SEQ ID NO: 223300 - DNA, 519 bp, Homo sapiens
ggccgggcgcggtggctcacgcctataatcccagcactttaggaggccgaggcgggcggatcacgaggtcaggagatcgagaccatcctggctaacacggtgaaaccccatctctactaaaaataaaaacccaaaaatttagccaggcgtggtggcaggcacctgtagtcccagctacttgggaggctgaggcaggagaatggtgtgaacctgggaggtggagcttgcagtaagacgagatcgcaccactgcactccagcctgggctacagagcgagactctgtctcaaaaaaaaaaaaaaaaaaaaaaaaaaaaaaaaatcctgcattacacataggcacatgcaaacacacacatgtggaaatagatacaccatattataacactttattaaaggatagcttgttctcaaggattccttcttgcttgatttggaatcaagtattaatcatgtgttagccacaaggtgagtgattttgaaaagatagtcgagagatttttaaactatttccacaaagt

SEQ ID NO: 223301 - DNA, 464 bp, Homo sapiens
ctataaattgagatacatctccttgtttcttacaaaatctacctcaaagtgacaaaaagaaagctttttgttttttctcatttttttcttccttggccatgtgtatacaaaataaaacaatttgtcaagaaggtttgggggaaaaaaagtagagtcctccagagaaatgatgcgataactaactggttaatttcctgatttttaactttcatttaaatgtgtagggatggcctgactttttttttttagcccagcaaaaagtttttctatgataaattttacatttcctgttagaagaccatttggattcttttgaaaaaaactgttcaaagcatgaggatttgtactgccaatcacctatattaaaaacaataactttataaatatttaaaatcaaatactgtggtgtgtttgaataaactttaaatcctttgttgaaaacttccagaaagaaactattttaa

SEQ ID NO: 223302 - DNA, 200 bp, Homo sapiens
tgcacccagccagaatgatcatttttgcattgtcattgatcacacccacagagggaactttaaaaccgtacagatgcccaggctccacccccacctattgaatgggaaccccagggtatggtaggggcctgggcctctatacttctcaaaggatccatgagtgattccgatgttgtttttttttttttttttaaaaaaaa

SEQ ID NO: 223303 - DNA, 488 bp, Homo sapiens
ctacttaaaagaaatcttttttcatttaacagcttttcccatggggatagagttttcatgaataaagcaaagtcattaaatgaggtatatggtacatcttttaagagtcacagaaagaagcaacaacaatttacccaggcagagggtataagtttagaccttggttgcctgatttgtgggacaagttctttaattttttttctttatattttgacttttttttggactctctcctccccttccaggctccaggtcaaatacttgacacctgaatgatgttcaattatttaaaagatggattggccagctcagctcctgtctcagacagactgtctttaaatgtattttcaacatgtcttcagacagttatttttcctctgttcaattttgttcatcttcttacttaaccgttcaagtgctcctatttcctttttaaatgtagtattgagaagtgcaaacattattggaaaagagagtctcactagcat

SEQ ID NO: 223304 - DNA, 650 bp, Homo sapiens
tacatcggctatctcaattatcttggtgcttacactctagtgacggcaagagacaattcagcaaagacataaataatgagattggttaagaaaatatagaaagcggctgggcgcggtggctcactcctgtaatcccagcactttgggaggccgaggtgggcagatcacttgaggtcaggagttcgagaccaccctggccaacatggtgaaaccccgtctctactaaaaatacaaaaattagctgggcatggtggggcttgcctgtaatcccagctactcaggaggctgaggcaggagaatcgcttgaacctgggaggtgaagtttgcagtgagccgagatcgcgctgttgcactccagcctgggtgatagagcaagactccatctcaaaaaaataaataaataaataaagtgctgggctactctgacctgggtgctgtgtgtccctgcgctgatcgcttgacatttctgagccagtttcttcatctggggcctggagccctgccttcctcccttgcagggtggccttgggggtcagtgggagagacaagtgtggacaccccgggtgggtgtacaacaaggaggtgggtggggatttggggcatccaaaggcttcttttcttgaggtgggtcttgcctccttactcccggg

SEQ ID NO: 223305 - DNA, 744 bp, Homo sapiens
ataatagtagacttcaataacctaccttccgtaattgatagaacattcagacagaagatcaataaggaaacagtgtaactgaacactataaaacaaatagacctaacagattatacagaacattctacccaaaagctgaagaatacacattcttctcgaatgcacagagaacttttcccaggataaatcacacattaggtcacaaaacaaagcataacaaatttaagaagactgagatcagatcaagtatcttttctgaccacaatagaatgtaataagaaatcaatagcagaaagaaaattggaaaattcacaaatatgtgaaaattaaacaacacactcttgtacaatcattgggtcaaagaagaaataaaaaaagagtttagaaaataccataagacaaatgaaaacaaaaacacaaaatactaaaacttaaggaatacaacaaaggcagcactaagaggaaaatttatagtgataaaagcctgcattaaacaggaaggaagatctcaaacaaccaacctaactttatgcctcaagaaggtacaaacagaaaaataaactaagcccaaagttagcagaaggaaaaaaataacaaaaattacagcagatattaataaaatagaaaatagagaataatagaaaaacaacaaataagtgttgatttttcaaaaaattaaacaaaactgacaaacttttattaatagctagaataactgaaaaaggtaaaagactcacataaata

SEQ ID NO: 223306 - DNA, 348 bp, Homo sapiens
gaattacaggaggcaagaaccattaagggccaccttacaggctttcagccacactatgcttgatccaagccatttcctatggttgtgtttgcagtgagcaatcttgaggaatgaggtaacatctccctctgggacaaaaagcaatctcactgcttgttataatagcagtgggttccccaagattattgttgttcgtcagctgcaatgcaaacccactctctaggcccatgcatgtcgctcctgtggaactggggacttgggagcaagagaaactgatacaaacattctgatgggcatggcttttttttttttcctgtactgtgaataataaacttctttttctctggc

SEQ ID NO: 223307 - DNA, 460 bp, Homo sapiens
tagggtggctactctaaaaacaaaataaggcaaaaacagaaaataacatgttggtgaggatgcggaaaaattggaaccctcatgcactgttggtgggactgtaaaatggtgcaacttctatagaaaatagtataaagtgtcatcaaaacaattaaaaaaaagaactactgagatatggagccagccggacttcgtgggtcgagtggggacttggagaacttttctgtctagctagaggattgcaaatgcaccaatcagcactctgtctagctaaaggattgtaaatgcaccaatcagcactctgtaaaaatgaaccaatcagcactctgtaaaatggaccaatcagcgctctgtaaaatggaccaataggcaggaagtgggcggggccaaataagggaataaaagctggccactggagccagcagcagcaacccggtagggctgctgtctgtgatgtgca

SEQ ID NO: 223308 - DNA, 657 bp, Homo sapiens
tgagtgaggcggcgggaagggagcgagggaagagcggcagtgagaccggggagacaagggacttgaagactaggagggaagaaacagcgaggtgaggtgcgaagagcagtgccagaactttgtatcccaggcccatctccttcccccttcgttttcctcgtttgctattagagagaataatatttctcaccgcgtacctgtgcctggacccggaagggttgccgctggggacgggaattcgaactggcactggtggcctgtgaagggaaagatgtgatgagaaagaccaaaacctgtcttactgacagttaacttcttggaatgtgaatttttttagttaaataatcatgcagtctttgactagcactaagtgcatgagtgtttattccctgaggatcctaagggctgaaattcgaggtcaaatgtgactttgctccctgattggacaaacagttccctcttctgtaacagctttagaaggaacctcagagagtcccagagtcaaaaggtaaacaagagatgaagtaatctgcgtctctgccgaaaatcgtgctcctgagattcctcatcagaattgtcaataaaattgcaatcctaatttacttaggtagtcattataattggcactgagctgtgggatggatgagtgggattacc

SEQ ID NO: 223309 - DNA, 460 bp, Homo sapiens
gaatagaagctggaagaagtactggattctagtggtatagcaatgtttagataccagctagaggatttgatgactgaggatagtgttggtagcagtaacaacagcagtcatagcaacaactatgatttactggtttcttattctaaaccaatcagtattctaagcactttacactactttagaaaactcgtttaattgtcatgacagccatatgctgtgtgcactattatcactttcatttggcataaggggcaggtaaggtacaaaagagtaaagtgacttgtctgggttgaagaggttatttttccttgcatatttgtttaataagagagcaccagaacacatttgtgtgctattagaaatgatctggtatgtgatgttccccaccctgtgtccaagtgttctcattgttcaattcccacctatgagtgagaacatgcagtgtttggttttctttcct

SEQ ID NO: 223310 - DNA, 528 bp, Homo sapiens
gtttaaaatttattgatttttaactgggaagccaacacaggctagctctacctggctaatcctgaatctgcaaaaagtataaaatgtgtcagaactgctcctgagaagtgaaacagagcattttgattttaaagatgtatatggaattatcaagtaaacaatatgattgcacatggatttctaccagtagttaatatgtgaattacatttaattcttcagagtattaacctactaaagcatactctgaggataagcctgtctggcaaaatttcaggtaggtattgtgtttaaagataaagaattatgtttgaaaacttgtgagttttcatatcaagaatgtttcataagctcactttcagtatacagttaagaattttagaataaaaaatgaaactacagaaattgctttagcatttttgcactagaacagtttaattagaatgaatataacaaagagtaaaaccatttaagaacaggataaacacgtattcaaaatgctttctttaggagatgatacacaatcattt

SEQ ID NO: 223311 - DNA, 312 bp, Homo sapiens
ccctggagggtcacccaaggaaagagttcgttccaaagacaggtgctcctctgagttcctctggaatctggcaaggtgccgagcttggacgcaaggcttccatgaggctgtgaaggaggttgcacggaaactgaacctggtgtggagggccaggagaggcttcgggactgaagggcagagcagcagactccggggctcatgtaggaaggaacatgccttcagccaaagattatccacgctgcatggagactcttgctaaatatcactggggtaagactgaagaaaagaaataaactatgctacctgctctta

SEQ ID NO: 223312 - DNA, 464 bp, Homo sapiens
gtgttacgaagtattatataaatgtatacttgagtccttgtacacagtaggttctcaagaaatattcattgactgattttgacacagtcttagcttgttacatttaaggaccctaatcaatacacaggactaagacaatgacttgaaaagggtgaaattacatgttccatgggaggaagactctgaaacacactagaaggacacacccagggatatcaacttcactgaaaaaggtgggtgggactttttcaaccttgaaccttccgagctacaagagtctgttgagcccttagcttcccaacctcttgtgagacagagctgtgaatggccaccacactttgaggccatgaggctatgtaaagtatgttctcagacatagaagagaataattatgaagccaatgaatgatgcatgacagagttaatagaaattaaaataaatagaaactgcttttgctttgaaat

SEQ ID NO: 223313 - DNA, 666 bp, Homo sapiens
ccagtaaacgcctcagttatccagcaggccctctcgaggtagctgctcagaacttaaacacctggaagagtgggaaaggcctctgatgagtcagcatagctgctgctgaggctttgtgctaaagtccatgccctttcctgatggtaaagtgcccccaaatcccccagggtctctctgtcatgatttctaatttggtttttaaagctggaactacaagtcagaaagagatgaagctagtaggtattcattacatgtgtatatgtttttttaaaattcagaatgtcattgctgagtggtttgatttcccagcacacaatgggttagaaataacaatgtagaatagagaattgggatgagaaggctggagctagaagcaatgagaagggatggccaatagtagctggcaggtggaagaatcatagtctcttcctgagcagcccggagttctgtgcctgggaatccagaacagtataggactttcagaaccatgtgtgacctaagtggttgacttgtgggtttttatccaaaatgaaatggttgggcaccaaagagacagaaacaggttatcaggaaactagtcattgtggaacttcttggtccctaacaatgcttactggttgtgggacatgtccataacttttccatccttggtttcctcatctttat

SEQ ID NO: 223314 - DNA, 446 bp, Homo sapiens
ttcagcatgacacagctactcacagggaatagactctaacacttagcatcaaagaacatgactgccactttccttgaggatgtattaacaggataccaggttcgttaacatccatggccagaaacttcccttttccaagttctgtgattcaacagcaacacttaaggcactttgagactgactgagtggggtgggaagtccctggagttttccatgcgggtgttacatgataacagacacgtttttaaagcatcactatgcctacagtgtaggaaaatagaacaaagggcaaacatggatacaggaagacaattgaggtttcagagatgagaaacaaggatggcttgtgtagggtgtggacacaaaggatttggctcatggatttggcgtgtgttagcaacaggtgtagagtgaaggataacttattggtttgggcccaagtgaat

SEQ ID NO: 223315 - DNA, 446 bp, Homo sapiens
tcagcctcccgagtaactgggattacaggcgtgtgccaccacacctggctaattttgtattctttagtagagacaaggtttcgtcatgttggccaggctgatctcaaactcctgacctcaagtgatccacctgccttggcctcccactgtgttggggttacaggcatgagccaccacactcggccattctttccacctttaccatcaacattagtgatgaagtgtgtacactgtattgattgatgatgattctagtgcagtgaagatagtggtaaaattaatgcctaatcaatatgtacagttaatatcaaatacgccagactctagaattcaggtagatttttgttaagaaacactaaactaatgacaagagcaccaggctcagagcagctcaaagacctaagttaaagtgtcttcactgccacctccaacagcacttcagggca

SEQ ID NO: 223316 - DNA, 596 bp, Homo sapiens
gtaaacaccaaattagtacatcgcttccataccaattgtaataatctctaaattcttcatctgtttatcattcataacacagtaatcattcttcctattttcacaaaccatttcttatataaatttcctaaactttacatttcctttcactttaaatagctcagtaactttctaattttttcatccacctgaagttaccgggttactttcttcactgtctcattcttttcttttttaagacaggggctccctctgtagcccaggctggagtatggtggtgtgatactggctcgttgcaacctctgcttcccgggttcaagcgactctagtgcctcagccttccaagtagctgggactacaggtgcacgccatcatgacccactaattgttgtattttgagtaaatatctgtttattccatagtaaggatagatgctagacaggttatgatttgctttggttctactcccctactttggataggattttacctaggtggagcattggatcatgttcttgagctgtgtggactttgatttgcttatgtgcatgcttcacatctgctgccagccctctgttacttaccgcggtacgaga

SEQ ID NO: 223317 - DNA, 444 bp, Homo sapiens
ctagggaaatctaggccaagacagttggtgccaggcatggtgaaaatcctgacatgcagtagcatcccagtcctaagatcctcacctgtcttggaaagtgataaagtatgagcagaaggtggactatgaaattctgtgctctctgtgaaatgtgcacagccttaggaaacggtcattacaaatatggagttgaatgacttctgttaactgtttttgaaaaccttgaaaaaatgataaactcagattggataactatcaatccaaggtagctgtgaaaaccaggggctctctagggcagcatttgaggaggccttcatttccaacatggcagatagagcaaaaaaccaggccaaggatttcactttgagggtagaagggtggcaaaggagatgaaatgcacagtcttagcagggctcctatgcccaagtcaggattctgaaagaa

SEQ ID NO: 223318 - DNA, 381 bp, Homo sapiens
ccccggccctgcccccacctttgagagaggatcccctagccaggtgctgtttgtgcacccaggcttctcaccagaaacgtaggcatcccaccaggaggggagagtgtggcccaacactagctttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtagggatttgcgcattagatgagagaatttcaagcaaaatactttgagttttacaaagatataaaacacctagtaattat

SEQ ID NO: 223319 - DNA, 633 bp, Homo sapiens
ttaatttataaatcagcaaatagaatggaatctctgacctcaccccaaatctgtatttggtggaagctgaatgtaaataaacagatgaaccagaagaacaaggaagcaaacaacattcatgatcaggaaagagagtgaaatcaactagagtatccacagaatccagcctgtaacatcagcctcattagcacagccccaagggcaggagaaattatgttttggggcaacaaggatgagataagaaacttgataatgaccatctgctgctgatgtcaggtctaccttaagcaagggagcagaagccctggcaatgggcacacacgcggatgtgttccatgtggtgtgagagtgtgtatgtgcgtttaaagtactgtgggtggtgcatttaatacggcacttttctgtccaagaaaatcatatcccctccaaagccctgaattattgaaatcttgaagtttctcacatctgttacgagccttgtatcaccatttccgcacgctattgggtgccatattctgtgtctgaggttacaggcatgccagaaccctcccactgccaagctgggagatcatttgttatttctgtagccataggcttgccaaaacctggggagcttgattctgaaaggagcca

SEQ ID NO: 223320 - DNA, 495 bp, Homo sapiens
gaaattccagctcctcggctcctgtgttctcataaaaaaatctaggcctttgggtcagagattcttttgaagaccaccctgctggcaatcctccaagcaagcacaggatcccgccagagacagtgcagcctcctctgccagccaactggcccctctcatcctcttctctccctcagtctttgttttttcttaatttaattaattaattaatttttgtttgtttgtttgagacagggtctcttgctctgtctcccaggctggagtgcagtggcatgatctcagctcactgcagcctccacctcccaggttcaaagtgattcctgcctcagcctcccatgaagctggaactacaggcacccaccaccatgcccagctaattttctcactttttacaaacatgcgggtcttgcccaggctggtcttgaactcctggcctcaagcgatcctaccttggcctcccaaagccctgggattacaggcgtcagctacaactta

SEQ ID NO: 223321 - DNA, 164 bp, Homo sapiens
agccctgtggccagagaaagcttgattcagctgaggaaatcagggccagggattgtagtgtggctctctctcgagagtgctgtcaaacatgagggcagaggaggcaggggcaagatcactcaaagcttgcaatccacatgtttgaaagatttcttcctttgctg

SEQ ID NO: 223322 - DNA, 509 bp, Homo sapiens
gtttcattaaagaaaagcatttcagtgagagaaattcctctaggacaggagtcagcaaacttctataaagagccaggtagtatgtatttcagatttgtgtgtcataccatctccattacagcttcttagctctttcactgtagcatgaaaacagcaatcaacaatacaagtaaacagatgtggctgtgttccaataaaactttatttataaaaacaggatttgtcctggtagacttgccttgaggaaaatagtttgctgacccctgctctcaggaggataaaacatgttctggcttcttactggcaaaaaagaccaatcttcagatttgaacataaaataaacaacaagtacttaaaggaaaataggcaatcaggtctatccaggataaaccgaagaattcgccagcatctgttgaattgcggcaggattgctgtacagccttccttgataattagaacatccacatctgcttcctcctcagtggtttacataatgaaggagaaaacag

SEQ ID NO: 223323 - DNA, 553 bp, Homo sapiens
atgaaatttggtgccgtgactcggatcgggggacctcccttgggagatcaatcccctgtactcctgttctttgctccgtgagaaagatccacctatgacctcaggtcctcagaccgaccagcccaaggaacatctcaccaattttaaatcaggacaccactgaaaatcggactgttcaactcacctggcagccactcccagagcccctggaactctggcccaaggctctctgactgactccttcccagattttctcagcttagcagctgaagactgacgctgccggatcgcctcggaagccccctagaccatcacggacgccgagcttccggtaactctcacagtggaagactcagcccgcctgcacccaggtgaaataaacggccatgttgctcacacaaagcctgtttggtggtctcttcacacggacgcgtgtgaaatttggtgccaaaacccgggtacatcttcctgaatcaggcttctgagaactgttccactttgcagtcctgttggatctatatcttgagaaataaattaaagagcttttccctcc

SEQ ID NO: 223324 - DNA, 366 bp, Homo sapiens
tcagataacaaatgccactcaaaatgagtttcccaaggccactggaaagatgttttaaatgtttgcaaaacagcattttacattacgcagattcttccttccaccattttgagctaagagttgtaattttttggctactgacgtcactttccaaatttttttttattgcacaaactacattaaaagataaaatttggggccaggcgcggtggctcacgcctgtaatcccagcactttgcgaggccgaggcgggcggatcacgtgaggtcaggagttcaagaccagcctgaccaacatggtgaaaccccatctctactaaaaatacaaaattagccgggcatggtggcacatgcctgtaatcccagc

SEQ ID NO: 223325 - DNA, 363 bp, Homo sapiens
tgatccaccacccgccttggcctcccgaagtgctgggattacaggcgtgagccaccgtgctcagccaggaaatgttttgaaattagttttgtaaagctccaaaaagaaataaaattattgatatggtaatgtgaactttgaatcttcaggaaaggaaaagtagtatggatcattttctaaacttttttgagcacagaacccttcttcctctgatcatttcataggaatacactgtgggaagtgctggatccaactaccgctaaaaatgaaattaaatcaacatggagttgggagtatgatggtgggaaataatttccgtttctctttacagatttcatggagggaaaaaaatttcagtaagac

SEQ ID NO: 223326 - DNA, 538 bp, Homo sapiens
ccctattggattgtaaactctgcgaagacaggaaccatgcctgccttgttgacagttgttttagcagagtgtctaacattgtaggaacttaaagttgaatgaattgagtgaatgcattcataagagaaggaaggaatctaacatttattgagcccctattttttgccaggtactataaaaagaattttgcacttttattatcaacactgtgattcaggtaaaaatgtccccctcctttacaaatgttgagtcttagacaggtggtataacttgcccagagccaaatagcaagtgtcagtaatagttggtttgtctaattccttttttatttagcatagtcataattaggacatttaaaataactttgtaatattttactttcttaagaaatctcttttgccgtcttgtttctgtcaccctttctttttgaagttatggaagtaaacttgaaatgatcacagaatgaatttttttatattcattcttgtattaaatattaagaaattttagtttatgaagtctgtgttattgaggatta

SEQ ID NO: 223327 - DNA, 437 bp, Homo sapiens
gtgcatatttgtatgtgtgactgtgtatatacattaatatgtgtgcttgttgtacgtatggctgtgcctgtgtatttctgaatgtccatgtgtattactggctgtgtgtgagttggtgagtttgaggatatttgtgtggaatggatcattctttccccaggccagaaggccaaggagatgctaccaagtgcttgaagacttgatgtcacattcttgactacacccacccccctagaacttcctggcatctcactgtgatgcacaggcatggcaaaggataacgcttaccttaccctggagagaacacactttctctagcctcagaaactaacccatcatacttctggctgcattatcaattttcaattaagacaccaatttctctgaccctctgaagacaacagcatggagcctgagtaataaagtggagtgggttc

SEQ ID NO: 223328 - DNA, 330 bp, Homo sapiens
cgactgtaaccatgctagcaaacttagtaccctttactgtaaccctgatatcttttctgctgttagtctgttctctgtgtaaacatctcaagaagatgcacctccatggcaaaggatctcaagatcccagtaccaaggtccacataaaagttttgcaaactgtgatctccttcctcttgttatgtgccatttactttgtgtctgtaataatatcaagtttggagttttaagaatctggaaaacaaacctgtcttcatgttctgccaagctattggattcagctgttcttcagcccacccgttcatcctgagccagaatcaaaaaaaaaaa

SEQ ID NO: 223329 - DNA, 586 bp, Homo sapiens
cacacttaatgtgattattttttgtcttcatagggtgacttcaagtcttttttaatgtgaaccttacagtggggtttgttctgaatatatttatttgcatttgatatagagaggctcaaaaaaggaaaactgacggacctaataaaataaaaaaatagtagttgaataaaaaaatttctggagggacacacaaataatggttactctctctgcatgccatgggagatagtggtgaagggaggagggacacttttgcaattcatttgatctcttccacagtatctgaattatttgcaagtatacgtattccatttgtaataaaaaagtaaagactagaaattctttttggaaaactgtacatactgtagaacatggctctgtgttgtttgtctctggatttccagtgactatcaaataggtgctcaagaaattggataattatgtgaatgaattcatgaattgaatgaatgaatgaacagactatgctgttctgtttgaaaataagtatggacttacaagaatgaaaagtcttcaacacttggaatatgttttcaataaagatcaggcctctcatctataataattc

SEQ ID NO: 223330 - DNA, 254 bp, Homo sapiens
tgcaagggcaatctctttgggataccaccattagggtaggtcagtgccatctaattttagttccaagattcaaattccagagacagctaactggcctagtgtgggttttatgaccaagccttgtttaaaagagagctgggtaaaatttacgcaaaatgatctgatataaacagacagactaagagatggattattgtatgtgatgcaataatcctgagtgtgaaacctgatagaaattgtagataaatcgaaag

SEQ ID NO: 223331 - DNA, 551 bp, Homo sapiens
  misc_feature (550)..(550): n is a, c, g, or t
tacttttcattctatggctatacttatttatcactgtctgataaaagcagagataagcaaactgctgcctgtgggccaaatccaactcatagcctctatttgtaaggtctgtgaatccaaaatggtttatttatctttaattagaaagaaaaaatatcatacaaaaaacattccgtgaagcatgagtagcatgtaaaattcaaacttcagtatccataaggaaagttttattagaacacaggcatgcccatttgtctatacctattatgctccaagagcaggcagtgttaggtagttttgacaaggacttcatgggtccacagagcccaacatttactatctgatctttcctgcctgagaccatctagagcaggctcttcagcactgggcgccaactatgagcagacaattaccagaacattcatgtctaaggtagaaaactaaagccaggtgcagtaatcccagcactttgggaggccaaggaggaaggattgtgtgagcccaggagtttgagaacagcctgggcaacataataagaactcatctctanc

SEQ ID NO: 223332 - DNA, 378 bp, Homo sapiens
taaaataactcacataagtgtcctttttgttcacaaggagcctctcttgaatacatctgagtttatgctaatgaagcgacttagggtggggccccaaaaaggcctcaggatcaagttggttaccagaaagtccaagtaattagaaggtggaaactttctgccccacccactcacctctgtatacaaacttgaataattagatttgatgagcctccaggtgaatacatcaaagtgctgggagggtagcacagctggagagggcatggaagctctgacccctccttcactgaattgtttgctttataataaacttgtaaatttaagtattgtttttctgagttttatgagatgttctaataaattattgaacccaaggag

SEQ ID NO: 223333 - DNA, 405 bp, Homo sapiens
tcaaaaattgcttcttttattgttttgttcattattatttagaaggaatttggaatctgattgagcaaaataaaggacaggcagctttccatttaaggctatggataatatccccctgtgaatgaaaatgtattcctgcatacagatttgtaggatggtgtttactcagtatcatacaaagcacttctacaatgtgggtcaataaacatgtgcagaacacttagcttgacagattttatgtaaatccagaaagaaacactggatgtcttatttcactaaaaggaaattaaagcaactgttttatatgcccaaaacttgtgtgtaattgatagactcacaatacaaatattttcacttggaatcaatgtaaaattatgcaaaattgcaataaaaactttaaatgaa

SEQ ID NO: 223334 - DNA, 444 bp, Homo sapiens
agattggaggataccagcacattgagggaataggtaccacactgaaaccaggtgaaagaatgattgcctgctgaattttgagacctgctacttcctgcctcccactagttctcagaatcctggcaactgagcatacaccctttagcatgtggaagaaccttccctgggaatctgaccacactaagaagagaaagagccttagaaaataataagccatatcttttgcctgaattataccataaggataggaaggtcttcgtgtaatgcaactcaggcaaaattgggggtcatgtaacaataatttcctcaatatctaatctataaaatatttttgctaaaatcatctacaagatccagatcataatcttgaggtgtttttctataacccatcttagatcactgactagagctgcatgagttgtctttcaaaaagaaaaaaacacc

SEQ ID NO: 223335 - DNA, 476 bp, Homo sapiens
aataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctca

SEQ ID NO: 223336 - DNA, 587 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncntgcctttttggccggggctcccaaaatgagttttccaggagattaggtaaaagttccaaggtttcttatgacctagcctcagaagtcccagaacatcatttctatctcaatcaattggccaagtaagtcactaaacccagtccagattcaagggaaggagaattagactccacctctcaacaggagaaatagcaaagaatttatagcaatctctaccataatatttatacctattaaataagaaatgtaagaaattgtctcaaggcagttactcatgtgagttagaatagagttgacatttgtgggtgtttggctcttaatgggagacctatttctgccatgacaaatgattcctctggagatttgttttaatggtacatgggtcagccaatagaaaaactctaggcatttgaaattcaaatgctggatgttctctataaaatgctgtctagctatcatcttttaaaattccagctgaggttctcctgaaagtttggtaatgagacaccctgttcctaacagaaggaaagggctctccttccagttacctatcatccctcatctttaacctctcta

SEQ ID NO: 223337 - DNA, 460 bp, Homo sapiens
gaagattgtgttgaatgttttaaaggccagccctgtacaggctgcctgactagaatccagtgacatgactctaatctaattggtgagcatggagtcagtctttgccaaaagagaaaaaggcataaaagaagggattctactgctctccccaaatccttgaagacttgcactgcacatgtaccatcttggccaggagtgctggtgaaggggtttggatggggaggtaatgtcctcacagtgatgacttctcatcatctccactagacagtacacagagaagaaagactggggaaaaggtcaccatttcagccctggaagggagctcaggaagatgaacctctcactttaagctcaaaccaagttattttgctgcttcttcagaatctggaggaagagccaggcttgatgcaagaggctcctaactcctattgcctggcattaaagacttccttccatctgt

SEQ ID NO: 223338 - DNA, 350 bp, Homo sapiens
gctgcaaggaagcagcaggtttctgggacagcccaagggcatttcttatttcctcctgttcctccctgggatcaatctgtaggagtaaactgactgaagactgtgaacaccttcatgaactcctgtgactttggacttgttttccaaaaggccaaaattatagatatgtacatattttgattattaaaaatatgtgtttccttgtacattgttggtgagaatgcaaaatggtgaagctgctatggaaagcagtatggagtttccttaaaaaattaaaaatagaattaccatgtgatccaatcaataatcccacttctgggtatttattaaaaagaattgaaatcaggatc

SEQ ID NO: 223339 - DNA, 404 bp, Homo sapiens
atatttggtcatgaaaattcttagaaaactgtgaagcgtcaaaatagatgggaaatatgattatatagcatctaaatattagaaccaactagaaaagaatataggtatcctatttttaaatgttgttataataaatgggttcagagtctatcaaaattgcattttctttggtccttttacatgctgagaaaggatctgtaattggcagcagttccgtgatagtaagcaacaaagctacttgtgatttagacaaatctaacagaacagcaaacatatatacacattaatactttatatttttataacaaatatttcaatgtaataaaaccatttcatgtgctgatcaaaacaccttaccataatttgtcattttgaataaagcaattttatttaaattttaaaaa

SEQ ID NO: 223340 - DNA, 453 bp, Homo sapiens
tccagtcctagtaaacaaccacatgtttgttgtcacttcggctggctctgagctcatttttttggcccctttttctagctttctttggctttatgcagttacagtgtcattaaggcccataatattccctgcagtaatttaaaacagccagattataccctgggattaactgagtggtttttgagacatttattgtggtattctcccaggaggtttgtattattgttgtaaaatgttacatcccaaactaaataacccttctgcagggagaagaaccagattgcactgacttcttaggatcattaagtggaaaggaaaagtttttcttagaaaacttatgggacccagtcacctgtatggaatgtatatctcagacaagatgagagaaacagccatgtttctgtcacattgtttactgtcatattaaagatatctagttttaaaatattcagt

SEQ ID NO: 223341 - DNA, 509 bp, Homo sapiens
agaggtcactctggctttcttccctggggaagtcagacagagtcctgtgtgctctgagcagtaccgccaaggcttcacgaaaagagctggtgctggcaagggccctggaggatggctgggatttccccaggggcaattccaggggcacaaaatggcttgcttgggcgaagactttaagacaggacaggacaagggtgtatttgggaagtggatccagtgtgtggggacttcagaggttaggagacaagcccagaccatttccttcacttagactagcatttctctaagcatggttcagaaccctggggtcccaagaccaaaactatacaaagccaaaactatttttataataatactgagaaattatttgcctttttcagcgtcttgatatttgtataaataatgcaaaaacaatggtgggaagaactgctagcagtttagcataagtcaaacagtggcaacagtgggtattagtagtgtttgtgatttaaaaaaaaaaaacaatgaaa

SEQ ID NO: 223342 - DNA, 330 bp, Homo sapiens
cccagtggctcaggctaggggctttctctccaggcaaagctgtttgtgtcctggcttaataaagctccctggcattgctgccccaggggtacactcacccgaggaaaaagtccagactgacaagaggctctgggagacatggggggcaggggggctcatatctctgagctatacagcgaagccctgcagatgtttaatattggatcgttggctgggcatggtggctcacacctgtaatccaagtacattgggaggccgaggcgggtgaatcacctgaggtcaggagttcaagaccatcctggccaacatggtgaaacaccgtctctacta

SEQ ID NO: 223343 - DNA, 406 bp, Homo sapiens
ccaacatggtgaaaccccatttttactaaaaatacaaaaattaggcaggcatggtggcgggtgcctgtaatcccagctactcgggaggctcaggagactctcttgaacccaggaggcagaggttgcagtgagcctgagatcgcgccactgcactggcaatagagcaagactctatctcaaaaataaaataataaaataaaataaaataaaataaatccatccatgaccaaattaatgaaaactgcagtacagtggaaataagcttatgatacaatgtccatccaccaaattgcagctcagggcttaatttttctaagaaacttttcctggtacattacattaaggagatgctcacctcactttcatttaatatgtagaacttcctggcttgtccatgctctgtagt

SEQ ID NO: 223344 - DNA, 340 bp, Homo sapiens
gaaagataatgtgtccttgaataaggctggagaggaaaggagagactggagatacaaccaaaagataaaatcagaagaatgtggtgactggatgtggagcagtaatcaaggatgactcccacatttttgggtaactaggatgatatatgtgatttttaggatggtttccaacaggatatctttaactgtagatggtgaatacctgttgtctacatagtggttgacaaaaatggagcagtgttgttttagtttctctggaatataggattgaggcttgtctgggtaatttttacagaataatttaagtaggctgggcatggtggctcatatctgtaatccc

SEQ ID NO: 223345 - DNA, 540 bp, Homo sapiens
gtgtgtgtgtgtgtgtgtgtgtgtgtgtgtgagagagagagagagagagagaggagagagagagagcgaaagttgggggagagagaaaaattgattataaggaattatcttacgcagttatggggcttggaaaccagcaggctggagatccagggaagagttgatgttgcagcatgcgtctgaaaggcaatctgaaggtaggattttttttttttgaggcttccatacttttaaggccttcaaccaattgaaggcattatggaaggtaagtggctttactccatgtctgctgacttaaatgttaatcatatctaaaaaacaccttcacagtaatatgtttctttctgtattgggattatttcacatagcataatgtcctccaggcctattcacattgtggcaaatggcaatatctcattctttttcaggactaaataatactcctttgtgtatatgtaccacagtttattcatttgtctgttgatgaatacttagaaggaaaaaacattgcatgatctcacttatatatgtggaatctaa

SEQ ID NO: 223346 - DNA, 760 bp, Homo sapiens
ggtatcacacagaatttgcacaaaacaggcacttgtcaacgcttgttgcattaaattaagttcacgtagacgcataataatgctgtaaaacgtagatttaaaaaaaaaaaaaagtccccaaaacagagacttcttgactgaactatcataactgtagccatcccttaagtctttgtgcctttgtgctttgtgcctgtcagatttttaaaaatggaaatagcaatagccttatacttcagttggaagggcagctgggtgatggcaggaaggccacatcctcttgagtagcaagccttgcgattagatgccagcttgatcagacatagcctgtgtgattcagctcaaattacataacctcactgagacttcatctgaagataaaaagacctacatacctcctggtgtgaggaggtagttaatgagaaacaaaagacctgcctaacaccagtacccagtatgttcccagcaaacagtaattatgacctgaaagtgagaagaaagagcagctgcacagacctatgcatcttggttatattaaacgtcccaaatatcaatttctttttctgtaaaatgagaacattattttttaccttctagagaggtgttgaagagatgattaaatgaaataattaaataagagagctgtagaatcataaagctattgcaaacttaaatataaattcactccttcaaagcatatatattgaccccattccatgccagacattatcacgtatgaataaaaagtaccaagtggtgc

SEQ ID NO: 223347 - DNA, 500 bp, Homo sapiens
tagtatcttgcattaatcaaggcagtgggtccaaacagtactagtaattattatcttcttcaccaccatggacaggggagggagcatgaggaagatatttaagaatacttaagaatatccttcatgaagtagaaaaattattaattaaattttgacccttgggtacatatttttattatattttgtgtgacaaagtgggaaattctcaaaaagattagtgctacaaagtatgatggtttcccggtgaagagacacttaggtgattgtttgatttgcaaatgcaactaggcttttttcatgaaaggccatttggcacattttacctacataacaaacctgcacatcctgcacatatacctcagaacttaaaataaattaaaaaaagaagaagacatacatgcagtcatccggcagtgaaaaaagctcaatattaccgatcatttgagaaatgcaaatcaaaaccacaatgagataccatctcatggcagttagaatggcat

SEQ ID NO: 223348 - DNA, 478 bp, Homo sapiens
cttgaatagataaatggcaccttggtcattggaagtcttctgtgaagtgaaggtagtcacatggttgtgactctgctcatagagttaatattacctaaacattaaactaagctaaatttaaggcagtggtacaggtgacagatcctgatgcccacagatctattttctagtgttgaaatatgtttacttgattttaattttatattttaaataacatttactgttttaaaaaaccacttacctattatagaaaacttaagaaaaaactagcacagcacaaagactatcattaaaatcactcacaatcctaacacctaggcagagtgaaattggttattttttcagagaagtgaagcagattaggtttaacagcatttctagagtaacttctatgatatgccagaagggctcccacaagtgcagctgagtatctgtatgatgtggtctgagtggcaaatgactcaagagttccttcatt

SEQ ID NO: 223349 - DNA, 627 bp, Homo sapiens
atgcatcgtgcttagaagagacatgttttcatttaaaacagtctgctaattctttctcttgctttcattactccaaattatatgtctcttcttttaacagccaacaaatggctactctgattaaggaggcccttcattatccttcttcctctcacaccgttttataaggtcatttatatggtttctgtgcttacaaattcattgagcatttactcttatttataagtgcagtaggaaaaaaagaagggataaatttagaatgttaacacagaagtgttttttgtttttgtttttgttttcttgagacggagtcttgctctgtcgccaggctggagtgcagttgtgggatctcagctcactgcaacctccgcctcccgggttcaggtgattctcctgcctcagccttccgagtagctgggactacaggtgcacaccaccacacccagctattttttgtaattttagtggagacagggttttaccatgttgaccaggatggtctcgatctcttgacctcatgatctgcccacctcggcctcccagagtgctgggattacagacatgagccaccactcctggcaagaagtgttttttagatggctgacctgaactctggcaggtcacttt

SEQ ID NO: 223350 - DNA, 514 bp, Homo sapiens
caagatagcagctataaaaacgagatttcgatcgctctgctcccccacccctcttggtgaaagttgcagttacaaaggggtagttcttttttctttttattgtggtttgtttcttgttctcaaaagcttattacattgggtgcaaacaacaacaaaaatgccataaaaaggcaagaatcgtaatatgcttaagagctaaaaagacctatggtgttggtttaaccaatgaaaatattcctgcaggtattgtaaaatttatgtgccatatgaaaaacattaagggtgttgtttttttcacagaggaaaatgttcattgttgagccattttgtaaattattttaatgctgcatttctgcttaaacctcatgattttgatatataagccagtttaatgttttctatacagaccctggcttttcttaaattttatatattggaaagcccatgtttgtattggaaactgctggtttctttcatactgaaaatctgtctcgcgcggcgtgatgccatgtgg

SEQ ID NO: 223351 - DNA, 451 bp, Homo sapiens
cactgtgttagccaggatggtctcgatctcctgacctcgtgatccgcctgtcttggcctcccgaactgctgggattacaggcatgagccactgcgcccggcctctgtactttatattaatcttaattccttgaatatattgtcagagcctttggtggaaggccatatctgatatttattctgcttccccatcaccttctagcatgatttggagctgacaatagacattagtaaatattgttgatggagctatgacaataactgagcttgctagctccaacataaaacatagacatacataaagggaaaaaggaactcaaaaataaatatttttttaacaactagtcatgggaaaaatctaaaagatgctagcatcagctttataatcttttccaattgggaagatcaaattatatagcctgaatcagagtaatagctgagtcatcattttt

SEQ ID NO: 223352 - DNA, 441 bp, Homo sapiens
ccaatttaatggtgactacaagtcaaggggcatgcagtcttgaatgggggtccgttcagttgttttaaaggccaccatgccttcgtgacatttgtagaaatgtgaaaaatcagcaacaaaagcagatgctgagtggagggaaaagaaaattgtgtttgttgcatgtctttagttttgctgcacggaggtgagaagcatttggtggtgttttcataaggcttttagtttgttggaaagtgcataagaaaatggaagtttgcccagaattgggccaagccattttcaaaaatactctttggtttggtattttcataatttgaaatgtttgtattagaagatttgactcatatgtaccatagaaactgtgtttgagaagttcagcttttatttctcaaggtgtgttcaataatatattaaaaatctgtgtaccaagaactttca

SEQ ID NO: 223353 - DNA, 505 bp, Homo sapiens
ggtactacactgttatcatgttttattttggggagagaaggagaatgttatgggttgaattatatcctccaaaaagaaatattgaagccctaacccctaatacctcagaatgtggccgtatttggaaacagagtcattgtaggtgtgattagttgatacgaagtcatgctacagtagggtaggcccttaatccaatatgactgatattctaaaaaaagaaagagacacagggagaagaatgccacatggagagaaggagatacacagggagaagatggccctaaaacagtggaggcagattttggagtgatgcatctacaaaccaagagatgccaaggattgccagctgttagtccatccactttgtgttgctgtaaaggaatgttggctgggaatggaagctcatgactgtaatcacagcactctgggaggccgaggtgagaggattgcttgagggcaggagttcaaggcctgcctgaacagcatagtgagaccctgttcctaa

SEQ ID NO: 223354 - DNA, 480 bp, Homo sapiens
tacatattcttctaaatgcttctgtacatatataacataaacactttttttacataaacagaatcatgcataacataaatagaatcatgcataaaaaatagaatatttttaccataaatagaatcatacatacagttctgcacctcgtcttttttacttgaacaacattacaaggtgtcagtacctctagatttctcaatttttttttttaaatagctccatggtatttcagtatatggatgaactgaaattgttctctccagccttacatatatcctttatgcaagtaatttcttaggataaacttccagaagtagaactgctaagtcaagggtatgtacatttaaagttttgataaaaattgccagccgtccatttttggctcacatctgtaatcccagcactttgggaggctgaggcaggaggattgcccaggagttcaagaccagcctgggcaacatagtgagaaccccatctcta

SEQ ID NO: 223355 - DNA, 142 bp, Homo sapiens
aaggagtttcccatctagtagtggaaatggacctgaaataactaaacatttataaaatttgcaaaacatgtatcattacaaattgtgctgcatgctgaaaggaaaggaacagagaggaccctgtgcgatggctcaagcctgt

SEQ ID NO: 223356 - DNA, 404 bp, Homo sapiens
gtcaaagtctctcctagggtccatcttggggccagagttacctaacagcatgcacaggtcctgcagtccttagtcatgttaagcagggaaatgaaaacctgccaatatggaaagaacacaaatcaccccttctagaagattcagcagtgttttccaggaatagtcctctgacagtacctgataaacaatgctcttctcacctctctccttcccactgccaggccacctagagatgggaacaacccagctaagaactcctaaaactcgtttcctctccctctctgtgtatgacttgcccaaatggtgctcagggagagcttaggaacccaggccttcgggtcctcagatgaagcccttcaaggcctgggacgggctgtggggaggggctggctgctcaccatggc

SEQ ID NO: 223357 - DNA, 459 bp, Homo sapiens
ctttacttctctctgtaaaatgaggatataatctacaaatagggtaattaatattaaataaattaacattatatatatagtaggcactcaagtttgttaaatcatattacctgaacagaaatgtcaacttcaaagagtcaaaactgactgttttaaacccgcctgaggcctagaaggttggcctcaattctcaatgtttcagaatgggctacttacaacagaaccttgaattatgtatgagagctcatcaactgattgctgacttctgattcttcctgagctagaaactactcacatgtcctctgtaaaccatgacccgagaatttgcttggagcagtccaacttggactttttcctcttcttacctctttctcttcttgccctccccctaggccaggcatcatctcccttaaccagtctaatccacaatgaaaataaagtcactttcagcttctcaat

SEQ ID NO: 223358 - DNA, 342 bp, Homo sapiens
tggccctcgtagaggcggtgccctatagaaagccgtggctccaagctgcgcagagacagttcttactgttatgtccttgctcctcttccactgtccacataaaggccccatgaggtggttctcaatcccaggacccatcagatcccagaaaccttttatcgacttgttctcagtgatgtttaaagaattgcagggaaagggcactcactgggatgagaggagatgggaacacatcaaatacatcttgaactctgctgaaagccatggttcaccagaagcatgtgcagtggtaacacggccagcttcatgtgtgtgaggcggtccagggagcacacaggttta

SEQ ID NO: 223359 - DNA, 506 bp, Homo sapiens
tgcattttgctgatgttcagaaatcaagtagcagggaatataaaaaattctggcctcaactatgaaatgagttgccactcaggtcataataagtgacttttgagtatgacaaaattaaaaattaaaaacccagcatccttatgtgtatgaagcattaagtcagtgagctcttgaagtggttgaaaagaatgagttcttgtagaaatcatcgcatccacagggaactgtgagccagcttgagacacatcaaggtactgagtatggagattccacgatggcttcaccttggctggcctacaaatgttccatggaattaaatctggagcaagctcagttatgatgacatcaacccaagagttctggtctattatcaaagcaagtcattgaagtctctctattaatgggaaagagctcaccttctctgccaatggccctcccgcaatgagttcacatccgtgcagctctttgtaactctcaaaataaaataatttctttaacaatgcttg

SEQ ID NO: 223360 - DNA, 385 bp, Homo sapiens
gaggcaggtaggtcctgtttgtatggctagtatgttcattaaatatgaaagtaatggaaagatgtttatgacataaggagagaggaaccttcgcctgtcaggataatagaaattgaaagatttttatgacctggctcagcagaaaaaggagtatatgatgttagcaattttttagaattgatttttcagaagaaacatgcaaaacaaatgagaattaagtagctagaaagcctttttcccccctttattcagataaagtaactgaagacttttaatgagaagcctggtttctgtctttctacacggtgcactgggaatagtaagctgttagaagtcagtgcttagaagtacctaccatcctaaacacaggaaccaaaaacaaggg

SEQ ID NO: 223361 - DNA, 499 bp, Homo sapiens
caacaaggggtctctgactttttttcattgaattcaacgtgttgttctgggtctgtcagccagaagttagtcaataagaagttggcaaattttaaaattatgtaaactggtttcctagctgtcttgagagccagagatgtccaagaacctggtttctgctgtcaaaggccttcaatcgcattggaaaaagaagccccctgtgtgcagcacaagacagctactcaaaaacttgattacagttgcaggagcagtggattggacatcaggaggcctggtgtgctccatcactgaccagatgtgtgcccacagactcctctaagcttcagtttcccacaagaaaaatacgaggcttgagcgaaatcactagttcccaaacttgcctatttgtgagaatttcctaggaagattatgcaagcacctcatcccaggagattctggtttagtgggtatgagtgggacctagaattctatattttaagcaactactctagtgaattct

SEQ ID NO: 223362 - DNA, 373 bp, Homo sapiens
atatatccccataccacccagtgtgatatacacggccctccctccatagtctcacattggagtgtctgctccatggagacacaagccttgtctttcttgtacattatgtatccccagtgcctagcacagagcatggtgcatcatgggccctccttttgcatttgagaagctaacaaatgatcaacttgcctagcctcatttcttcatttcctgccatctccttcatcccctcactgaccacccgtcctctccccaccccagctgccatcctgttcctgccactctgaaccacagacgttttccttgatacagacaccatgctcttgtaactgagcctttgcatgagtctgctctgtccataaactcctcccca

SEQ ID NO: 223363 - DNA, 454 bp, Homo sapiens
tcatttggggaacctggtatgtgcttcagtgagaactgttggatagttaccagaatcaagtatttggtatgaaaagaccattacgtttcttaaaacagtgaagtaacatgaaattagtttcaggaagattcaactgttcatattttgtggcactacaaaaactaattgagcacttactgtgtactgagcactgtcctaaagggctttattcatttaatcctcacagcaaccctttgagacataggtagcccttatgttacagatgaacttgagtcacaggggggtgtacctattggcccaaggtcacgccgtaactgataatgccttggctatgaactggcagtctgattccagagcctatacacttaaccactacactgtgtccctgtgaaggtgaattagacaaagaagatgatccttgcacatagcagtgaaggaatggtaatggatcact

SEQ ID NO: 223364 - DNA, 589 bp, Homo sapiens
agatcatcctggctaacacggtgaaaccccgtctgtactaaaaatacaaaaagaaattagccgggtatggtggtggacgcctgtagtcccagctacttgggaggctgaggcaggagaatggcatgaacctgggaggtggagtttgcagtgagccaagatggcgccactgcactccagcctgggcaacagagcgagactctgtctcaaaaaacaaacaaacaaacaaacttctcctgtagcagtttgctttgagttgtgggtgccacctccctcactgtctttttctgagggtacataaataaattgcatcctagcttgagatcaggagcaatggtttttagttctctgtgtccaacacaattcttctacacagtgtcttgcccaatacatgtgttggtaatactgacaaacatagttaatcttcttctttgaagattatctgaagcaagattttgaccttaggtcagcttcccctgaagtatgtgattggaaactgaacgagttcagattttagtttaggtaaaaatataaccagagaagttgctaccaagcatagttgactttgagctgacctaacttttggattatg

SEQ ID NO: 223365 - DNA, 686 bp, Homo sapiens
ttgatattaagaaatctgaaaaactttgaataggtagtaaaagatgatgaattcttagagctttacctcagaatgtgtaattttcatgcttttcctttctagaaatctaggaaacctgacatgggacctttggtaaatacattattattcatacattttgatggaatataactaatatgtttattttctctaaaccatagtttcataagtacaagccagacctttgatttacctaccctatcttctttactgatgaagctgaaactactttgtgatgcctattgtcccagatctttctgttaattgcctaacaacaaaccagtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaa

SEQ ID NO: 223366 - DNA, 538 bp, Homo sapiens
agatggataccgtatcgacgtggggcctccggtatgttgccgctgcgttgagtttcataagtacaagccagacctttgatttacctaccctatcttctttactgatgaagctgaaactactttgtgatgcctattgtcccagatctttctgttaattgcctaacaacaaaccagtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaa

SEQ ID NO: 223367 - DNA, 249 bp, Homo sapiens
gcactgtggtgttttggaaagggcttagcacctgaggtttcagttaagatctgatatccagtaatttatttttcactttggacaagtttacctaacctttctgaatcctattgtttgtttgtaatttggttcaccagtaatacctattggagttgggagaataaaatgagatagtttatgtcaagcacctgctgcactgcctagttgttaaagaaatattattttccttctgtaaacatcctttactca

SEQ ID NO: 223368 - DNA, 381 bp, Homo sapiens
tatcctatttccacacatcttagctcactggtgatgttctcagtaactttgaaactctagttcatctgtctcatcagatccctcaaatcccggtctcctcatagtctagggctaaagctcattccttctgatacatggtatttgttcatttaatcaaatttgaaggacaaatacctggacaaagagctccctgatctgacaagggtgaagagtgattctatacatgtggcagagaggttttcagacagttaccaccatcatgtcctcaatgatgaaaagatttctgtattcttcgagcagtggcaccctgtactctcttgggtgttccacagactaaaccatccagctacttctctgaaataaaggattaccctaatttga

SEQ ID NO: 223369 - DNA, 1175 bp, Homo sapiens
acacgctgtagagaaaaactcattattaatcttggccaagtcataaaacaaacaaaaaaagggacaataacccctggcaggagagtatcagaaataaatgctgttacaatgtattatttaaaatgtccagttttaaacaggaaagtatggcttatctagtataaaaaaaaaaaatactcagtataaacagaagctatttccaagggttcccaaatgttggacttaacagacagacttcaaagcagccaataaaaatacatcttcaaagaacaaaagaaaaccgtgtttaatcaaagcatgaaaacaatgactaatcagagaacacttaataaagagatcaacattttttaaaaaatggaaattctggagttgaaaagtaactaaagtgaaagcttcattagagggacaacagcaaacttgaatgcagaaggaagaatcagtgaactcaaagataaatcaatacaaattacacaatctgaagaacagaagtgagaatgaaaaatgaaccaagtaggaaatctgtgggttacaatcaataccaacatatgcataatgggaatcccagaagaaaagaatagtgagggccatacaagttttgacatcttttgaagagtcatagaagtttttaatgtctgaaaacattccaaatttagtaagaagtataaatctgtatatccaagtatctcaataaaatccaagtagaataaacattaaaatatccacaccgatacacatcaaaatcttgaaagcagcaagagaaaaatggacttatcatgcacaggggaaccccagtaaaattagcagctgacttctcaaaagaaacaatgaaggccagaattaagtggtataacatactctactgtcaaacaagaattctaaatccagtaaaactatccttcaaaaaagaggacaaaaataaagatcttcccagatagacaaagagaatttgttgccaccaaaattttttttacaagatatgctaaagcaagtacttcaggctgaaaggaaacaccaccagatggtaacttgaatccacataaaaaattaaagtaccagtaaaagtaattatgtaggcaaatgtaaaaaatagaaaaaatactctttttaagttttcttctcttacttaaaagataattgcatggaaaaataatgaacccatatagttataaataata

SEQ ID NO: 223370 - DNA, 635 bp, Homo sapiens
taattaaaattaaaaattttagtttcaacattgatgttatagatgagtctgattctgttgattcctttattatttgcttgaattttttcccttgcttttatagggcatctcataattattgatcgaatgtcagacatcatatcatgcatagcaggagtccccaacccccgggctgtagaacggtaccggtctgtgacctgttaggaactgggccggacagcaggagttgagtggtgggcgagggagcattattgcctgagctccgcctcctgtcagatcagtgggggcattagattctcatagtagggtgaaccctattgtgaactgtgcatacgcaggatctaggttgcatgctccttgtgagaatctaaagcctgatgctctgaagtggaacaatttaatccccaagccatctccccaccctccaaccccccagccccacttttgtggaaaaattgtcttccacaaaacagctccctgttaccaaaaaggctggggaccacagatgcatagcataatagagactgaggtaaatatcatagtatttatgtctggaaacggggatgcctcttttctgctaagctattagcttggggtggggggttgagcttaggttggtttgaattccagattaa

SEQ ID NO: 223371 - DNA, 462 bp, Homo sapiens
atagatgttacggtctgtgggggagatgggcctcaagcaaatattctcacaagtcaatgcaaaattacactactgtgcatgctataaaaggaagatttgtgttactataatgcatgtaaactggacttaggaatatcgagagaggtgcccctgggaaagtgatgcttgaactgggctgtaaaggatgagtagccttgccaggcatagtggctcaggcctgtattctcagcactttgggaggccaaagcgggtggatcacttgagcctaggagttcgagaccggcctgggcaacatggcaaaactccacccctacaaaaaatacaaaaactatctggcatggtggcacacctgtagtatcagttactctagaggataacctgagcccagtaagtcaaggctgcagtgagctgtgatcatgccacagcactccagcctgggtgacagagtgagaccctgtttcc

SEQ ID NO: 223372 - DNA, 506 bp, Homo sapiens
tgtgaaaccatgaaactaatattcataatgaccttacaagataaagaacttgaaggaaaaacagcttctgtgtgcctggccgtcaccatcagggtgctccgtgaaaaacatggcatctcaccagagccacagacatcgtctccccaggagcctcagtgctggcggccctcagccccaccagccactatacttcattgttagtccttaattaatggtgcctttgtgcacctggtcatcccgatgccaagcccagaaccgaatggggcctctgacttctcttccacgtctaatcagacgccatttcagccaacatttaccaagtatcagcaggtccaggcctgggcctggtgcaaggagtgacagggtctctgtttgtgacatcctgtccctcacccccacccctttagtcccagcaaggttcagagtctcattccctgccctcatttcttttatttgttgattgacatataacataggtacagtaaagcacactaattttaagcata

SEQ ID NO: 223373 - DNA, 676 bp, Homo sapiens
gtatggtgaaatgaaaagtgctccggcctgggaacgataaggtctgaattacccgaattttattactgactctgccactaactatacgacatctttccataatttgtttcctctttctgagccatgatttctttgtatataaactgaggaagtctttttcccgttgcaaaacagcagtggttgttcaaacctaacaattgtgattctcaagttctttacttcctttttgtacttttcccgctcaatctcgagttctttacttcctttttggacttttcctgctcaacagaagacttagatctcttcatagaaaaaaaaacccagataattgtgcatttatctttaactacacttaatgattaggctctggagttaattgatatggaatatgaatgcctcctcagtcactatcaaggagtataaccttggcaagttgtttaacttttctaggctttggttttctcttctataaagtagtatttcctaggtttgttgtgatgattaactgcagtaattcatcaaacgtaggacctggctcataggaaatagtacatattaacttttgaccattaccttttgtatctacactgggaaaattaaaactcaacctctttcttcagatgtttaattcttatgtttcctttttgtattcatgtttctgagtttgaaaagacaa

SEQ ID NO: 223374 - DNA, 411 bp, Homo sapiens
gaattacaggctttgagaaccgggcccggccccagccaattttttaaaatattttgtagagacaaggtcttgctatgttgtccaggctgctctcaaactcctgggcttaagtgatgttcctgtctcggcctccccaagagcagagattacaggcatgagctacctctccaggctcaaatttccgaattttttaaggacaccagtcatgatggtttagggaccatcctactccagtatgaccccaactgattatatctgcaacgaccctacttccaggtaaggtcacattctaaagtacggtgggttaagacttcaatatgccaattttgggagtggacccaattcaacccataacaacatcattcaggctgggcgcggtggctcacgcctgtaatcccagcactttgggag

SEQ ID NO: 223375 - DNA, 1225 bp, Homo sapiens
ggacgctctaccggggtgggggttcccagaaaggagggggagaggagcccgagtaggggaatcctgccctctcaagtaaaaagctggatccccggcagcaggctgcagcccgtcctcgctaaggaaacgacgaggcagacagagggccttttgcgcggaaaggcagaaggcagacactttccgaggtccggacgcaagccgatcccccatcccccgagggaggcgaagggtgccccatgggtggctgaggggacgcccggcccgcgagggacaacccgaggaggagcagtttcatctgattaacacctgagtctcgtccagtgtgacattcttcagaattcatcctggaatcaatattatgccaaagaaaattttctgaaagtcttgctgtgtcagccaggctggaatgcagtggcaccatctcagttcactgcaacttctgtctcctgggctcaagtaattctcctgcctcagcctcccgagtagctgggattacagctacacagatcataccactgcaactcagccaaccagcacatcggacagtgggaggaggaattcttggctaagagtactgaggtaaactcttcatctacttggaaatgcttagaacagaaaagcctgtaccctgatttactgagaggaaaagttggctgactcttggtctgaattgaaatattcctcctttgaccaataccatgaataaaaaaagaaccagaccaaggacattactgtgagttttcagaacatcagagataaagagaaaaacctgagattccacagagaaacgaaggtcattttacaaaggatcagaaatgagaatgggattgaacttctcaaaaccagcagtggagagtacaagaaagtagagcattgccctcaatatactgcagggaaaacaactttcaacgtggaatttaatccagtgtaaggatagaatagagtgtttttagacagccatgtctcaaaaattgtactttttgtcttctgcagaggagatgattcagtgcaataaggaaataaaccaagacatgaaagatatggaggactgtgggcaggacagtgacaggagatcctagaaagacagctgggctccaggcccagagagcaactggtccaggttggagcagaactgagttggccagggctgaggtctccagggaaaaaaaaagaaccaatggtttatctatgtgctggacccagtagagcagagcactgaccactg

SEQ ID NO: 223376 - DNA, 792 bp, Homo sapiens
ggacgctctaccggggtgggggttcccagaaaggagggggagaggagcccgagtaggggaatcctgccctctcaagtaaaaagctggatccccggcagcaggctgcagcccgtcctcgctaaggaaacgacgaggcagacagagggccttttgcgcggaaaggcagaaggcagacactttccgaggtccggacgcaagccgatcccccatcccccgagggaggcgaagggtgccccatgggtggctgaggggacgcccggcccgcgagggacaacccgaggaggagcagtttcatctgattaacacctgagtctcgtccagtgtgacattcttcagaattcatcctggaatcaatattatgccaaagaaaattttctgaaagtcttgctgtgtcagccaggctggaatgcagtggcaccatctcagttcactgcaacttctgtctcctgggctcaagtaattctcctgcctcagcctcccgagtagctgggattacagctacacagatcataccactgcaactcagccaaccagcacatcggacagtgggaggaggaattcttggctaagagtactgagagatggggtttcaccatgttaaccaggattgtctcaatctcctgaccgcgtgatccacctgcctcagcctcccaaagtgctgggattacaggcgtgagccaccatgcctggccaaaattctgtatgtctttctaatctcacttcctaatggagataaaatagatctcaggcttatgtatttttctagaacattaaaatcttgttttttgtgta

SEQ ID NO: 223377 - DNA, 154 bp, Homo sapiens
gagggaagagggagtaaggagggaggaggggggaatacttccaaactcattttatgaagccaagcattactctgataccaaagccagaccaggacaacacaagaaaagaaaattatatgccaatagccctgatgagcacagatgcaaaaatcct

SEQ ID NO: 223378 - DNA, 407 bp, Homo sapiens
gtacaagatttctttatttctaccacctaacacatattattaagtaatctcattacatttttgctattgaagaacaggatctttttagatggttgtttctgaaattcatgggatagagttccattttgcatatcatctcagcctgtcatcctgcctgttttcttccttccacctattgtttagacatttctttgtccattgacacctttctcagggggtaaccggtgggaaggagaaggcaaggaagaacagaggtgaaaaaccaatgtgtacctcttactactttataagaagatattatggaaaatttagatgaaattatattttttggtagttttccttcatagacaaattctgtatttatttaataaatagcacaattccaagctttttatgggaaaatatag

SEQ ID NO: 223379 - DNA, 576 bp, Homo sapiens
gaggacaagtttaaagtaatgcctaaagaactggaacaagagaaagatgtccactttcaccactacttgtctacatacttctgaaagtcctcccagggcaggcagccaagagaaacaaataaaaggcctcaaatcagtatagaggaagtcaaattatctctgtttgctgatgatattaccttatatttagaacaacctaaaggcctacctaaaaactcttagcattgataaatgaattcagtaatcatgcaggatacaaaattgatgtacgaaaagaagtagcatttctatacaccaatattgattgagctaagaatgaaataaagaagtttaccctataactgaaaaaaaatacctaggaatccatctaagcaaggaagtgaaaaatttctataaggaaaaccacaatacactatgaaagaaattgtagatgacacaaacaaatgaaaaaggcatcttctggtgatgtacctgaagaattaatgtagttaaaggattatactgctcaaagaaatctacagattcaatacaatctttctcataatacaaacaccgtctttcacagaattagaaaaa

SEQ ID NO: 223380 - DNA, 439 bp, Homo sapiens
gggtgtgatcattgctactaggagatcactgcttccaggtttagttttcaccctttccgaactgttaattcccttctgtgacagagaaaaacctggctctggctctcatctcaatacactcacttaattaatctccctgtatgtaaccaatctcctgaccttatggctgccttgcagaccaagacatcaccttacatggaggccattgtgtagtagaaatgagactagcccctttgcttttcccactataacttgtaaatgcactacacaaagccaatgagacccttttctaaactaattcctattctttatgcaaaagagattatgtatgaaatttgggactccattgatttaatttatcataattttgtgaaatttattttgctatagaatgaatgtatattataatattggaattaaaatttctttttaatctgaa

SEQ ID NO: 223381 - DNA, 488 bp, Homo sapiens
tctagaggatccctgccttgatgatgctccactacttgacaggtaacctctaagcttcaggtttcccatgcatatagcatggggaataatacagtacctgctttatatagtgctgcaagtattaagtgaggttgcgcctgcaattgactcaggataatacagggcgcataatactaagcacaattattctttcataggactaaacagaaatacatccctgagttcattcagttgatatttatgctacatttcttctaggttcccaccattctgcctcttttcttcctacttccatcagaggaacagggaggtagaaccagagtagtttttggtctccaaacaaaccatgttcttctctttactgagaaaactctagtggttttgcttggagtatttaaattgaattaagtacatttgggactagaattggcttttttttattattattattacctgaaattgcacgagtgcaattgggaagcactcat

SEQ ID NO: 223382 - DNA, 435 bp, Homo sapiens
tcactgaagcaccatattcttatagtgtcattttaatctacctgaccaaaatctgttttgagacaatataacaccaagtcagggttaggcaggctaagttttagtctttatgctaatttgttaaatgaccttgggtcaatttattgccataatggaaaatcaagcaattctataactttagcctgcctcctttttttttttcttttttagcttttttcttacattttttaaaacattttaagcctcatgaaattgcctttattattttcatttgtaaggttaaaagtttaaaaataggctataggtcccagctacttgggacgctgaggcaggaggatcacttgaggccaggagttcaaggctgcagtgagctgtgatcacacctgtgaatagcccctgccttccagcctgggcaacatgggtagaccctatttc

SEQ ID NO: 223383 - DNA, 186 bp, Homo sapiens
ccaccaaaacaaccacccaacagagacctgcccagagaatcataagccataaaatgactattgttgccaggcacggtggctcatgcctgtaatctcagcactctgggaggctgaggcaggagggttgcttgagcccaggagtttgagaccagcctgggcaacatagtgagaccttgtccctattta

SEQ ID NO: 223384 - DNA, 636 bp, Homo sapiens
gttgtccaggctgatgctttcagattttaatacggcggtgcacacagatggttaaacaccgtgtggcacagcaacgtccctgcccctccccacactcagcaccttctgccacgagggctggtaacccgtcaagaggcaaccgcacacgcctgccgctccgtgggacatccagtgtctgtcgccgtgggctctgctacggtggtgcaagagccaccaggggatgtggacacaaggggtgcagccgtgtgcccgagacgcttgatttacagacactgaaatctgaattttacaattttcttgtactatgaaacatcattagaatggttttgactttttccaaccatttggaaatgtaaaacccgttctcagctcgccgactatacagaaacgccgtgggctaggcttgccagccgtcctccccgctccctctctaagtaacacttgtgcggctccttctggatacgccgtcttctgacatggttcccttccgcaaggggacacgagagcatagtgccggattcctgtgacctcccgcgagaacttcttcaaccctggctgcggctcaccaagcttcactggacacgttaaatcatgtcagcagggaggaacctcgctacctcacccctaaaactgtcg

SEQ ID NO: 223385 - DNA, 744 bp, Homo sapiens
cacttctccctctccttagttctccggtaaccaaaccttctctcgttatatacccaatgataaaaccaaagtaattgttgtacaggttaaagattcaaaacaaaccatagcaactgaaacagggtatcaggacgcaaatgcttggctggaatggattaaacattctgtttgcaggctaaacaaaagcgcctgttacacttgtgtgacaggcaggccagagacccaaattgttccctttccacttgggtggtcctctcacagaccgggcacgagctgtgtggtagctctcttccagaaccccacagcctggggtggtgagtcatgcaagactctttcactgctgttccctgaggtcaagagccctgcgggtcagccctgaggactatccggcctccagcccctgatgttaacttcacctcatgcctttcacggcagggggaaaagttagcattccttggagacttaacagggtgcagtgaaaccaggccttttgaagagcttaccaatcagtctgcccttgttcatccccgagcagatgtgtggtggtattgctggggactactgctgggtactctgccaagtaattagagcagcactcatgctctagtccaactggccatccctttcaccctagcattctgtcaatatgataaaaaaaaattgtaaaagaagtgcctcacgtgggtcctttgacccccatgtttatataaacactattggagttctatgaggagaaccagatga

SEQ ID NO: 223386 - DNA, 446 bp, Homo sapiens
tctgtcaaaatgctgctccttccatactgagtctctttgctcctcctctttcccccagtcaacctggggttaagtgggaaggggagtaaggcaactccaggggatgccttccaaactccgggagagggaaagcacaggaattgggagaagacgtgaaggcagagcttgaactcctatgtacccggtgacacaagactgctctgagggtggcgcccgctgcttctcccgggcgccccgccagccgctctccctggcagtggcgccctttcctcgccctctgcccgcccaagagctgctggcccagagcagccgcattcccgaccctccaaggcgaagatcccctggattcaccccctcactggcctttccgcctaactgactgaaacccggctccccaggcacagattttccagcctccctaagaaatgaaaggttcgcgtgccctt

SEQ ID NO: 223387 - DNA, 158 bp, Homo sapiens
aggaaggtggggttggtcgctgtgctgaatgctgctaagcgttacctttctgcaaaaacctttgtcaccttcttgattacaaatcccaccactgcctccaagaaagagcgttaattccttctggaatatcaggtctctcacacacttctgccaacata

SEQ ID NO: 223388 - DNA, 1125 bp, Homo sapiens
gctggagtgcagtgcagtggcatgatctcagctcactgcaacctccatctcccccgctcaagagattctcctgccccagcctcccgaatatctgggatcacaggcatgcaccaccatgcccggctactcttttatatttttagtagagacggggtttcaccatgttgaccaggctggtcttgaactcctgacctcaagtgatccgcccgccttggcctcccaaagtgctgggattacaggcgtgagccacggcgcctggcctaaatcgccctttcttattactttcttagaactttgggctatctcatttatgaatgatggaagagttctgctgaggatttcaattcagaaagcagggttctctctgtgggtaaacttcatatcacccagacataatttctaccgaacatcatcaattaaataacaagagaggaggtcaacaccttgagacctgaggaagaagaaaaaatacttatcattaagtgtaggatgcaaacattctattagaagcttagaagcaaagagtaagatattattttcgtggatacaagagaagacagagaaagacagagggagcggcccttacgactgatttgtgtttacacaataaggaaatctctcctctggggtctctccgtagttcacagggaccctgcttccaggggcacgcgtggcgaagagagtccgtccagagctccagccctcactgcacttcccaggtgccaagacaaaacatcactgggtggggagagaactgtcatgaggattattcccccgccacacaatgctgagcttctctccctctctttttgaagaagtgcgtttatgactgatcgctcaacaccttgttggttctgattgcagaaaacacaccttataaatatatgataaccatcctgtaatagagagtgtgacaatttacttcacagtgcgtttcgggctgctaattgatcgtttcagtccagggacgatttggaataaattatagccatcaaaaggatatcacagctcattttggtggaagggtttccacgtcgcttcgcgttcgtctcccggagagagcagattgcacccggcgggcgttgaggagcggagggagggggcaggggaaaaggaggccagcgg

SEQ ID NO: 223389 - DNA, 511 bp, Homo sapiens
gatgggcttctctctctgatgtttgtcaaaatcttaggtggtgttagctctacactaaatatgacattctcttatcttccatctactatggacagatccaggaggtgctaactatcctaccacaattggcaagaggtgggagtacaggttctttttaactgcattgcaggaccagactctgaagacagctgcttagatctaacagcgatttctttcagtaacaatcaagtaggagaagagccacatttgcttaggcctgcaagtcagtggaggaggacttaaactacagcaccctgcagcagacacattttggaacttcagctatttatgtaagaagctcttgaaatcagcttttctgaaaagtggcaccttagatttacagaagtaagcccagaatgcaaacggttttaaccattcttcagtagctaccatactgacatccaaaactctgtttatgataagctatgttgatccttaaagctgtgctttatagataaatattttgaaagga

SEQ ID NO: 223390 - DNA, 468 bp, Homo sapiens
agacaggatgataagagtttttctgctctttattgagaactttagacaagcaccaggtttttattactcatgcttcaaaatttacagccttcctgaaattctggatgggagtggggaagttaaggaagggtggtactaaggtgaggagtggtttgcttctctgaatgtttccttcttcatcaaaactatcattttcaatgtgaataatatattctgaatttttccatttctgtgcatttgcaatactaacaattaagtgtaagcaactgtcactctcacttttattataaatagtctaattgcttctcctactcacacattctccacagaacaactaagctgattacttaaatatgtcattcacatcttttccgctgctgttttaatgcctccttatttcaagttgaaggaacaccacataatgcacctgacatgggacacaaggccctccatattctgccccctgcc

SEQ ID NO: 223391 - DNA, 425 bp, Homo sapiens
tggactccggtcagggcaagcattagtattctcctgtgtgatggccacagccatgtcccctcctccggagtcacccaaggtgggtggcaccagccctgcaggaatgggcgagccacagggctcagaggagccctcctgcccccactctgcccagcccctccgtctggaatggccctggacaagttcaggagcctggactccttcaggctggctggaggagaagtttctctgagccatctggaggcggccccagtgtctacgagatggttttttgattccctgtggtgggagtgggtggtgtgaacccacatctgcaccagcagcccagccagggtcccagggagcaggggccatgaggggcagtcacgtcccgtggggaggcatagcagtggtgagggtgtcctgggaccaccggccgcagatgc

SEQ ID NO: 223392 - DNA, 417 bp, Homo sapiens
gctatataattttagtacctttctactggtcaaattttaatcatatttcaaaatgaatagcaaagaggtttataattaagttttataaaaattccaaatgtaataaagttatatttgtaacttacgtatactgcaaaaatggtagtgattcaaatgtttgtctttcaatataccgtattttattgcaggatgaatctccaggaaaaataaaaggaaaatattgccttgataagttatcagtgttgactagtatgaataatagcaagagtttagaataatattgaatacacatttttcatctcgactctaaacatttggacctgtagttgaactttccagagcccctaaccctgcctgtacctctcctagagtctcgccttcatacttttaataaataaaatatacaacttaatagac

SEQ ID NO: 223393 - DNA, 496 bp, Homo sapiens
gggggaagaatcacttgagcacaggagcttgagctgatcatagctgcagtgagctgtgattgcaccactgtactccagcatgaacagcagagtgagaccccatctttttttattgttgttgagatgaagtctcactccatcacccaggctggagtgcagtggcacaatcttggctcaccgtaacctctgcctctgagcttcaagcgattctcctgcctctgcctcccaagtagctgggattacaggcacccgccaccatgcccggctaatttttgtatttttagtagagatggggtttcaccatgttggccaggctggtctcaaactcctgacctcaagtgatccacccacctcagcctcccaaagtgctgagattacaggcatgagccaccatgcctggcctagaccccatctcttaaagtttgtggcagggctgcagtactcaaaccataaagaagtggcctatggaaatgagctttaagccacattccatgaa

SEQ ID NO: 223394 - DNA, 722 bp, Homo sapiens
cctgaaagtcgtagccacagcaatttaacaagataaagcaataaaatgtattcaaatagaaaaagaggaagtcaaattatcttcactggtgatataattctctacctgggaaacttcaccgaaaaagatttcaccaaaagatttctaagcctaaataatgacttcagcaaagtctcaccatacaaaatcaacatacacaaatgagtagcatttctgtgcaccaataatattcaagctgagaaaaaaagaacatggttctatttacaatagctacaaacaaaaaaatatgtacctagtaatacattaaatcaaggaggtaaaatatctctacaacaagaactacaaaactgctgaaaaaaaatagagacaacgcaaataagtaaaaaggcactccatgctcatgaatttaaagaatcaatataattaaaatgtccgtgctgcctaaagcaacttacagattaagtgctatttctctcaaactataaatgcaactttttatggaattagaaaaagaaaaccattctaaaagtcatatggaagaataaaacagcccatttagccaaagcaacattaacaacaaagcaatcctggaggcctcacattacctggcttgtactacaaagctacagtaatccatattacatggcttgctacaaaaatacacatgtagaccaatagaaagaagagaaagccctgaaataagtttacatttctacacccaa

SEQ ID NO: 223395 - DNA, 235 bp, Homo sapiens
ggcttttcttgactttttccgtatgtcaagtatgggtttatcagattagctggttatatggaaatgttgaaatgtgagacagttaaaacaaaaaaaggcggggggaggggaattgagcattgaaaaaaaagcattagcatagaatacaaacagcctccctcacactcatgcctcgggtagtgagagagactgcgagcctgagtctagtgtgtaccctaaaacttaaagtatgata

SEQ ID NO: 223396 - DNA, 475 bp, Homo sapiens
ctttgtgacaatgctaatcatgtgggaatggtgctgtttccccaccacaagctggccaattccggtctggcttctttaaccaggaagatgtgggctgagagctgtggagtagatgtcttcaccagatgagtacacagagaagtagagaatgtgtatctgcagagtaggatgaagcagagacaaggtgggatgggagagagacaggggctgcaggacaaccctaccatcaatacacccaacagtcgccatcctaccccacttatttattcacttagtaacactaattactctctaaaaatacttgactatttatttgtgtatctacacccacaggaatggatgtaagtgctatgagggcaggaagattgtttttcctaccactgaattcccaggacctcaatcaatgcttggtatatagtgggcactccataaacattggccgaataaatgaattctatttacttgttcaaaaaaa

SEQ ID NO: 223397 - DNA, 474 bp, Homo sapiens
tgtaaactggcagtaataataatacgaatgccacagagctgtggatgaaatgagcccattccggtctggcttctttaaccaggaagatgtgggctgagagctgtggagtagatgtcttcaccagatgagtacacagagaagtagagaatgtgtatctgcagagtaggatgaagcagagacaaggtgggatgggagagagacaggggctgcaggacaaccctaccatcaatacacccaacagtcgccatcctaccccacttatttattcacttagtaacactaattactctctaaaaatacttgactatttatttgtgtatctacacccacaggaatggatgtaagtgctatgagggcaggaagattgtttttcctaccactgaattcccaggacctcaatcaatgcttggtatatagtgggcactccataaacattggccgaataaatgaattctatttacttgttcaaaaaaa

SEQ ID NO: 223398 - DNA, 292 bp, Homo sapiens
tattttaataaaaaatgtactctttctatttaagaattatttatcacagatttgtaaaatactttgtttagcttagttctatactataaaactgaaatggtaactaaacctgtaagaaatcagttgaaatttacatttcaaatttatacacatattttgtggctcaagtcatgtatgctactcttataactgacaaaggggttgtggacagaatatgtaaaggactcctagaaaatcaacacaagataaaaatgggtgaaaaacttgagcaggcattttataaaagtgaata

SEQ ID NO: 223399 - DNA, 518 bp, Homo sapiens
aaaaatcaagctatccagctggacagagtgcaatgctaaggagatcatatgtctcagttcatctgggaaagtcttggtttcatcctgctttcccagtgtagttatgaataacactccctttcactttcaagtcttccagtgtgaactgtggatagctacatggtgactctgggcatcttccacctcttcatgcctatagccaggcaggagccccaagaatctggcttctttgagagagatgagctattggtttcatcttttagatatcagggactcaggggtcccatggatactcacacctaatcagagagcctgatgacatcaaggagttcatcaattgtgtgatgatttttcttttgtaaatttttttcagagagtttcaggttaagtataagccattcagaataattttttgtgtatatatttctcccatcacatatgcaaagctgcttaaaaaatcactattggttactttcttcttcagaagtcttcattagcataacatgaaaaggacatgc

SEQ ID NO: 223400 - DNA, 390 bp, Homo sapiens
cagtgtaggagcgttcattgttacctaattagagttaggcatcttttcattgtatttcctgaaccagctaaaaaagttacctgcctgtctgatcttatgactcataaaatccctttcatacacattaaaatttttattgtggtaaaacacacataacctaaaatttaccatcttaaccattttaaaggataaattcagagacatcaaaaaatttgcaatgttgtgaaaccatcattcctcttcgtttcatatttttttattgtgaaaggaagccccatatccatgaagcagtcactcccatgcctcctacccccggtccctggcaaccactaatctttctgtctccatcaatttgcctattctggatatttcacataaatggaatgatat

SEQ ID NO: 223401 - DNA, 418 bp, Homo sapiens
ttttagaaccagccatatagcacagggatgctccctcactaatcctcatagattaccttttagtaacaatgtcatgcaatgatatttaacagttggtggctgcaataattcacagggcaagagttcaagaccagcctaggcaacatagtgagaccccatctctagaaaatataaaaaatcaacctatggtgacccacacctgtagtcccaactactcgagaggctgaggtgggaggatcgcttgagcccagaaggtcaaggctacagtgagccgtgattgtactgtgcactccagcctgggtgacagagtgaggtctgtcgggggtaaggggggcagcgggtggaacccaaagcaaaaaaaaagaaatataaaggattatgacaggaatacaattaaaaaaattgtttgccaaataac

SEQ ID NO: 223402 - DNA, 296 bp, Homo sapiens
tatcctcatctccttttctgtgaagcatctatattcatatgttcactttcctattagattgtcattactgatttgtagttccttataagttgggtcatgaattaatgttctagcatgcctcaaacatttttaaagtatctttattatgtttcaaattttatacagtcaatgtagaggctggaaaacagggtgtcctttatagtatctagattttgtatcttgttttagaaagtttttcctgctcccaagactataaaattattctcctgtattttctactaatacttccacagttt

SEQ ID NO: 223403 - DNA, 379 bp, Homo sapiens
aatctaccacatctcagacctgttctcagtatgtctttgatgagggtaggtccttctccttctggggggttactttatctgtggtattattgctaggcccctgctccatcttctctttttacagtctcctctgtgatgctggctccgctggatttggtgtttatatgcccattgccatgccatttgaaccttgcagtattctgtctaccaaatgagattgttgtgagaatatctgcattcattgtttgtacagggtttctttgtgtgtttgtttttgcttttgagaatgtgtggagagattcagatttaggcagttgggcttattctacaggagcccagaactcctcagaaagtctgactttagacagaccttctagga

SEQ ID NO: 223404 - DNA, 484 bp, Homo sapiens
tgcagcacagaatgcatttattcatgaggcagccaagtgaggagatgggaaaacaggtctcaaacccacttcctcgaagatggggtttagagacgtttatgggacaaagaagcaggtggcctaaggtgtggggaaggtgattggagggaaaagtaggacatcggcgatctgtgcaagcctagtcaagcttcatcgttcttcataggatgcaggttcacaaaatggtggcattagcatgatggaagatggagtttttggcgctctgacatcaaacgtcacctactggacactcacacagaccaagttgaaggattgatggtcataagtggcttgaactggataagagctgaccccaagttcctgaaaaacaactttttttcttttcttttttttttttttgagatggagtttcactctcgtcactcaggctggagtgcaatggcgagacttcatctcactgcaacctctacctcctgggttcaaa

SEQ ID NO: 223405 - DNA, 461 bp, Homo sapiens
aggcatagttataaactgcatgggtgaaggttgaaaggtgtgtcccaacacagaacacatctgcaaatgctacgaggcattttgttgttccaagtgttcaaagaaatcttttgaatcactagctgaccactaagctaaccaaagacttagtggccacacctgacaaagaatacaaactaaaaaactaaaaatgtagttcaagaaaataacaggctgggcacagtggctcacatcggtaatcccagcactttgggaggctgaggcaggtggatcacttgaacccaggactttgagaccagcctgggcaacatggcaaaaccccatctctgcaaaaaatactaaaaatttgcagggcctggtggcacacacttatagtcccagctgcccaggaggctgaggtgggaggatcacctgaccctgggaggtccaggctgtagtgagccataatcctgccattgcac

SEQ ID NO: 223406 - DNA, 485 bp, Homo sapiens
aaatgtggctgaaccttgtcaacaaaagaatgatcctgtgaaaatgattgtaagaaataagaaaaacccaaaagtggtttttcctttgtgtcttacacagtcatactcatcacacttctgacatcaactgtgacaaagaaagaaccagtgtttttcctactctatatctcaatatagatcacctcttgtcatcaaaatgagtgaagatttcttctcaccaacaagccaattctgtggcagaccctccagcagacatcagctaagtgtcctctaattcaattcaactctggcactatttacctggagatagcagctgatcccacgggttaagggcttagtcccctgtggctgcctcctacttcaggtcccacttgcaggcacaggtttccacctgtacttctgaccaaccagctataagtcaggttccacagacccccttcttgggttcaattaatttgctagagtctcacagaactcaggagaac

SEQ ID NO: 223407 - DNA, 266 bp, Homo sapiens
aggcatggtggcccatgcctgtaatctcagcactttgggaggccaaggtgggaggattacttgaggccgggagttcaacaccaccagtctgggcaagtgagaccctgtctttacaaataaaacaacaacaaaaattatccagatgtggtggtgcatgcctgtagtgtcagctacttgggagactgatgtgggaagatcacttgaacccaggagttcaagccttcagcgagctgagattgcaccactgcactccagcctagttaacg

SEQ ID NO: 223408 - DNA, 733 bp, Homo sapiens
ccagatggtctgggctgtatttctttaagttgggggactgactgcattacatttctaactcccaaaacaatctggttggatgctacaagaaggaggcattccctgacacactggacacccagacctctcttcaggctttctgtttaacttacctttctctcccacaacaaatcccactgaaacaacagaataaatagtataatatacacctccaactagactgtaatctccttgaggataatgacttaacttttacctttcctggatctcccagtgcacagacataggacattacatttttttaataattaagttttacatatattgatgaatagctaatcatttctctaggttttacatatattgatgaacagctactcatctgtctaactttaaacatgcattagcacaacagtgataatgaaactccctatttattgttcccagacatacacaaggctgttttgaaaatatggcaagaaacaagttaaaatgcttatatgccatataaatggacccagagtcctgacaatgaacctaaaaccattcactgagttcagatgttgttgtaatacacaatatagcaggtacagtagagagtctgtaatatgaagttacatattgaattttaaaacatatactccaggcagaattcaacagtggaaaactgtctcccacaaaacaagtccctggtgccaaaaaggttggggaccactgatataaagtatatacc

SEQ ID NO: 223409 - DNA, 852 bp, Homo sapiens
aaatatgacctaaggttctatagtatatttagacaaacttctcatttctctgcagtgttcggaattcatcatgcctgtatgacaaggttgtgtttgagaacaaaaggggacctgtgtgacatgttgtatttcaatatacatttagagtttgaacaaataaaaaaagctattagaatttttaatatatataacacattatcaaaaacactgtcacttttctgagtgctctaatcaggcaattcgtatgtatatttaaaaagagggaaaaagctaattagtatactaaatatatttattttaatacctgtgctcatatgttatctttaaagaacaggaataaaatttatgggtagaatagtatgccagcaatttaccttcaatacaaattaaacacatcttttaagaaaagggcgagttatattggctggggtggcactaacactacattattaatatgtatttattgagcatttactgtgtccaggaccctgtaagggggaaaaaaagtccttgtttttacaatctttattgactgaaattctgtaaaatgaattgaattcctgaagtgacatcatttaacccaaattttttcatcatcaactaattcatctcagaaaacagtaaagtttaaaaaaaaatactatcagtaagaataatatatttccttggtttggaaatttccaaaccacgatattctgccctgtcaaaatatattcactggggaattttttacttcatacgtttcttttgaacttagtcacatttttatatctagctggtttcattattaaataaaactctaggggctggtttgggaacactgaaatcaacctctgggagcactttttttgg

SEQ ID NO: 223410 - DNA, 1268 bp, Homo sapiens
aaatatgacctaaggttctatagtatatttagacaaacttctcatttctctgcagtgttcggaattcatcatgcctgtatgacaaggttgtgtttgagaacaaaaggggacctgtgtgacatgttgtatttcaatatacatttagagtttgaacaaataaaaaaagctattagaatttttaatatatataacacattatcaaaaacactgtcacttttctgagtgctctaatcaggcaattcgtatgtatatttaaaaagagggaaaaagctaattagtatactaaatatatttattttaatacctgtgctcatatgttatctttaaagaacaggaataaaatttatgggtagaatagtatgccagcaatttaccttcaatacaaattaaacacatcttttaagaaaagggcgagttatattggctggggtggcactaacactacattattaatatgtatttattgagcatttactgtgtccaggaccctgtaagggggaaaaaaagtccttgtttttacaatctttattgactgaaattctgtaaaatgaattgaattcctgaagtgacatcatttaacccaaattttttcatcatcaactaattcatctcagaaaacagtaaagtttaaaaaaaaatactatcagtaagaataatatatttccttggtttggaaatttccaaaccacgatattctgccctgtcaaaatatattcactggggaattttttacttcatacgtttcttttgaacttagtcacatttttatatctagctggtttcattattaaataaaagaaaaggtgattcccctcttgtactgcaggagaccacatacttgaatgatactctaacttctaggttctgttatagtaacactgaaatcagaaacctgtgggagaaatgtcactttatctgagagagtaaaatcagactctaaaaggaagtagcaaattcatcttgttcttttttttaatcaaccctctgcctaagacaagtagtttgaaacacagaggactctttaagtcatacttcctttatgtagtcaaaaccaaagccactgggtagtgctttccccaaaggaatctctaaatagtagacggggacattttcagatagattcgtttgtaggcaaacctccattgcttgtatcacatttcctgaaagaataaaggtaaaacttcaactatgtattacagaaagataaatcataaaggactattttgaacatttgggcctttaattgtctagctcctagatgaagtaca

SEQ ID NO: 223411 - DNA, 1324 bp, Homo sapiens
aaatatgacctaaggttctatagtatatttagacaaacttctcatttctctgcagtgttcggaattcatcatgcctgtatgacaaggttgtgtttgagaacaaaaggggacctgtgtgacatgttgtatttcaatatacatttagagtttgaacaaataaaaaaagctattagaatttttaatatatataacacattatcaaaaacactgtcacttttctgagtgctctaatcaggcaattcgtatgtatatttaaaaagagggaaaaagctaattagtatactaaatatatttattttaatacctgtgctcatatgttatctttaaagaacaggaataaaatttatgggtagaatagtatgccagcaatttaccttcaatacaaattaaacacatcttttaagaaaagggcgagttatattggctggggtggcactaacactacattattaatatgtatttattgagcatttactgtgtccaggaccctgtaagggggaaaaaaagtccttgtttttacaatctttattgactgaaattctgtaaaatgaattgaattcctgaagtgacatcatttaacccaaattttttcatcatcaactaattcatctcagaaaacagtaaagtttaaaaaaaaatactatcagtaagaataatatatttccttggtttggaaatttccaaaccacgatattctgccctgtcaaaatatattcactggggaattttttacttcatacgtttcttttgaacttagtcacatttttatatctagctggtttcattattaaataaaagaaaaggtgattcccctcttgtactgcaggagaccacatacttgaatgatactctaacttctaggttctgttatagtaacactgaaatcagaaacctgtgggagaaatgtcactttatctgagagagtaaaatcagactctaaaaggaagtagcaaattcatcttgttcttttttttaatcaaccctctgcctaagacaagtagtttgaaacacagaggactctttaagtcatacttcctttatgtagtcaaaaccaaagccactgggtagtgctttccccaaaggaatctctaaatagtagacggggacattttcagatagattcgtttgtaggcaaacctccattgcttgtatcacatttcctgaaagaataaaggtaaaacttcaactatgtattacagaaagaaaaattcagcctgaaccctacccttataaaacaggttaattgggttttaattttcataaatcataaaggactattttgaacatttgggcctttaattgtctagctcctagatgaagtaca

SEQ ID NO: 223412 - DNA, 389 bp, Homo sapiens
tgggggaggcgaaaggcggaaggtattcacccatctcattcagcaaatttatgctgatcctctaccaagtgctagaccctggccatacagtggaaaataagagaaagtttttgcccttacgtaacttatattctagtgggagaagacaggacaataaacaaagacagtaaacaagtaaacagtacattaaaaaagtgatgttaaatagtggtcggtagtaaaggtaatgatcagggtcgataaattgcacttattctgtgaatcacttgctttgcctatgatagtctaatgaacagtcttcatgttataactttttaatattcatgtgcagtccaaatgaatttgaataaaaatctacacattaaccagtttttaaaaaaagaaatgtg

SEQ ID NO: 223413 - DNA, 522 bp, Homo sapiens
tccctctgccctcagagtgggggacattttagtgacttcttgatttttcatgccaaaggcgatggtaggttatccaaaaaaatcttatttgaccttccaatgcatattacaattgtatttgactatgaaagaaatgctctaaaaattcagtctttgaaattaaataataaagatctaaggcaggagaaactggaaagccattcaacttcccgtgttgactcctactcaggaaactttcttttcccaagataatgcagggaatctgcatagcacaacttgggcagtatttactggtccattgctcagagagccccataaatgtaaggaattattcatatccagttgcgcattttagctgttaagtatttttccagttctgctgggttagagaggtatcgtgttacagtggaaagaaaaaggcatggatagactgacagttatggaaagaagacggagcaggggacagtgaaggggaaatggattcgttatgacacacaaatgtaaaattccctagtcaagaac

SEQ ID NO: 223414 - DNA, 228 bp, Homo sapiens
acaaggtcgagactgcagtgagccatgatggcatgccactgcacttcagcctgggcgacagagtaagaccttgtctcaaaaaaaaaaaaaaaaaagaaaaatcagttttctcattctttccatgttttagattaacaactcttaaaacatattcctttgtggacatgaggttaatttcaagagatattgaaatctgttttctgtggaataaagacaaaataaaatttc

SEQ ID NO: 223415 - DNA, 789 bp, Homo sapiens
  misc_feature (789)..(789): n is a, c, g, or t
ggtcagatttaccaccaaaatgcatgcaggagatcccgcaagagcaaatcaaggagatcaagaaggagcagctttcaggatccccgtggattctgctaagggaaaatgaagtcagcacactttataaaggagaataccacagagctccagtggccataaaagtattcaaaaaactccaggctggcagcattgcaatagtgaggcagactttcaataaggagatcaaaaccatgaagaaattcgaatctcccaacatcctgcgtatatttgggatttgcattgatgaaacagtgactccgcctcaattctccattgtcatggagtactgtgaactcgggaccctgagggagctgttggatagggaaaaagacctcacacttggcaagcgcatggtcctagtcctgggggcagcccgaggcctataccggctacaccattcagaagcacctgaactccacggaaaaatcagaagctcaaacttcctggtaactcaaggctaccaagtgaagatttgggtacctggctgagtttggggctggcagccttcagcacaccaatggtgtcaatggcaggtgtgcgtgggacaagaacatatgctgtcatgattgtgctacagtttctttaagaacaccagcttgcaggatttgagttgaggaaaacacagacttccatgagtttgggaactacgagagaaaagacagacagagtcaaatctacagcatatctctcacctcaggaaactgggaagaatgtattccatcaatatgattgtaaaagtcttgaacatan

SEQ ID NO: 223416 - DNA, 405 bp, Homo sapiens
ggtcagatttaccaccaaaatgcatgcaggagatcccgcaagagcaaatcaaggagatcaagaaggagcagctttcaggatccccgtggattctgctaagggaaaatgaagtcagcacactttataaaggagaataccacagagctccagtggccataaaagtattcaaaaaactccaggctggcagcattgcgtaagttgttttgtgtggttctctcgtgtgtaccaatacttactctaactctccaaggagagagggatatcgtctccatttttagatgaggaagcctgggccctaaagggttaaattatgtgctctccactgttaaggagcagagtcttgacttaaatacatctttccacctcagttctaggtcttctctcctttgtccacatatatattta

SEQ ID NO: 223417 - DNA, 217 bp, Homo sapiens
cagtttcttcggtctctgacgttgttgtctgcacaagagagttaaggcagccatcttgggaccatgagggagccagtctaagaggcaaatcaacacaatgagagggtgttggaaaaagacaaaaagaacctggtccttgatgtcacagccaggcctctgaattaaccacccccaggacttcttgttacgtgagctaataaacgttcctttttgctta

SEQ ID NO: 223418 - DNA, 587 bp, Homo sapiens
  misc_feature (523)..(523): n is a, c, g, or t
cggagtgggcacatggattgggcacaaagtactcagtagtccaagaatatttcagtaagactgcaagaagggaggaaatcaagtttcaggagaaattctaaaggcctaagactgtcatggatccaaatgtgtattttctgaatttaacatgcaaatctttgttaaggggttcaagaaagtcattccttatcttacaaatactagccatggtaaactgattaggaatatgtttaaaaacaaaaaaacaaaaaactagccataagaaactacttagttctatatcatccctgtgagaaaggaaaaaaaattcttatgttagagaaaacaaagtctaaattctttagatttttcatatatgtttaagcatgtgtgaataacataaaataagccaagcaaaacagagaaatcatagttatgcactgtaccaaattagctcccaaaagaaagtataaactggggtttaagtcaaaggaaaaggggaataaaaactatatgatcatgaccgaagaatcagtgtcatganttttattaagcctcataatttttaaaattaagctcatttcataatttcctataattgaataaat

SEQ ID NO: 223419 - DNA, 468 bp, Homo sapiens
gatcccccgggccgcaggagagagagagagagagagtgagactccgtctcaaagaaagaaactgagtgaaggacacacaagaatttctggtacattttcacaactttctgtgattctgtatttcaaaataaaaggtttgtaaataaaagaattgtgttaacactttaaaatgttaggaggtgtaggccgggtgtggtggctcatgcctgtaatcccagcactttgtgaggccaaggcaggtggatcacctgcagtcgggagtttgagaccagcctgaccaacatggaaaaaaccccgtctctactaaaaatacaaaattagccggccatggtggcgcatgcctgtaatcccagctactcagaaggctgaggcaggagaatcgcttgaacttgggaggtggaggttgccatgagccaagatcacgccattgcactccagcctaggcaacaagagtgaaactctgtctca

SEQ ID NO: 223420 - DNA, 703 bp, Homo sapiens
  misc_feature (518)..(518): n is a, c, g, or t
  misc_feature (587)..(587): n is a, c, g, or t
  misc_feature (589)..(589): n is a, c, g, or t
  misc_feature (601)..(601): n is a, c, g, or t
  misc_feature (634)..(634): n is a, c, g, or t
  misc_feature (690)..(690): n is a, c, g, or t
gatccctgtactaggatggtttcagagtctgtctctctccctcccttccaacaacctcagatacattgacttagatcaaccaatctttgttcatgacacattagtatcattggtccacgaatggccttacttatgtatattttgtagacaatataatgaagtaccatgagcccatcacccagacccaagacccagaatattcactacctgtgcgctacctcccttttccatccccctgctgcctccttggacatatacctgctgatggctcacacctacaatcccaacattttgggaagccagcgcaggaggatcacttgagcccaggaattcgagaccagcgtgggcaacatggggagaccctatcctacaaaaaataaaaaattagctgagcatagcggcctgcacctacagtcccagctactcgtgaggctgaggcaagaggttcatttgagccccagagcctgaggccgcacaggctggagtgcagtggcgtgatcctagctcactgtagcttnaaccacctgggctcaagcagtcctcccacctcggcctcccagagtgccgggacacagacgtgagccacnanacctggccagancgtttgacacatgaggggacattagactttctntggaagggtgtattttccagtgctctagaatgaacatgattccatggtgacctgtnttactggacttcg

SEQ ID NO: 223421 - DNA, 311 bp, Homo sapiens
caaaactgcacagccaggatagtgtgacatttctcaacccttttgtcattatcacatcaccccaaagaatgattaagatattgagatatcctttttccctaactgacaaaagttaaaaaaaaataataacccgtagtttcaaaggagtgaagaaaagagcactctcatataccattgacagagaaaattagagagcaatttgaaaaggtatcaaaagcagccatttaactttgtaactctattttgagcaattttgtctttaaaaaatgaataagtatttaaacttgaataaagtatttaaatatgttcaa

SEQ ID NO: 223422 - DNA, 434 bp, Homo sapiens
aaggagtgaatgaatgattgccaacctcaatagctggacatttatcatgagggcagtaggaagccacagaagtattttaggcagaactggacccatttctctcaaactctgatgtgcatctgggattttgaatgtagattccgcttcggtgggttgaggaaggggcctgagattctgcatttcaagctcccaaatgatgccaaggctttgagtagcaaaggtgttgccctgctcttcagtacagtacaggagccactggccacatgtggctcctgggcacttgaaatgtggctcgtgtgacttgagatatattttaagcataaatacccaccagagttaaagacttggtacaaaaaaaatgttttatattgatcacatactgatatggtaatattttggatatattgagttaaataaaatatattattaaaatt

SEQ ID NO: 223423 - DNA, 712 bp, Homo sapiens
gactctagcttgtaaattctcagagcctcctgaaaatcaaggggatatatcttaaaattcaaacaaaaacaagggtgcttcagagaggagactggcaggagacccccaatgtggtggctgtttctctgacttacgcataccctggcagaccctatgagttttccacttccctttcaagacagcatggggtgctgtgccttggaggttgagtagggaactttgggcaccagctttgaccaaatgcaggacaggaaagaagtgatggacagttggtctgttgagctcactttggtgaactgtattttaattagcattttaagaaatggagaagttcaaaattaaggttgatccacatcagatgagtagcccatgtgccagggccacatataagcctggtattttaagaaggtatgtttcttatctgtaatgaaatattcaggcaccccatgaaggttttgatcctcctggccacaaaactacaataaagatggaaaaagtttatacatatacatacatacatatatatatatatatatatatcattggtatgggagaaaatctctgaaaagaggtaacaggaaagcacacaaaatgtatctattcatcaaacattaaattatgtttgtttagtgctaaatcaacatataatctgaataaagaaaagccatgttaaaaactagacaagaggttcctctttctctcaaagcagctt

SEQ ID NO: 223424 - DNA, 347 bp, Homo sapiens
aagcttactaggctgataaataagttgtctgaggtcaatagcttctcagctgtagaaaagtggaaatgtgccaacatgaaactgacaacgattataaagcacattaacttccttctggttaatctccatataatatttttcaattgcttgtggaataactaaatgatttcatattgatgtttttattcacttaaaaagtcaggacagcagactgaatttgaatttgttatcttggaaaggtttggagctagtgagcaatggctatttcaaactaaagaattatatttaacctgggtttacttcaattcttggagagtctggctaaaaattacaaggtaggttctccc

SEQ ID NO: 223425 - DNA, 418 bp, Homo sapiens
tgtaggaacactgaattactaactagatgaatagcatagcaaaccatccgctgaaacctaacaaaagtagctcatttggggagtgagttttggagagtcactctgcctctgttctgtagattgtggcaaataaacatgatatagtatacattgtgtgtgtgtgtgtgtgtgtgtgtgtgtgtaggtgtaatactatctatttgaaatgacaatgtaaaatgagcaggagaccttttaagaccaacaaggagcttcctttatcactactgattctcgtgtcgaaatagagcttagagaatctatgatgaaaacactgtgacccaagttcacactctaaggtcaaacttccaaagttcagcccttgtccttgtgaatcacttaacctttctgtaccttcgttgcctcgtctgtacaatgg

SEQ ID NO: 223426 - DNA, 403 bp, Homo sapiens
gattacttagggctggcctgagggggagttggggaatgactgccagtagatacaggcttttgtgggtaataaatatgctctaaatttgattgtggtgatggctgcacaatggtttgaatgtactaaaaccattgagttgtatactttagatggatggtttgtgtggtatataaattatatttcaataaagcggtaataaaacaaaacaggtggtaggcttattgaccagcaagccaaagcttgctgacccataatagattattcttcattttcctgctaagccattctttatctgttctcattgctaactcaaatctttctcgttactcaatttttcattcaaaatttaagtacttgtctcacattttccctctgtgttccaccatcaggttacatctttatg

SEQ ID NO: 223427 - DNA, 556 bp, Homo sapiens
gtaacctccactacagtcatgaggtagaatattcccgtcaccacaaaaaggttctcttgtacccctctgcagtaaatcccttccccataccaccggccccagacctgctttctgacagtgtatcagttttgccttttctagaacttcatataaatggagtcatacaatatgtactcgactggcttctttcactcagcataatgcttttgagagtcatccatgtcgctttatcagtagttcatctcttttccttgctatgtcgcataccacaatgtgtttatctgtgcaccagacaagttgtttccagtatgtggcaattgtggaaaaagctgttatgaacatttgtgtatctttttaaaatgtattttcatttcccttgggtgaattaactcagaatgaaattgctgagttagctagtaaacatgtgtttaactttatatgaaactagcaaactgtttccccaaatgctgtatcattttccactcccaagagcagcgtaggaaagctccagttgtcacagctcctcgtcaacatttggtatggtcagtctttttca

SEQ ID NO: 223428 - DNA, 2644 bp, Homo sapiens
ttcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctgagctgtgcagagccagggaacaggagtgctccaaaagcgagaagggtttccggttgccctttcaacctcagaagtcaggacttgactcacagtcttctggatttttgacaaacaaaatcctatgcctatgcctagatccataggcacacaaatggaagacctaaataaatcaaagtgggggagtgaggctgctggactcctagagattcatggctctgccttgattagtcaccattcttttagcacatacgtccagatatcctacagaaaagaatgcagtcaccattcaggcatgctttgttttgaagcaatgatcatgaacttaatattctctgctggcataaagaggaaaaaaatataacacctggcagcttgtgggtaagtccatcacgggagccggtcctaaaattcttcaaaataccaactttctgaggttggaagcagaccctgagatgagattttggtgcaagtgatttattaaggaagggatcccaggaaaggcagtaagggagtaggggaaacaagttagggatggggaagaatccaagcaaaggttcaacttcaaaagttctggcctcagtctaatcccgagtgtaaattaggcctcagagtttgttctacctccaggcaaggaagcaggactgtcatattcttatatgagtcagtcatcggctaagagctactctggagaagtaaactccaaggcatctctagctttaggcaaagcggctccaatagccaaaagtgaaaaccattggtcaggatgagatactccaaatgagagcccagagggatgaggaatagggcctccacagagcagtcccaaagctcatctctctcttatcttgagataaggttacaggaagtcctcatgcataacaacaaattatctaaatgtatgtccatcaggaccttgaaagagagagaacaacacttcccccatcatgactgtaggggagaaaaagaaaaccatctctctctcctaaccagttgtcactttgtagtttaatatcataatgtacttttctgcctaatgcttgaaaatgcctacttgagtcacaggaaatattgctcccatctcccagtatcaccaatatcagagaaatttcaaagaattttagtgggggatgactgccaccttcgaatatttaggtttctctcatatgacctggtgctttctctgtggtcctagagggtgagctaggctcgaggggtagatgtcataagaagatcagtttttgactcaagaaaatcatctggagtaaagtggtccacatgctggactggaacaacatttccaaaactgaccttccaggggatggatttttaatgtaaactctttagcgagtatagtatatagaaagaaattcattaggtgtggctccatgacattttaactaaatgaacagacccatgtagccagcacccaaatcaagaaacagacgatttatgtgccctgttgctcagcagtgcaagagattcctccatgttcctgtatgtagttataggtcgttcattctcattgttgaatatcattccattgtataaatggatatttggattgtttccatttggggctactatgagtgatattgttaggaacattcttgtacatgccttttggtgaacatacagatacatttctgttgagcgtctactagggagtcaaaatgttgggtcattaatatacatatgtgcaattctagtagatatcgtcaaatagtttcctgaagtgggtgtacccattgaccctaccttgagcagtatatgagaattacagttgccccacatccttgccaaaatgtggtattattagtcttctatattttagcattcttatggatgtgcagtggagtcatattatagttttaatttgcacttccctcatagctagtgaaattgagcacactgggtaaagttttttaaaaaatacattcccaagcctcacccaagcctcatagaatacaaatccctagggatgggtggcccaggaacctgacttttcaatgcttgttccccgggaatacttaagctgccagcctgtcgctgatctgtgaactagggtgtgaggatgatcaataaggcaatagctctgtgaatctatgactctgggtgcagagtgtgggtagctggcttctgcctctgattaggtgttggtattcagtcaagatttaatgtttctgcatgaaacaacgaatccaaataataacagagacaagggtttatttctctgtcatgtgaaagaaaatacagagataaggaacccagggctggtttagggtaccggggtaccattgtgaatcagggaatccagctctttctagctttctgctcctttgctctgccactttcatgttctctagacgtgctggaactccagccaccatgtttacatttcaggcaggaaaaggagaagcacaaagggcaaaaaaataaataaataaacaaataaaagagagagagagaaggagagagagaaagaaagagaaaaat

SEQ ID NO: 223429 - DNA, 433 bp, Homo sapiens
catagagtaagaattgggagtgagctagcaccccttaaaaactgtttggattgaaagacttgtagagttttacggagttgattcttttcgcagcagttttgtgtgagtttcactctaccaaaacacagtgtggcaagattcacttcttggcacctactttacttcctatcaagatttgggaacttccctgtaatctcagcactttgggaggttgaggtgggtggagtgcttgagcccaggagtttgagaccagcctaggcgacatggcaagaccccatctttacaaaaaattagccaggtgtaatgatggacatctgtggtaccagccactcgggaggctgagaagggaggatcacttgagctcaggagtcagaggctgcagtgagctatgatcacaccactgctctaggcaacagagtgagaccctgtctcc

SEQ ID NO: 223430 - DNA, 245 bp, Homo sapiens
ctggttgtggctgcttggagtagagtgttgagaaaaatcacaaatctcatctgggcgtcaggcagagaagagtgatgtgatcaattagtagtgtctgcctttgttattctaagctaatctgtgctaaatagcaacaacaacaaaaaaataagacttttgtagacaggtgaacaagtccttgagaatttaaattcaagtcaactctgctagtgccatatcaattactggccttccattttcttcat

SEQ ID NO: 223431 - DNA, 459 bp, Homo sapiens
accttctctgggccttgcctcccgtagctgcacaacacaagcccacaggcaaacacacagactcctgcagtgtctagagcagtcactgggatatgaagactgtgtgtggaggctgggcagctagggtgcagggggtaagtcttctacactatgtgacagcaatggaaaggccccttgagcccagaaagctcttttattttttgttaaagaagttcttccaaatacgaacttgagaaatctagaaaaatattttgggttgtaagatacagtggctcagataagaacattttaatttcccccattgcacaccatggttttgctggaaataaatttttggtgctgcaaaagaaataacactcaaacataaattttctcagcaaggcaattttacttctatagaagggtgtgtctcatgaagggagcaatggcgagagcacacctgaacaagggaggggaagg

SEQ ID NO: 223432 - DNA, 270 bp, Homo sapiens
tcatcctgtgtgggtctccacccaggatgcagtgagccctgagctgcttgtgttcaaagacatcaaggttgtctacctgagatgtggggtttgtggagcaaaaaaggaatcaatacccgaagaactcagagacctcagtgactttcttgttacctttggtttggtatggtgcagttctcttgacacatttgaggggtagctcattatagacctcactttttttctcaaatatttatttatttttttattaaaaaccatatttatttcaga

SEQ ID NO: 223433 - DNA, 575 bp, Homo sapiens
tatttctttggaaagaatctgagtgataaaacctaagattaaaatatctaagaatgtaaaaggcttaaaaattatattttctatataataaagtaaatgtcagtatataggcaaaataaaaaatataacagtaaaaaaaattatcctggctgctgttttagaaatctagcagtcttgggccagagtagtaacagtggatataagaagtggccttaattctgactaaattttgaaggatttctgatgaattggaggtatggtgaaagagaaacggggagtaaaggataactccttgatgtggtttgtggtgcaagcaactaagaaagatttggacagttttggacttgttagtttgaaatgtcaattaggtatccaggggaaataggtaggcagtttgatataccagtctgcacttaaggaaagattaactagagagagatatttggcagtctgcagcatggatgttatttaaaggcatggcactggatccgagtatccacgagtgtggatagggaagaggagtgaggaccagcagccatggggcatttcaacgtacaatgattgaaggagactaa

SEQ ID NO: 223434 - DNA, 186 bp, Homo sapiens
gaaaagcagtcaatataaactactcctaagaaagcccagacactgaactttttagaattttttaatttagagacagggtctcactctgttgcccaggctgggtgccacactgtagcctcgccctcctaggctcaaccaactctcccacatcagcctcccgaggtgctgggaccacaggtgcatgtg

SEQ ID NO: 223435 - DNA, 231 bp, Homo sapiens
catctgacctgcacccttggcttcagagacatctagcttctgagtctctctagtacaggaagacacacaacaaaagaggctgagcgagccaagctgtcgcctctttgcagtcctgggccttctctcaagtctccctgcctcttcttgctgctacagggctttgcacacgctatttgcttctgtctgtgattcccttccttctctcttcttcccctcttccttcggatccca

SEQ ID NO: 223436 - DNA, 462 bp, Homo sapiens
tttacctcaaaacagtcatttcctacttttttctggttttctaattgtttacaaaaggaactctattttgtttttgaatcctctaatcatttttgatttccaagaactcttgtttctctgaatattgcctttttcaaaaataagctcttattcctgttttacagttaaaatatcttacatttaaagataatgattttcaaagacattttcttctcccatcattgggtccgttttctctagttttctgtttgatgattttggtatttctttcttgtgagaagctttcctcagttacagctagtaatccctcattgcctatccaggcagtgggaagactaacgtcctttttggacgttctgggtaagtggggcttcagtcttcaacacagttctccggccccaacacagttctcccgccccaggcatcttccgtccagagcaactttgttttgctctcctgaaa

SEQ ID NO: 223437 - DNA, 458 bp, Homo sapiens
ggtcagaattaaccttaccatttataaagcactttaaaggggtgcaaatgtgccagcattaacaaaaaaagactgcagaacaaaacgtagcctttggtttaagtgattgacgtgaaattattgcttctcgtgtgtccttcagtgaagatttgaggctttgtgtgtgccaggcattcttctggtttctgggaggctgcagaggtggatcagacacgggttcacttgtagtcatgtagcggtcagcagtactcctgtgacaacagtgctagctggcagcacatggcatccaccaggactgcccactgctatgtgaggagatgatttccagccatgagtgagtcagggaaggcacatggaggaggtggccaccaccccagggagcccaattagacaagtcagcttggattggacatggtttaaggaaacgcattcccagtgacaacctggggagaggtgag

SEQ ID NO: 223438 - DNA, 297 bp, Homo sapiens
catgtctataattttgtcatttcaagaatgttctataaatgcagtcatacatatgtgacttttcgagctgacttttcttcactcagcataatgtctttaagagttctgattagttgcatatacatcacattcccttcttattgctgagtaggattccatgatacaaatgaatcacaaatgtcccagagatttttttttccatgttttaagttttatggttgtagggtttacatttagaatctatgatccacttgcagttaatttttgcacaaggtttaggtcaaggtttattttgtt

SEQ ID NO: 223439 - DNA, 396 bp, Homo sapiens
cagtgggagaggctctgggtgtgaatgcgtgaccatgtggccatgcgggattaatgccatgactggggggttctgggtgtgattgtgcgtctcttgttttgatcagaacccacttagggccaggtgcagtggctcacacctgtcatcccagcactttgggaggctgaggcaggtggatcacgaggtcagaagttcaagaccagcctggccaacatagtgaaagtccgtctctactaaaagtacaaaaattagctgagtgtggtggcaggcacctgtaatcccagctacttgggaggctgaggcaggagaatcatttgaacccaggaggcggagtcgagatggtaccagtgctctccagcctggatgacagggcaagactccatctgaacaaagaaa

SEQ ID NO: 223440 - DNA, 757 bp, Homo sapiens
tcaaacttcttttagtttctccaacatactatgagaactttttttctcttttcttgccctctttactttcaatcctcctttacctggctcacactttcaggcctcagataaaatgccacttcagggaatatatttcctgacagcctaccaccatccccacatattgctgggtggccttgctaagtgctcccagagctacttggcattcccccatattggcatggattacatggcataattactcttagatcattgtctgtgtccttcattagacagtgtcatagtccattcaggcagctataataaaatatcataagctgagtaccttataaacaacaaaaatttatttcccctagttctggaagctggaaagtccaaggttaaagtgctggtaaacttggagtctggtgagggcctgtgttctggctcatagacagtgccttctagctgtacctcacatgatggaaggaatgaggatctatctggagcctattacataatggcactaattccatttgtgagggctctgccctcatgatctagtcacctctcaaaggccccagttcgtaatatcatcaccttgcaggttaggatttcaacatatgaattttgagaggcacagatagattttaagtactttgaggactggatctaagtctgtctgatttactgttgaatcttcaatgcctagaaactaatataagttcaatacataattgtagggaaaataaataaatgcataaattaatcaatggta

SEQ ID NO: 223441 - DNA, 434 bp, Homo sapiens
ctccaccctttcctgtccagaccactgtgaaggcctttagtcacctcctagagaagcaagattttcagccctggctttctacccccacaccctacagccggccaggggacagggtcgtgttcacacagtgctaagggaacacgctgacgtgtgtgacatcaagaactccagtgcccacacagcccgagtccggatggagggctcatcaatgtatggagaaatgaaagagcgccgcatttcacattggagggatctgggtttgagtccttgggccagccttgctacagtgggggcaagaacaccaatcacactggcttattacggaattcaaatgtggcagagtatttaaactatgaagtgtagaataaattaattggcttgcaattccccatagctagtactagaggctggcctcagatggaagaaccaggggc

SEQ ID NO: 223442 - DNA, 512 bp, Homo sapiens
ctccaccctttcctgtccagaccactgtgaaggcctttagtcacctcctagagaagcaagattttcagccctggctttctacccccacaccctacagccggccaggggacagggtcgtgttcacacagtgctaagggaacacgctgacgtgtgtgacatcaagaactccagtgcccacacagcccgagtccggatgggacgtttgaaatcaggaaggagtgtgggttggatccacgtttctgttcataccaggcaggcacatcggaaggctcacggtcagaggatgctgggacaaacgccacgagaggttcctttttgtctggctcacccagaagagaggctcctctcctcccttccctgcagcacaacggcctggctggcacccaaagggcagccggcgtgggctgacctcagaggagcaaggcgtgtttgcagctctgccgctcacatccacagtggccatgacaacaggtgcagcaccatccattaaagctctgtgtcatttcaaaaaa

SEQ ID NO: 223443 - DNA, 348 bp, Homo sapiens
gcacgagccaactgctcatattaatttataatatctggcatctaatttacacatataaaaaagcaggaggctgggcgcagtggctcacacccgtaataccagcactttgggaggccaaggcgggtggatcatgaggtcaggagtttgagaccagcctggccaatatggtgaaaccccgtctctactaaaaatacaaaaattagccaggcgtgtggtgggcacctgtaatcccagctactcgggaggctgaggcaggagaattgcttgaacctgggaggcggaggttgcagtgagccaagatcgcgccattgcactccagcctgagtgacagagctagactccgactca

SEQ ID NO: 223444 - DNA, 573 bp, Homo sapiens
caggcgtggttttagcatctggtacacagctgcaaataaggcagacatggtctctgcccacatggagcttcctatctagtgggagagatactcaacaatgtccagcattcaataaaaaaattactagatacacaaagcaaaccagtgcatatgtttggtggtggtatgtgctgcggagaagagggaggcaggataaaggtatagtcagtgccatatttgggctgtaatgagtgagtcttgtggctatttggtggaagatgttccaggcggagcttggattgtttgaagacagtgggcagaggtgagagggagcaggagggaggagaggacggacacagtaggtgggggccagatcatgaaagtgctggtaggccataataaatgcatcaattatctgtgttgctgcatcataaacaaccagaaaacttagtgtctacattggatgcaatgtacactgttcaggtaatggtacactcaaatctcataaatccccgctaaagaacttatccatgtaagcaataatcatgtaccccaaaaactattgaaataaaaacaaaataaaaataatcaaaa

SEQ ID NO: 223445 - DNA, 347 bp, Homo sapiens
agatctgagattgaaattggaagaggggtgttcagggccaaatcctcaattaatgaagatactgactgggagcacaactgagttggtgtcgggagggtgaaaatctcggaggcaactttgggattcggtaaggcaggccactctgcaaagaacacagcagctgatggagctgggtaggcagggccaggcattgcttgttgtcccttttctgtttttctttcccgtttttctccctttcttttccctaaatgtctttccctcttgtgcagtcacttgggtctctttaaattttattaacgggtttttaatttctttatttcttttactctcttttaattgaacacact

SEQ ID NO: 223446 - DNA, 173 bp, Homo sapiens
agacagacattaaaagttaaaggagataatatttcagattctaaaatctatcagatgagtgacattcatttctcctctcaatattctaacaaagctgttaggacaaaagacctattttacattaatacaaaaatatttgttttctaactccagatagtcaacaaaggcaagaa

SEQ ID NO: 223447 - DNA, 317 bp, Homo sapiens
ccttgcttgcccccagtgacgggaagctcagcccctccactgtcgtcatgaagcttcctcttggaacctgggctcgggctgtagtctgggcttcctggcccatgacatctcagagtgtgggaacagggtgggcctcagtcccgcccatgagttgggcgtcagatgggatccccctggcctcctcatcgctgcccccatccccgctgtcacacttcccactgggtccccacggccttcctgcctctggccctttaaggcccaggcaggaagcccctccccatttagggcaataaatggacacgtaaaatggccgaggg

SEQ ID NO: 223448 - DNA, 553 bp, Homo sapiens
acgataatgtagcctaccatggggagaaactcagtttaaatatccgtttctctgtgaaaatatctcagaagacacacattccaggctctttgctgaggattttattttgctgttatctcatttaatcatcacaacaattctggggaaatgggttcattttagaaatgtgaaaatcattactcagaaaattgtacattttgcctaaagtcacacaagctagtaaggatcagatccagggtttgaatccaggtctgctttgattccaaagcctgagcccttctatacaaactacacagttcaaacatgtcacagaatctctcctgccctggggctgtggcccttgctcccctatgacaccgatgttttaggaagatggctagaacctgcccggatttttccaaggaagtcagactaatccctaagtcaggcatacctttttccctctgtccttactgggctttggtactaggcagtggtttctgtcctccacaactgcccatggctgtctttgtgtgaagggaccccgattgtggccagttaactcagtgtccta

SEQ ID NO: 223449 - DNA, 436 bp, Homo sapiens
gagggactgaatgtttctacttaaggtggtatgcaccacaaaggatatgtagacaaaaagtttgaaaaactagagagagaaatgggaaattgagactatatatataaagacaaagaaataaaagactgcaagagaatgagatttggctgtgcccttcttgttgtgaaggacaaaaaagaaaacaggatgagttagaagctgttgtcagagaaaataagaactaaagtcaagtgtagtggctcacacctgtaatcccagcactttgggaagccaaggcgggcggatcgcttgaggtcaggagtttgagaccatcctggcaaacatggtgaaaccctgtctctactaaaaatacaaaaaaattagttggatgtggtggcaggcgcctgtagtctcagctacttgggaggctgaggtgggagaatcgcttgaaccctgg

SEQ ID NO: 223450 - DNA, 1941 bp, Homo sapiens
gtatttgtgttagatgttgttagatgtgttgtttttttgtgtgtgttttgtttcgttttctgagacagggtcttgctctgtcacccaggctggagtagtggcgcgatctcggctcactgtaacctccacctcccaggttcgagcaattctcctgcatcagtctcctgagtagctggcgttataggcacctgccaccacgccaggctaatttttgtattcttagcaaagacagggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtaacagtgtaagaatccaggttgtatagatgggtttttgtttgacacagatgtttctcccagtaaagagaggataaggagctggaactcgtggcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagcccaggagtttcagagcaacccgggcaacaaagtgagatcccatctgtacaaaaaattaaaaaattagctgggcatggtggcacatacctctagtccagctattctggaagcttaggtagaaggatcacttgagcctgagagatcaaggccgcagtatgctgtaattgcaccactgcactccaccctgggtgacagagcaaaaccctgtctcaaaaaaaaaaaaaaagagacacctggctttactgtgtatgctgtacctcagggcaagttttccctttgtcttctaatagacactttttggatccagaaattgttctctgcaatttctttacttaaacataattatcagcctgtatgacctctgtggtctgactactttgaaattaagggagaaggctgggcacggtggctcactcctgtaatcccagcactttgggaggctgaggtgggcggatcacttgagcccaggagttcgaggcaacatgacaagaccctgtctcgacaaaaaaacaaaaaacttagccagacatggtgacacacgtttatggtcccagctactcaagaggctgaggcagggggattgcttgagcccaggaggggctcaaggtcggcccaggaggtcaagacccaggcgatcaaggcccaggaggtcaagactgcagtgagctgtgctcatgccccactgcactccagcccagtcatcagagcaaaaccttgtctcaaaaaaaagtaaagaaagacatgtttattatatggtagtttgaaaaattacaaaaaaaagagtaaatcatggccggacgcggtggctcacgcctgtaatctcagcactttgggaggccgaggcgggtggatcatgaggtcaggagatcaaggccatcctggctaacacgatgaaaccccgtctctactaaaaatacaaaaaaattagctgggtgtggtgctgggcctgtagcccagctactcgggaggctgaggcaggagaatggcatgaacctgggaggtggagcttgcagtgagctgacatcgtgccactgcactccagcctgggtgacagagcaagactccgtctc

SEQ ID NO: 223451 - DNA, 585 bp, Homo sapiens
tgtatacccatcaccacaatctaattttagaacttttgtctcccctcaaagaaacccagttagcagttgctccccatttcttctacctgtagccacgaatctactttctgtctctatggatttgtctattctggacatttcatataagtggagtcatacaagatacggccttttgtgtccgacctctttcatttagcataacgttttcaagtgccagccgtgttgtcacatctatcagtatttcgttcttttttattgccaaacatcctattctaaggatatatcctgtttgtttatccagtcataagttgatggagcttatgatggttttcactttttggcttttaagaataatgcagttatgaacattcatgtacgagttttagtgtggacatcatatgttttcatttttcttgggtatgtacctaggagaattgttgaattaacgtggtaactctatgtttaactccctgaggtgctgtcacactgctttccacagtagctgtaccattttacatgcccaccagcaatgtatggaggttataatacctacacatcctcaccgacacctgttattgtctgtct

SEQ ID NO: 223452 - DNA, 661 bp, Homo sapiens
ttcattgctagcagtttttctaccctctctcctgcaggcattctcccagaaaaaaggctgactctgtggtgccatttgagagaaataggttcagtagattcttccagagatgacaaacgaaaagacttgatgtggaagtaagagaagtaggggcgtcaggacactgaagtgagagatcttttgttctcgtggcattggagaagccaggaaagaaaaaggctttagcagggaccaggtgcgtccactttgcaagtggatttggagagaacaagcagtgttcacatatcagtccagcaatgtctcaagactccttcctggaacagtcatcagtttaatccagtgaggatggtgtctctcttctttcatgagcattttcctatttctgaaatattaataaataggtgctttgttcctaggaagtggagagaagtcaaggaaaatactcatcatactcctagaagtcaaggaaaatactcctcgtactcctcatggccgctggagcccgctgctatgaggttatggagaacgtcttgaacattccattccccagcacctagtgcagtgactagcatagtaggcactcaaaaagtgtctgtaggattgtatttcaaactttagttgtctttcccaaagaagcctgtcgtgcccacacgcggccgca

SEQ ID NO: 223453 - DNA, 278 bp, Homo sapiens
ttcattgctagcagtttttctaccctctctcctgcaggcattctcccagaaaaaaggctgactctgtggtgccatttgagagaaataggttcagtagattcttccagagatgacaaacgaaaagacttgatgtggaagtaagagaagtaggggcgtcaggacactgaagtgagagatcttttgttctcgtggcattggagaagccaggaaagaaaaacctggggccctatggcttaattgctgaattccaccaaacatttaaagaactaatttcaatc

SEQ ID NO: 223454 - DNA, 892 bp, Homo sapiens
gcacaggaagcgtgtaggaagcgtggcgcctcagccacaatcgtaatcacctttaatctcttgctcaaaataacccaaagtcaagccagagggagcctcgctaaccaccaaggcggtcctgcggccccgcgcagccctgagggcgtccagtcctccacgcgtggaggagaatccggcctccagacacaatctccagggcccactggatgggcctccgctccttctcactcccagtcctctggtgcatgcccccttcctggctgaagaacctgcaccagccgcccctccgcctgggaagctccctcctgtcattcactccgagacgcagcagcgttgccccaagagccctccctgctctgcaccccgaattcactctcagcccccacctagtttaaatcctggcccttctctctcttccgttgaatgggagtaaagaccactcctcccagggagcttgtggtttctcacaaaagaaaaacaaaacaaaaaaaaaaaaaaaaaaacaaacaacataagacaaaacaaaacaagccgaagcaacacgtctcacccgccggcggggacgcagagcagacatgagcagagacaggcagcaaagaacccacagagagggcccccaacaacgcgaccgccggatggagtaccaccaagaagagacacaacggagggcgcgcccggacacagcgcgtaagagagcagagcgactggaacaaccaacacgaagcaggaggcacgcgaacaaccaaggcgcgaagagcagcagaagcatacaaaagcagaacaagacacctcggagcgagactagatagaaagacagggggcccgcaccaccacgagccaacacaacccagggaggaaccacacacaagaagacaagggggaaccaaaagaa

SEQ ID NO: 223455 - DNA, 1412 bp, Homo sapiens
gcacaggaagcgtgtaggaagcgtggcgcctcagccacaatcgtaatcacctttaatctcttgctcaaaataacccaaagtcaagctgaccctcggtctatcttgaggccctcggctgcccccgacttgaagattctcccccgttgcgtctaagtggctgctccaagttcccgtccccgctggcatctccctgcctcaccatccgccacattcctacaccaaaagttgacgccgcattctggactcctctctttcctccccccacacctggtccaactccagcagcatctaatccacctgcagaagcatctggaatcactccactcccaccacgaccgcccaaacccacctccagcggggacgacgcccaaggtaccacctggtctcctggcacccacaatccattctccctccacagccagagggagcctcgctaaccaccaaggcggtcctgcggccccgcgcagccctgagggcgtccagtcctccacgcgtggaggagaatccggcctccagacacaatctccagggcccactggatgggcctccgctccttctcactcccagtcctctggtgcatgcccccttcctggctgaagaacctgcaccagccgcccctccgcctgggaagctccctcctgtcattcactccgagacgcagcagcgttgccccaagagccctccctgctctgcaccccgaattcactctcagcccccacctagtttaaatcctggcccttctctctccctgatgttctgcttggttatttacttttaattcatgttggagctcctcctgccactgcaagagcaggagctgtgtgtcctggtcactgctgtggcatcccagggccggcgcggtgcccagcagccaggactggacagactcgggccacgctgcgcacgggctgggatgcgcttgctctgcttcctcttccgttgaatgggagtaaagaccactcctcccagggagcttgtggtttctcacaaaagaaaaacaaaacaaaaaaaaaaaaaaaaaaacaaacaacataagacaaaacaaaacaagccgaagcaacacgtctcacccgccggcggggacgcagagcagacatgagcagagacaggcagcaaagaacccacagagagggcccccaacaacgcgaccgccggatggagtaccaccaagaagagacacaacggagggcgcgcccggacacagcgcgtaagagagcagagcgactggaacaaccaacacgaagcaggaggcacgcgaacaaccaaggcgcgaagagcagcagaagcatacaaaagcagaacaagacacctcggagcgagactagatagaaagacagggggcccgcaccaccacgagccaacacaacccagggaggaaccacacacaagaagacaagggggaaccaaaagaa

SEQ ID NO: 223456 - DNA, 1079 bp, Homo sapiens
gcacaggaagcgtgtaggaagcgtggcgcctcagccacaatcgtaatcacctttaatctcttgctcaaaataacccaaagtcaagccagagggagcctcgctaaccaccaaggcggtcctgcggccccgcgcagccctgagggcgtccagtcctccacgcgtggaggagaatccggcctccagacacaatctccagggcccactggatgggcctccgctccttctcactcccagtcctctggtgcatgcccccttcctggctgaagaacctgcaccagccgcccctccgcctgggaagctccctcctgtcattcactccgagacgcagcagcgttgccccaagagccctccctgctctgcaccccgaattcactctcagcccccacctagtttaaatcctggcccttctctctccctgatgttctgcttggttatttacttttaattcatgttggagctcctcctgccactgcaagagcaggagctgtgtgtcctggtcactgctgtggcatcccagggccggcgcggtgcccagcagccaggactggacagactcgggccacgctgcgcacgggctgggatgcgcttgctctgcttcctcttccgttgaatgggagtaaagaccactcctcccagggagcttgtggtttctcacaaaagaaaaacaaaacaaaaaaaaaaaaaaaaaaacaaacaacataagacaaaacaaaacaagccgaagcaacacgtctcacccgccggcggggacgcagagcagacatgagcagagacaggcagcaaagaacccacagagagggcccccaacaacgcgaccgccggatggagtaccaccaagaagagacacaacggagggcgcgcccggacacagcgcgtaagagagcagagcgactggaacaaccaacacgaagcaggaggcacgcgaacaaccaaggcgcgaagagcagcagaagcatacaaaagcagaacaagacacctcggagcgagactagatagaaagacagggggcccgcaccaccacgagccaacacaacccagggaggaaccacacacaagaagacaagggggaaccaaaagaa

SEQ ID NO: 223457 - DNA, 900 bp, Homo sapiens
atttcggaccaggaccaggaagtaactttagaggaggatctgatggatatggcagtcctctggtgcatgcccccttcctggctgaagaacctgcaccagccgcccctccgcctgggaagctccctcctgtcattcactccgagacgcagcagcgttgccccaagagccctccctgctctgcaccccgaattcactctcagcccccacctagtttaaatcctggcccttctctctccctgatgttctgcttggttatttacttttaattcatgttggagctcctcctgccactgcaagagcaggagctgtgtgtcctggtcactgctgtggcatcccagggccggcgcggtgcccagcagccaggactggacagactcgggccacgctgcgcacgggctgggatgcgcttgctctgcttcctcttccgttgaatgggagtaaagaccactcctcccagggagcttgtggtttctcacaaaagaaaaacaaaacaaaaaaaaaaaaaaaaaaacaaacaacataagacaaaacaaaacaagccgaagcaacacgtctcacccgccggcggggacgcagagcagacatgagcagagacaggcagcaaagaacccacagagagggcccccaacaacgcgaccgccggatggagtaccaccaagaagagacacaacggagggcgcgcccggacacagcgcgtaagagagcagagcgactggaacaaccaacacgaagcaggaggcacgcgaacaaccaaggcgcgaagagcagcagaagcatacaaaagcagaacaagacacctcggagcgagactagatagaaagacagggggcccgcaccaccacgagccaacacaacccagggaggaaccacacacaagaagacaagggggaaccaaaagaa

SEQ ID NO: 223458 - DNA, 673 bp, Homo sapiens
tgtgtccaaagctggaagctgccccagccaaacactggaaacacccagctctccaccaagataaaccacgcgagccacagcttgcgggcaatatcccatctccatcctcaccactgctcagcccagacctccctcatcttcctggcctgcagaccttagcagtggctgttcccacccctggaacacccttcccacctggtacctgatgcctgcagggcccatgcacggcatattcactgctgtatccccagagcctcgcacagtgcctggtgcagagatgattttcagcaaagaggcactgaagggaagatacctatgtgactgtgaggagacacaggctggacgatgaatgtgatggctggaactcaagcagccacagtggatcataagggacggtgtcttgctatgttgtccaagctggtctcaaactggcctgaatcaatgcttccacctcagctgccagaggaaccgggattacaggcctgagccactgcagccagccagtttgttattttaatgtaaattcttagtaaacaactcaggagctctcttgtccttttaaaatccatttcaacttctgctaatcggagtgtatattcagggcaacttgaatctgtgctcctgggatgcaatcctcaagcttggcccaaataaagtctccgctgatattaat

SEQ ID NO: 223459 - DNA, 514 bp, Homo sapiens
atctctgcagggctagcccagaggttggcggcggaaggcccacagctcccctggctccatgggcaatgaccgaacagcccttcacctctctgggccttgttttctcaaactgaaactggagaggatgaccccagcctgggaccttcgagggcctcaaaagggctctgggccttgcgtggctggacgatgaatgtgatggctggaactcaagcagccacagtggatcataagggacggtgtcttgctatgttgtccaagctggtctcaaactggcctgaatcaatgcttccacctcagctgccagaggaaccgggattacaggcctgagccactgcagccagccagtttgttattttaatgtaaattcttagtaaacaactcaggagctctcttgtccttttaaaatccatttcaacttctgctaatcggagtgtatattcagggcaacttgaatctgtgctcctgggatgcaatcctcaagcttggcccaaataaagtctccgctgatattaat

SEQ ID NO: 223460 - DNA, 3025 bp, Homo sapiens
  misc_feature (10)..(10): n is a, c, g, or t
ggcggggctngcggcaggagacgccgcgttgagagcttgggctcctccgtgagccgccggcgcgcttcgctgcctggcggcctttccccgagccgagcccgcttcccgaggccgccagtcgtcgcctgcccgcgcctgcgcagcgtcccgggccgagagggccacggcggcggccatggcgcaccgctgtttgcggctgtggggccggggcggctgctggccccgcggcctacagcagctcctcgtgcctggcggcgtgggcccgggcgagcagccctgcctccggacgctttaccgatttgttacaactcaagcaagggccagcagaaattctcttttgacagatataattgctgcttatcaaagattctgttctcgacccccaaaaggatttgaaaaatactttcctaatggaaaaaatggaaaaaaagctagtgaacctaaagaagttatgggagagaaaaaagaatcaaagccagctgctaccacacgctcttctggaggaggaggtggtggcggtggaaaacgaggtggcaagaaagatgattctcactggtggtccaggtttcagaagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtagacagattggaagtcgtcaacaagcgttttgttcgagtgacctttacaccaggaaaaactcctgttgatgggcaatacgtttggtttaatattggcagtgtggacacctttgaacggaatctggaaactttacagcaggaattgggcatagaaggagaaaatcgggtgcctgttgtctacattgctgaaagtgatggctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaagggtgccattctcactggtcctccaggcactgggaagacgctgctagctaaggccacagccggagaagccaatgtccccttcatcaccgttagtggatctgagtttttggagatgttcgttggtgtgggccctgctagagtccgagacttatttgcccttgctcggaagaatgccccttgcatcctcttcatcgatgaaatcgatgcggtgggaaggaagagaggaagaggcaactttggagggcagagtgagcaggagaacacactcaaccagctgctggtggagatggatggttttaatacaacaacaaatgtcgtcattttggccggcaccaatcgaccagatatcctggaccccgcgctacttaggccggggcgtttcgacaggcagatctttattggaccaccagacataaaaggaagagcttctattttcaaagttcatctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgagcgagtgattggtggcttagagaagaaaacgcaggttctgcagcctgaggagaagaagactgtggcataccacgaagcaggccatgcggttgccggctggtatctggagcacgcagacccgcttttaaaggtatccatcatcccacgtggcaaaggactaggttatgctcagtatttaccaaaagaacaatacctctataccaaagagcagctcttggataggatgtgtatgactttaggtggtcgagcctctgaagaaatcttctttggaagaattacaactggtgctcaagatgacttgagaaaagtaactcagagtgcatatgcccaaattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactagaggcccagagggaggccatctcagtctctccactgtggtttcagctggtgcattatttcagctgtggctttcagaagaatgggaatgctgcgctgattttagccagccactggcccagctgaaatgatggggaaaggagtccttagtcctttcagcctcagaggtcacagtgggtggcaggtgactttccggaggccttgagggaaatgcacactgtcccatagcctcattgggctcccagacgtgctggaaaggttgagcccagagtggccgaggctggaccctgtggcaccaagtggggtcggctgaccgtgtggcagggatcgttgcactggactcttggcgtgtgggaagggatgctttctctttgtcgcccactcttcattcctgtttctcctcagttcccctgtgcagatgggctgtgaaattaaattggagtcttgataagaacatttt

SEQ ID NO: 223461 - DNA, 945 bp, Homo sapiens
  misc_feature (10)..(10): n is a, c, g, or t
ggcggggctngcggcaggagacgccgcgttgagagcttgggctcctccgtgagccgccggcgcgcttcgctgcctggcggcctttccccgagccgagcccgcttcccgaggccgccagtcgtcgcctgcccgcgcctgcgcagcgtcccgggccgagagggccacggcggcggccatggcgcaccgctgtttgcggctgtggggccggggcggctgctggccccgcggcctacagcagctcctcgtgcctggcggcgtgggcccgggcgagcagccctgcctccggacgctttaccgatttgttacaactcaagcaagggccagcagaaattctcttttgacagatataattgctgcttatcaaagattctgttctcgacccccaaaaggatttgaaaaatactttcctaatggaaaaaatggaaaaaaagctagtgaacctaaagaagttatgggagagaaaaaagaatcaaagccagctgctaccacacgctcttctggaggaggaggtggtggcggtggaaaacgaggtggcaagaaagatgattctcactggtggtccaggtttcagaagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtgacagactgccaggtcgcacagcgtatgtcgactagacttacccaggaaactcgctgcggccaacgtggtacattggcgtggacctggaggaatggacacaaacgatggctaagaaacgccgcgccaggcaaaactcagagcagacaacccccaaagcgtggcgcacgataacaaataatggtacacaacaacaaaccacaccccccccacacctc

SEQ ID NO: 223462 - DNA, 2896 bp, Homo sapiens
  misc_feature (10)..(10): n is a, c, g, or t
ggcggggctngcggcaggagacgccgcgttgagagcttgggctcctccgtgagccgccggcgcgcttcgctgcctggcggcctttccccgagccgagcccgcttcccgaggccgccagtcgtcgcctgcccgcgcctgcgcagcgtcccgggccgagaggctttaccgatttgttacaactcaagcaagggccagcagaaattctcttttgacagatataattgctgcttatcaaagattctgttctcgacccccaaaaggatttgaaaaatactttcctaatggaaaaaatggaaaaaaagctagtgaacctaaagaagttatgggagagaaaaaagaatcaaagccagctgctaccacacgctcttctggaggaggaggtggtggcggtggaaaacgaggtggcaagaaagatgattctcactggtggtccaggtttcagaagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtagacagattggaagtcgtcaacaagcgttttgttcgagtgacctttacaccaggaaaaactcctgttgatgggcaatacgtttggtttaatattggcagtgtggacacctttgaacggaatctggaaactttacagcaggaattgggcatagaaggagaaaatcgggtgcctgttgtctacattgctgaaagtgatggctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaagggtgccattctcactggtcctccaggcactgggaagacgctgctagctaaggccacagccggagaagccaatgtccccttcatcaccgttagtggatctgagtttttggagatgttcgttggtgtgggccctgctagagtccgagacttatttgcccttgctcggaagaatgccccttgcatcctcttcatcgatgaaatcgatgcggtgggaaggaagagaggaagaggcaactttggagggcagagtgagcaggagaacacactcaaccagctgctggtggagatggatggttttaatacaacaacaaatgtcgtcattttggccggcaccaatcgaccagatatcctggaccccgcgctacttaggccggggcgtttcgacaggcagatctttattggaccaccagacataaaaggaagagcttctattttcaaagttcatctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgagcgagtgattggtggcttagagaagaaaacgcaggttctgcagcctgaggagaagaagactgtggcataccacgaagcaggccatgcggttgccggctggtatctggagcacgcagacccgcttttaaaggtatccatcatcccacgtggcaaaggactaggttatgctcagtatttaccaaaagaacaatacctctataccaaagagcagctcttggataggatgtgtatgactttaggtggtcgagcctctgaagaaatcttctttggaagaattacaactggtgctcaagatgacttgagaaaagtaactcagagtgcatatgcccaaattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactagaggcccagagggaggccatctcagtctctccactgtggtttcagctggtgcattatttcagctgtggctttcagaagaatgggaatgctgcgctgattttagccagccactggcccagctgaaatgatggggaaaggagtccttagtcctttcagcctcagaggtcacagtgggtggcaggtgactttccggaggccttgagggaaatgcacactgtcccatagcctcattgggctcccagacgtgctggaaaggttgagcccagagtggccgaggctggaccctgtggcaccaagtggggtcggctgaccgtgtggcagggatcgttgcactggactcttggcgtgtgggaagggatgctttctctttgtcgcccactcttcattcctgtttctcctcagttcccctgtgcagatgggctgtgaaattaaattggagtcttgataagaacatttt

SEQ ID NO: 223463 - DNA, 197 bp, Homo sapiens
cgttttgttcgagtgacctttacaccaggaaaaactcctgttgatggggtaaatcattttattaattgatgtgaattagttgtaaattaactttttcagatttaaagctgaaaggaaaacctgcctcatactctaggagttatacgcaccagatatatcagaactgggcagtgtggcaggggtgatcttactaacat

SEQ ID NO: 223464 - DNA, 335 bp, Homo sapiens
cgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaaggtaaaatgaaatttaagattaactttttgaaatgtttcttgatctctgaagttataattctgtgaagtttgattacttattatagatagctgtttttctg

SEQ ID NO: 223465 - DNA, 515 bp, Homo sapiens
cacactttaaactttgagtggggactgaggaatttgcatcccaactctgtgacttattcactgtcccctaacactgccacccatccaacaagttacttaagctatactttctccctctgtgaagggtataacagtcctataatttcttgggttattgggttattgtgcatatttcatgagatgatgcaagtatagcccttgggagcctccctgattggtaagctttgtatttgtattctttctcatagtgcttcacttagtaactgatcagttgccacagtgtattctgcaatgagtcttttattaaaccgtatacatgaagacattgctgagagagctaaaaccttgccgtgcttctgtgtgtgctctttgtttatgaacagaatcaaagccagctgctaccacacgctcttctggaggaggaggtggtggcggtggaaaacgaggtggcaagaaagatgattctcactggtggtccaggtttcagaaggtttgatgctatacattgtgtgaat

SEQ ID NO: 223466 - DNA, 190 bp, Homo sapiens
actgaaataagtatctccactccccaaagtgatacatctgaagtcatctggctgactgtgtgtccagaggcaccacgtcagtgtctctttgccagagcctttatgggggtggtacgaggggaactggagtctgggggcacgtcaggccttcatcaatcagaaggcagtggcagcgacagcaagacaggcg

SEQ ID NO: 223467 - DNA, 455 bp, Homo sapiens
gcaacagcgtgagactctgtctcaaaaaaaaaaaaaaaaaaaaaaaggaaaaatgcatttaaagtaactttggaaaaaatgaattaagaacttttcccttcctaattaaaaaacagcgaattgactacctaataaagccagtaattgtgactagggagcattatcattgcctagcagagtttcccaaatcgtggctccgaagccctgtggctctctttcagcacattatgcaagtctttggcacgaagtagaaaggaataagggtggaattcaaagttcatatatagtagtaaggatttagaaaagagatgaagatacacactcaaggaaaattaatataaaatggatgtcagctgggagaggaataagtacgtactcaggaataaatcacttttatagctctgctttaaagctctattactttctgttaaaatgtattttcaagtgttatgttg

SEQ ID NO: 223468 - DNA, 498 bp, Homo sapiens
gggaaggcaccatgggagagatggggtggagacaataagaggcaattgaaattaaagggaagttgggcagaatgtggagacccagcacctgctagatcctctgcaagtgtgctggaaatgaacagcgaaatcagggagcaaactaacacatgacctcaattaactgatgaaagaattaatcatacttcatactgagcacttattttgtgccaggcattgcactaagtgctttacatatgtagttgtcccttgaacaatgtgggtttagtggtgttgacccccctttcagctgagaattcaagtataacttttgtgtcccccaaacttaactattgattgcctactgttgacctgaagccttaccaataacataaatgaccgattaacacatatttgtctgttacacgtgttatatactgtattcttacaataaagtaagctagagaaaaaattttaagaaaatcatagagaaaataaaaattggctgtttttaaatgg

SEQ ID NO: 223469 - DNA, 451 bp, Homo sapiens
attatcttccaccacagcagaattttttaacagtttaatcatcatcagcctttagtctcagtcatcatatacccatcttgcaacctcattctccctaattttatcgtggaaatgaaaaaaaaaggaccttcttttggaaaagattagattattttgatctagcatgaccaattattaacacttaaatagtttgtagcacccacggagcagtgttttatagttttccttagtttttacatttagttgtttctattctgtgaatgaaattaaagcaagtattaatacttgatctattttctatgaattatgtacttcaattaatgtagtttttcatatctatcaaatcaaaataattattagtccaaaaagttaatatgattattttttaaaaacatttgtttagaatcactagatgtttagatactaaattagaaaagtttgtcccatacca

SEQ ID NO: 223470 - DNA, 571 bp, Homo sapiens
gacttttacaaagctataataatcaagacagcatatttggtgtaaacataaacatatgcattaataaaaagtatccacatataggatcaactgattttcaacaaaggtgccaaggcagttcaatgaaggaaggacagagttttcaacaaatagtgctggaatcactgaacatacatatacaaaactaaaacaaaataacaacaaaatctcagtccttacccttacactatatataaaatttaactcaaaatggacctaattaatgtaagagctaaaaactataaaacttctagaagaaaacataaaagaagatcttgggttagatatattttttttaagacacaacacccaaaacatgatccatagaagaaaaaatggataaaatggacttcaacaaaaataaaagctgctgctctttgaaagatactgttaagaaaatgaaagctagacacagtggcgtgtgcctgtagtcccagatactcaggaggctgaggtgagaggattgcttgagcccaggagttcaaggtcagactgcccaacacagcaagactctgtctttaaaaggcaaaaa

SEQ ID NO: 223471 - DNA, 528 bp, Homo sapiens
cagaaagagggaagacaactctttcatgacatataactctctttaaagcattaacatacggaacttttctgaaagggtcaaaggggactaatactgaaaatggaagtgaacaatgtgatgagcactctgaaagggtgaggtgtattgacaactaaggtcttctcactggtattttgtggtttctttttgaaaaatggaggtgattctcaccttttgggggaagatctgttgctatttgaccatcattggcaagtatctaactgtttcacatctccagagaaccaaaggtaaattataaagctgacaggaatataaaaattcatcatttctgctcagtgtatgaatttggattaatatttaatgattcattaaatttttgtattttgtcttcttcccactgtcagtgagtaaggtttaatggaattgaatgaagtctatgtttactcacttttatggcttctgtgtcctcaggataatgtctgacgcatattaacactcagtaaatatttttattattgttgttgtgta

SEQ ID NO: 223472 - DNA, 413 bp, Homo sapiens
ccaacgggctgaaaattccatcttgtggatgtaaagaagcagaagttgtcattttgagtctgagggaagtctgcagacagaattccttcctcttcaagggacctgggtccttgctcttaaggccttcaattaattggatgaggctcattcacactgcggaagataatctgccctactcaaagtgctctgacttaaccacattgatcacatctgaaaaatacctttgcatctacactggtgtgtgaccaaataacgaggcaccattgcctgggcaagttgacatgaatttaaccaccacactagagagctctcccgatgcccatggagggccattgctgtgggtatcaaatggctcagggagattctgtagagaaatattttgtttccaagaaaaatcaatcagtcttgatcca

SEQ ID NO: 223473 - DNA, 412 bp, Homo sapiens
aatttgaattgtaatatcaatatgaacttatgacgcttttatcttaaggaaaatgaaaagtatttcctacctagctctgtttacttaaaaggcctagaaacaaggacaactcagtagcaatgagcaccccagcacccagattctggtttcaaatactatttcccacaaaaagaaatgggggctctttggagaccggctgaatccaaaccttgcggggagatcagtctggaccatctagttatagtagaaagaaaagaaagtatctaagagtaatgaggggagtcaaagggtaggatcagatcacttgagggtcaataatagtcattacaagctgagagtcgataagaataattgcaatgaattgaaacatgttgaatatgtttaagtctatgagttcataatgatactaaaa

SEQ ID NO: 223474 - DNA, 456 bp, Homo sapiens
gcaagtttacaatttcatgttgagctaaatccattagctttatagcatttttttgtgttttatttcctcttataagtgaaaagaagtgaaagtgaagaacatttatttgtttgaagaagataggaaagcagtgctacttatacttccgagttcatattcggtttaagtatccaagatagctggatctttattaaataatttattaaaattaacaaatactctgaatggaaatattgttcaaaattataatgttgaaaattttcaaattcccaggtaaacatttgaattggatttatatgaggagttagaagaaaatacttttctcataatttgaagatatatgatgccagtggaaaatcttgtagacactttctaaattattttgattattacctttttccacggattgtaatttagaggcttcttttctccccagcattcaatattatctatcag

SEQ ID NO: 223475 - DNA, 182 bp, Homo sapiens
tagaacttaaatatataatttgggggcagacacaatttagtccatagtatcagcagggcctggtggctcatgcctgtaatcccagcactttggaagtccgaggcgggtggatcatgaggtcaggagattgagaccatcctggccaacatggtgaaacccgtctctactaaaataccaaaaaa

SEQ ID NO: 223476 - DNA, 380 bp, Homo sapiens
gaacaatcacatgaatgaagtccttcagtatataagagcagatgagttccagtgcagaattgctgggattggcctgaggtgcagaaattgattatctgttgaaacagtatggactgcagaatatatggataaaaagttaggtagatttactagtgagagtatgaggaagttatttttttatttcctcagtgaaatgaagagcacagtcatcagctaagagttgggggaaggactattgcaggttagagataaaaggggaagctaggaaaagaccaaaagaagaataaatagacttgggaaatgtgataggattaccaaaggggtccagttgagagttttggctatgtagttatatgtttcaaaggaagaaagaatagagg

SEQ ID NO: 223477 - DNA, 447 bp, Homo sapiens
gcattggtctatttttccacttactttgtgagtttttctctccctttccttgctgtcagtgtcctcatgtagcagcttttctccttatttctaattttctcattttacatctactacaggctttgaaattgcatactgaagcttctttaagtactatgtaacctaagattaggccttgaaataagggcaaaagagatcactttcaagccacatgtgtgagatttgaatgcaggcccttgagatgatactttggctgtatacaggtttgttgcttcctgctttaggctacatctaaagcagagttttctctgataagagtttgggttagattcaacataaccttagaagaaatggctaccctattttatttatgctttgctttttttacaaaaaagaaattttattaaaatgtatagaaaatcatgtgataaaatattttttaaaaaa

SEQ ID NO: 223478 - DNA, 129 bp, Homo sapiens
gaatggaatggaatggaatggaacggaatgtaatgtaatggaatggaatggaatcaacccgagtgcaggggaatggaatggaatggaatgcaatggaatggaatcatccggaatggaatggaatggaat

SEQ ID NO: 223479 - DNA, 789 bp, Homo sapiens
gacgttatagcgtggtatcaggcaggcagacttctgatggcccattcagtttcagtagatgcctggattttctactggcactgagccagaggctgctaggctcagaggtgcctctaacctcacttggtgacttcattttcaaaaccgaacctgagaaactggcaatctgtcatatctagactcaaaagcaatgggccacaatatcttgtctgtgtaaggcactcatgcttctttgccacattatttgataatggtttcatgtcatgaatgcacaagtagagagatcttatggaaaatatattggcatgaataaggacaggcatatatttgctgtcacccttctctaaaggtggaagaataacctggtgtagaggatgatggaatcagagttaagagacgtaggtccttgccatgctggcaagaactaagtgaggcactggacttctttgtgccaaggattcatggaaaatgccatgggggtcattctctggttaacagaggtcacctgaggatctgagtaaaaactgtgatgtctgttgcctttataggcaaaatgaataggttaaggtattgactgtgaagtccaggggaagtgatgatgctgaaaggtaacatgtaaagtgatggtgggaagatgaatatcagcatagatgaggagtgggaaccagcagttctttagcagttttgttcaggtgatggtcatgggcttggtgattgatcaggtgtgttccagagtagggcaggaagatgcagagatactatttcaaaatctaggagtaatgaacgccg

SEQ ID NO: 223480 - DNA, 405 bp, Homo sapiens
aaaaacagaaaacagttggatacagattcctgagttggaagtgcactttggccaactcccttcattatcatactaaaatccctgcccaaggcagagcttactcaccattttctacacgtgacatatgtaggagcatgatcagccactgtgactgtgagtaaagctgcctttactccatctctacgcacagtgactcagctaactagctcaataaaagccctatttcaccattgtttgagaaggtactgcttcggggaattattcccagtgccctctttacttgctgtaagtaataaggtcctcttgttacatgctccttggttgtggtgattgacagttacccaccaagcaatggagcccacccattgtgtgggtaacacttccaaccttgacattgtataatta

SEQ ID NO: 223481 - DNA, 388 bp, Homo sapiens
attgcacatgtgcatgtttctcctttcataaatattcatggctccttctatagcttattgaatatgtgtatttggccgccttgctcagcataaattcctgtttcctttgcccctctctcaaagtatcttgtttctggcttctggctggaggctgtgcttcccagcctgtcagaatagccaccctgcaggctgtaacctttataagaaataaagtttcctcttgttttaaacaaacaaatgaacaaacaaacaaacaaacaaacaaacaaacatatgccttagttgggcattggagtttgtgactgtaatcccagctttgcaggaggatcacttgagcccagaaatctgaggccagcctgggcaacatagtgagacccatctcattaaa

SEQ ID NO: 223482 - DNA, 456 bp, Homo sapiens
caggggtttctgttcttatttctgacaaaacagtctttaaaccaatgatgatttaaaaaaaaaaggggacaaggaaggacattacataatgacaaagggcccaacccaacaagaagacttaactctcttaaatgtgtatgcacccaacattggagcatctagattcataagacaggttcttagagatctatgcagagaattagataactacacaataatggtgggagtcttcaactctccagtgacaacagtgttagacagatcactgaggtagaaaaataacaaagatatttgggacctaaacacgacacttgaccaaatggacgtaatagacatctacagaatactccacccaacagcaacagaatatacattcttctcatcaacacacagcacatactctaagatggaccacacccttggccgtaaagcaattttcaacaagttaaaaaaaaa

SEQ ID NO: 223483 - DNA, 430 bp, Homo sapiens
tttatgaagaatgggttggtgccagggtaggagaagtagcctgactaggccaatgagcaaacctttgttttagggaagagaccttgtaacaattggcctcttggaaattgcagccaaggtttgtttatcggaacgatgggaatttgtccttaggcagtcctctttgcctttctgaaacatctgtgatttagtattatttctgggcaataagtcaaggtccacaacttagttttctgttgtcctttaacattttaaaatatgcctacatctctttcatttttagttttcttcacagactccttttgtttacctccctctctggtgttttgcatgattatagctaactttcttttctttcgacattctccccttggacacagttttaactctttcatatcttggtggttaccagatctctgtctccaaccct

SEQ ID NO: 223484 - DNA, 667 bp, Homo sapiens
gtgactctgaggatcccccggccagaacacactcaaagagcttttgcaaaaattagatgaaatagtgcatgttaagtatactgccttctttatccacagtaagtacttaatagatgacagatattcgggctgggggcctaaagcccagtgccttacacaatccatattgtattacaatagatgtttatggaaggaaatgggatgagcctttatggctaacaaggtacagatgtttcgattgttaagcatcatacaccatcaggtaccactcttcatccaaagatggtgtgacaaattgacaaagggttaggaaaaagtgtttagagagaggtgggtaaattcaacttggctatcaaatgtatatcatatagaaacaaggatgctgaggttattaaaataacctatttgctacagccttggtgtctgtcctctctcccatgggaacaatgggaggaagggtgagcagaagaaagagtaacaccctccaggttgtggtactattgtgtgttgccattttgttattaaagccatataccatagcttaggcgtgggggacaacaataagtggcatcgggccagcttcatcagaaggttagtatttcctatagatttatggtacctaaagggttgttttgtttgagtgtgattctggccggttttgtttttt

SEQ ID NO: 223485 - DNA, 542 bp, Homo sapiens
tgcatcagttatcacctctagaaatctcagaattatcttcaattctgcccaatacatagaattgtacactggattctaaagaagtggctctcaaatgtaccctcttctttctttgcctactcccataagttgtcaaaaaaaaaaaaaaaaaaaaaaaccacaccaataaaaccaaccacctctgatgagattatgattcttctttcaactccttcaatgaacctcagaatctagggaatgccacccaacctccttggaatggtcttgtgtcatcttgcccccaacagactaatttcatcttccaaagggatctttgttgccctgcccatcaccctcataagccaatctgctcttccttaaacacttgggacatcttaatacctctgcgcctttattaatttcattccgtcctctttctccatcatcagtacagagtgcagtttctacaacctgctatctccaggctcactgttccctctatctgaaatgccttctcctgcaaactcaattcatccttaaagtcacagcatgagctataaaca

SEQ ID NO: 223486 - DNA, 579 bp, Homo sapiens
gggagaagcagcaggctgaagtggctctttagggagacacatacctccacaggaagagcagtctagattgttttagcacattccacttaaggattgcagtgtgacagcagagaaaatcctctccagtcaagtaattgcatccatttcatcttcccagccctcctctagatgggaggtggaggtgtgtgtaccaatctcttaattcagaaatgagacaagaggaggaaaaaggagttccggaggacagtggggaccccagccagagcctggggacttggctgccttggaaccagaacctggcccctcagaggagttgcagaatttcgatagaggagtggcaggaggtgtactggctgaagaggaggcccaagggaagagaacgttgccctcattggtctggaatcagcaggtacctcatggctggaggtgtattttcagactcctttggcatctggtgaggcctgtggattcattctcagaatcacatttttaaatgcacataataaaatacatagaattgcaaaggaagttaattatattgaaatacagttatcaaaaatataaataaaacaagtatgt

SEQ ID NO: 223487 - DNA, 535 bp, Homo sapiens
gtagctctgggatttgctgcatgttgctggccctgagttttggagagaagccctgataagactaagagggatgctgataacctggagggacattgatgacagaaaatcctctccagtcaagtaattgcatccatttcatcttcccagccctcctctagatgggaggtggaggtgtgtgtaccaatctcttaattcagaaatgagacaagaggaggaaaaaggagttccggagactttgagtaaagctgatcaccttacgtaatgtgagtgggtctcgtccaatcaactgaaggctttaagagcaaagacaaaggtttttcaaagagaaaaagaagactctcctcaagactgtgacatagaaactctgcctgaatttctagcctgctgccctgcagaatttagagtcaagcctacaacataactcttacctgaattctcaggctgctgacttaccctgcagattttggacttgccagcccctcacaatcccatgagccaattccttaaaataaatctctctttttccctctgtata

SEQ ID NO: 223488 - DNA, 483 bp, Homo sapiens
tctcgattgcccagccttacttggtgtctgctgatgctcgtttagaagaattaataatccagtagacttacctaccaggtgctaagcaaacctcttgttcttttgttgttgttgtatagatgaaggcttcctatgttgcccaggctggtctcaaacgtctggcctcccgtccttatgcgccaggacaacaggactgagccaccgcaccatccaagtctcttgctttttaatagctttcttatttttcttttattcatccaggggttactttgtgaatttaaataattcacttaaaataacattttgaaatttatcaactttatctactgttgtatgagatatgaggaacttagcaaatggactcattcttcattttcttcttcctctctctcctgatttttccaagttatgttattatttttaaatttccaaagcttgtgtcatttagattgttctataaatataattaagcaatcaaaagtt

SEQ ID NO: 223489 - DNA, 469 bp, Homo sapiens
caggatgaagtgcggtggcaggaccatagctcactgcagcctcaatcaactcccggagctcaagcaatcctcccacctcagcctcccaagtagctgggaccacagatgaaggcttcctatgttgcccaggctggtctcaaacgtctggcctcccgtccttatgcgccaggacaacaggactgagccaccgcaccatccaagtctcttgctttttaatagctttcttatttttcttttattcatccaggggttactttgtgaatttaaataattcacttaaaataacattttgaaatttatcaactttatctactgttgtatgagatatgaggaacttagcaaatggactcattcttcattttcttcttcctctctctcctgatttttccaagttatgttattatttttaaatttccaaagcttgtgtcatttagattgttctataaatataattaagcaatcaaaagtt

SEQ ID NO: 223490 - DNA, 814 bp, Homo sapiens
aactagactcccacctcttacgttatacaaaaatcaactcaaaattgaccaaacacctaaatgtcatagctgaaatgtaaaactgctagaaagaaacacagggtaaacacttcaggatattggtctgcgaaaatatttgacagataagaccttaaaaacacaggcaacaaaatcaaagatgaacaagtaggattaatataaatggaaaagtttctgcacagcaaaggagacaatcagcagagtggaaagacaacctacagaatgttaagaaagttcaacaatcaaatgatatttatccctaggacgcaaggacggttaaacatagggaaaccaataaatgtgatgcaccacattaaagaatgatttaaaaatatattgtctcaaaagattccaaaaaagctgttgagaaaattcatcactcttttatgataaaaaaagaaaaactgttaatgcagaaggaaattaacataataaaggctatatatgaaaagcccacaattaatattatactcagtacttagaaagcaaaatcttagccaggcacagtggttcacacttgtaatctcaatgcttttagaaggtgaggtgggatgattgcttcaggccagtagttcaaagacagcctgggcaacacagcaagatctcatctctcaaaaaaaagaaaccaacaaaaaaaagaaaaccaaaaacaacaacaacaacaaaaaattaagtgaaatctctaaaatcataaagatggaaaggattttccgttatgtcacttgaatttaacggtactggaagtcctagccagagcaataaggcaacgtagaaa

SEQ ID NO: 223491 - DNA, 422 bp, Homo sapiens
aaaagtaattaagtcctttatgagtcagactgacagcaaaagttagcaatcttgttacagtattaaaacttgcttacaggaccaaagactttatttggtctttgaaataaaagtaaaatcaccatctctttgtgggtttcttttcacaatgaggcattgatttgcttttggagagatgggagcccattatgattttactttttttgttggcgctgctgatattaaatcagcgtacctcaggtgatgaggttatatatgccgtgtttttaactttcatctgcttagtgaattccttttgtcttttgatctctctcagcaacctagtttttgtttttaattttagatatgaccctgcttttccagaactagatcactttcattctgttttgaatacttaataaaagttcccaaaatgaacacga

SEQ ID NO: 223492 - DNA, 509 bp, Homo sapiens
aggtgtccagtcctttgtgcatctatcccctggcattctcccatcctgccccaagtcatcagcccacacaggttgctggcacatctaaagtgagaattttaggactaaataaatcaaatagaagtaagccctcacatcttctatatctcacctgatagtgaagaagtttgaaggtacagagctccacttctgctaataaaaaaagagtaaaatttaatttgtaaaatagaatggtgtagctagggttgaggtgctataatttatttattggaatggcatcttgagatccagcacagctcattgaatttccctgtggggagagtttgtggtgaagactcatcaacagacaagctgctatccccccctaaaaaaaaaagctactaacatcacatcaatttccaggttcttccaacttgcggaaggatgtgtagaccaagcttttattctattttgtgaccaaagtcttgggaaaagaagaaaattgttagcattttcatgtcaagcatacg

SEQ ID NO: 223493 - DNA, 462 bp, Homo sapiens
ccagaaaaccaaaattaacattagggagtttttaccaaccaacggctattgtctttttaaagttaaggggattatctaacaacttggggtcatggaaaataaatatgggagatgttttagatcaaaagaaacttaagagatgaacacaatcaaagtgcaatgtgtgatccccaactggatgaataatagtgtgaacaagctagttgtaaaaacaagcttggaggggcaattgggaaagtcttgaatatgaaaatgttaaatatatggataatattagggaattattgttagtttgtattaggtatagtgatggtattgtagttataaagaaaatgtacctattttgaaaaattcttactggagtattggggtaaatgtcagcaatttactttaaaagcataggaaaaaagcaaataaaacaaaaaaggcttcagaattaggtgatgggggagatgaggggag

SEQ ID NO: 223494 - DNA, 513 bp, Homo sapiens
aggctggagtgtaatggtgtgatgtgggctcactgcaacctctgcctctcaggttcaagcaattctcctgcctcagcctccctagtagcctgggattacaggcgcccaccaccacacccagctagtttttgtatttttagtagagatggggtttcaccatgttggccaggctagtctcaaactcccaacctcaaatgatccacccgccttggcctcccaaagtgctgggattacaggcgtgagcgaccgcgcctggcctaaaatgcttttcctaatgtgtatttacatgtatgcattataaaacttctagatttttctgtgagccccctgcttaaaatccgtctgtaaatatttccttgaaatctggtctagtttaaggtaccacgtacaactggtgtctctaaattaaatgtggtctctattacttctcttctttaaagattttttttaattaaaatctatgattctacaaagctcattgtagaaaccttgacaaacacagatcatagcaaa

SEQ ID NO: 223495 - DNA, 424 bp, Homo sapiens
atggctgtgaaacatctgaggtgacgtaataggtcggtgtcttctgggtctctatcctgctttggtaggcttaaaaagtgtgtgtgtgtgtgtgtgtgtgtgtgtgtgtgtgtgtttaaaatctaatcagaatcaggactcacctttgaatgggcataatattccagaattcttacagcttcaagaatagtggtagaggctcagatgggaagccttgctgaatttctctcagggaaaattgcataattttcacttccatggatagaaaggaagttccacactattcattctgccttttggacaagtgatcatcccctttcgtgaaagagaaagatatagggagcaaaggagagcagaaggttgcattcatacgacattcacatgaacaaaagaagggaaaggtaagtaaaaatcaaagaacaaa

SEQ ID NO: 223496 - DNA, 367 bp, Homo sapiens
gcagggaggaagtgtattagcaataagaggcatgtggtatgtcagacaattttaggtggcactcacatgaactggaatgctttttatttcaatggttatatagttatctgagtgagtatttgatgaagtatatttagcacataaaacccatggtttcctgaacagtgctgcttaagacaaagtttaaaaaatgagttgggtttaagtcatttgaaagaaacagattcaataaaggacagtacaagccagggacagtcactcacacttgtaatcccagctacttgggagaccaaagtgggaggatcacttgaggccaggaattggcacccagcctggctaagtagcaagaccctgtctcttaaaaaaa

SEQ ID NO: 223497 - DNA, 241 bp, Homo sapiens
gacttttaaatgtattttctccagacattttagttctttaagcaggagagtggtctgaattatctagtttatcactaccagaagtggaactctttcaaatagtacaagttttgttattagcagttctgttctgctatgagcaaacatatgcaaagctacccccaaaggctaagggagctgagatcgcgccattgcactccagcctggacaacaagagtgaaactccgtccaaaaaaaaaaa

SEQ ID NO: 223498 - DNA, 463 bp, Homo sapiens
ttttaccttctttccaggcggtatcctttgtgcatgcctactgtacattttcgacctctttccgatggaatgatctaagatgaaagtaaactttttaaatgtttaatcattcaccactaggcaaaccgtcataatagcattacagttcgcattatttctgtagtgtctcttatgtaaaaatgctttcatttctgatcttgcaatgaagtgctgtactaactcgcattatgcatattagaaaactgataagtgatttgtccgacattattctgttaattagcgatgagccagtattgcacagcttgttttacgtaattttagatagctgcttgtaaccacttagattatatagaaattaagacatagaaacttttatcagaattaccagaaatagtagccttttgctattagcttcatgtagagatttacctgagtaaagtaccaaagaagttatctgaggtat

SEQ ID NO: 223499 - DNA, 350 bp, Homo sapiens
cctgagaattctcaggggacagagacagagtccatcccgcacagggcggaggggcgacctggatcacacaccgcgcgtgtgccgggctcacgctcaccacgcagggcctgtcaccgccaacaccgttattgtcactgccaggacgccggcaccgtggcaggcccagagtggatgcagaccccaccctgctctgctgggtgcaccttctggacgggcagagacttgactgtgacacttggggcaaggcccacgcagggtgctgggcagggcgggggtcctcaccacagcatgaagaggacccagcagaagggggagtcagagaggggagagggagtgaggcccacacatgc

SEQ ID NO: 223500 - DNA, 208 bp, Homo sapiens
ctacctcaggctgctctctccacgaggcctcttctgacaccccttttacaacttgccaagcctcccacaccccagcttgccaaccaatctttccactcccctttccagccttattcttctccacagcacttttcagcctggtgttctaggctggaggctctaagatcttactgtatgtagttttaagcttcaataacttcagagaaag

SEQ ID NO: 223501 - DNA, 470 bp, Homo sapiens
cataaacatttctctcagtatgagcaccacgacttagacgagacaccaccactggctctaagggactattggccataaacatttctctcagtatgagcaccatgacttcgacgaggcaccaccactggctctaagggactatgaccagagatcagctctggcccaaagaccatcaaggacctgagaggtgagtcatgagagcactgctcacctggatgatgactggacaacccaatcacatcttttctcttaagaagtatgaagccaagagaaataagaaaatgggagagcttatagtctagagaaatagaagtacattataaggagatacaggctgattggtcaaaatggtggaaatactagagttggtaacaacaggtgaactagaggacataaaaggtaaatggtgtttaattttcgtgaaggccaactgagatatgtatctttataataaacttggaaggtaaact

SEQ ID NO: 223502 - DNA, 428 bp, Homo sapiens
gattaaaaggttcagaagacaaaaatgatttaagacacagtccatgcctttgataagcttatagtttcctaatcctggataactccgataaacaactgtataaaaaacagtgtgcagttctcataaagttagaaacagccgtggagatttgaggaatggatagtgcaaatcagattgggagcagttttatgaagggaattattatttgagacagttcttgtaaagtagataagaaaaaaagcattccagttaagaaataacatagtggccaggcatggtggcttatgccagtaatcctagcactttgggaggctgagatgggaggatcatttgagcccaggagtttgagaccagcctgagcaacagagcaagaccctgtctctgcaaaaaattaaaaacagaaaaattagctgggtatgatggtgcat

SEQ ID NO: 223503 - DNA, 335 bp, Homo sapiens
cagcccgcgctctattctcctggggtggtgctgaagcgtttctccgggagacaccggttggtgggcgtggtgcagtccgcactgcggtctctacggcagcccgaggcggacaaagggcgttcacgcagccctcgttccccactccccctccccaataaaagacgaaagaaaaaccttgttttagatgaaaaaataaatgcttgtcatctgcctctgcagttggaaacggccacttgtccccagaacaaaaggctgcagggtggggactggagttgcagacctggttcttttgtttaactttaaagcacttgattttcccttttagcttaaaaaaa

SEQ ID NO: 223504 - DNA, 428 bp, Homo sapiens
ttttcatcttgcaaaacagaagcactgtacacattaaagaaaaactccccatttcacccttccccagcccctggtaaccatcatcctagtttctgtctatgaatttgaccatctagatacatcatgtaagtggaatcatataatattcgtccctttgtgtctggcttatttcacttagcataaggtcctcaaggttcatccacattgtagcatgtgccagaatttttctcctttttaaggctgaacagtgttccattgtattccattgattcttgacatgtatgtatgcatgacattttgtttatctgcttctccaaggatggactcttgggttgtttctacctcttggctattgtgaataatgtttctgtgaacatggcaagtatctgtgccaggtccttcttttttgtttgcaacgaattcacatt

SEQ ID NO: 223505 - DNA, 338 bp, Homo sapiens
gtgagccaccgtgcctggccaactgtcatttttccccacaaatgcatcaaagcttgtttattaaaacaaatttattatgaatcaggattaattaacagattaacatttaacatactttaattgaagatattcatttagattttgttctgtcgtcaagtaatcacaaaagttgtagttaccaagttttctgccattgttgaattatcctggaggtcacatttttgtgtacaaattgatgagggacttgcttcgtagtataatttgagaggtggctgaactggcttctatagctagacatatttccccttttgggctagtgagtgcctccattagttgtc

SEQ ID NO: 223506 - DNA, 299 bp, Homo sapiens
gcctaattgttaaagtgtccttatagatgttactgaaacctccatatccaagataaaagagactgctttgcggggttgttaaaatcagtttttcaaacataattaatcaaataaaatttacctaatgacatttcagtagtccttatggggtcacaattgctctatttttttttttattttaaataaggtgaagtgtaaatgaaagtttttcgtaatgttgtttacatgtgcaaaatgattagataccttgccattttagtataaatatgaataatgatcatggggctaatgattaaaaa

SEQ ID NO: 223507 - DNA, 732 bp, Homo sapiens
tattaaataaatttattttcaaatgacaccttaaaaatattgtttgtttcatcataaatttcatcatgatgcattcatttcactattaagtgctttgatatttacaattgtaaattgataccactcttgtcaattgtttctaataagacttaaagaaacaatgtaaatacacattaattaggtttgagtcttttttagtatggtcaccatagatgaaaaaatgatattttcttctctgtctatagatctgtaaaagtaatagcagagaggtcagccttgaagtactttaggttgatggtcaaaccacaacatggacaaatactgccttggtccagtggttagatcaaggggtgaaaaagaggtcttagatttgaagcagactctctttacttctctaatattggacaagtaaatatatatctgacctttctgtgatataattttttcatctattggactaggataataactttccaagtaacttgttgaaatgattaatgaggtactattcagaaaccactctgaactcctccataaaaagctacagtgtaaatatgaatgattattaaccataagccctactgtttactgaaaaatgcaaaatacaatgtagctgtattattttcattgttattattagttatgatgatggttataatactccctgatgtagaaacacgtgttgtggttacatttttagtaaagtgaataataaacatgacctttccgtcc

SEQ ID NO: 223508 - DNA, 547 bp, Homo sapiens
tgtcagccacactctctcacaccatctcccttaacaaaatcctctcatgtttcatcctgtcctggcatctccttcctggaggacccagactaatactacaagttccagaaagaaagaactgaaaaaatagaggggataaattacggaagaatgatatatatacattttttagtttctcagaatgaaaggccacaagattccaaattcaaagagcccactaagaaccccaaacaaaaaatgtaaaccacatcaaggcaatctcatgaaacttcaaaacattggagataaagcaagagaaatatactgcacatcaatgattatgaacaattgttcaccaaaagggcacttgaatccccaaagccacacaggatgctacgaaaaacagtggagtattttcaaattgaaatgttgagggaaaataattctatacctagcctaaccctcaattaaatgtgcaggtggaataaagaccatttcagatccacaaggttcaaattacctcttccagagcatttcctaggacatgactagaagatgcgggcaccaa

SEQ ID NO: 223509 - DNA, 418 bp, Homo sapiens
tggccacctggcctccatatgagtgtgtcttgaaccagagtgtgcatcatattttatccacaggcctcactgcaatggaaggagcgaagagaaagccctcatcataaccaacaaaaaagtctaaggacttttgagaatgactactctggtcatctttgggaattttctctgattgtgccatctccaagccatccctccctcctctgaacacctatttcacttacagatgattaaacaaaatgtagcatttagtggtgcccctgttatttcatgtgtgtgcactacacctacctgagtgcacacacatgaagtagcatgaacagcagcaaggtccatttcaccctcatcatcctaaaaataattaatatttatcaggcacctacggtatgccagatactattctaaatgctttacatat

SEQ ID NO: 223510 - DNA, 546 bp, Homo sapiens
ctacttgggaggctggggcaggagaatggcatgaacccgggaggcagaggttgcagtgagccgagatggcgccactgcactccagcctgggtgacagagcgagactccgtctcaaaaaaaaaaagagaaaaagaaaatcatgccaagtatgttctccctattacagtgaaatgaaattagaattcaataacagaaaaaaaatgtggaaattaaacaacacacttctcaatatccaatggatccaaggagaaatcaccaagggaattagaaaatagagctgggcgcggtggctcacaccttttaccagcactttcggaggccaaggtgggaggattgtttgagcccaggagtttgagaccagcctgggcaacatagtgagacactgtctccacacacacataaaaaaagcaattataaaatacttccagatgcttaaaaatatactaaaatttgtaaaatgtattaaaaacagtgctcagaggctgggtgcagtggctcatgcctgtaatcccagcactttgggaggctgaggtgggtggatcactc

SEQ ID NO: 223511 - DNA, 546 bp, Homo sapiens
agtgctattggagatatgttatatgaactgggacatgttaaatatcactggaacatatgctattgctttacacttccatagcttcattcctgttactggagagtagcaccattttcaaaagtgagtaagtcataagatcaacctggaaaaatccatcttaagatgttccccttgacaaatcgaaaggatagctcaccatacttatttaactgctaagttgaaaatagccatttgtctaattatgcttttatataactttttggtaactcattatttcaactttaaaagtcaaattctagggatatggaattgtgaaagaaaagactttgcattcacaagtcagtgcgtgaatcgcaatcaggcaaaaatacagtgatctcatctgtaacacataaactgggtaattttttatttatgaagtaatgcaaataacttaatatagattactacactaactcatagtatactttacttcagttaaataacaccattttgggcattactgaaatataaatggacgtgaagcatgcaaaataaaattatgac

SEQ ID NO: 223512 - DNA, 565 bp, Homo sapiens
gaaccggggggtattacttctggtatggtaaacctcccatctgagaatttctgacaacctcctttctggtaacttacactctcctgctcaaacgaagccttttcattaaaggagtacttagggggttccataagggaaagctccagtaaaggcatggtaagggtttcctcttccatcttagttacctctgtcattgcagctcctttggcttctctgtccccctttctgtttcctctagcctcatcacctcctcctgtttgatgccctttgcgatggatgactgctacttcttttggagcccatatggcttctgagagctgctgtactttctttttatttttgatttcctttccttcagtagctaataatcctctttccttatatatggctccatgggcatgcaaagtggcaaaagcataccttaagtcattatagatgtttactgattttcctctggccaagagcaatgctctagtgagaagtattagctctagtgagaactattagctcagctctttgggccgaagatccgaccgtcagagggcagacttcggctactgaattc

SEQ ID NO: 223513 - DNA, 415 bp, Homo sapiens
tgtttatgtgagaatttttttcttcttctaggggatataattttagtcatacagtttatttggttaatcagtatgaatgaataatttgtcttttgcccctcaaaacaaaagaaaattttctttgcagtataaattaaaagggtttgttggagatcctacaaagaaactctaagaactatttttctgaaatactagtaaaaaactaatgataaatctcagtacagttggcccttgcacaatgcggggttggagcaccaactgcctgcacagtccacaatctgcgtatacattttgactccccagaaactttactaatagcctacggttgactggaagtgttaccaatgacaattaacacatattctgtatgtcttatactgtattcttacaataaagtaagctggagaaaagaaaa

SEQ ID NO: 223514 - DNA, 248 bp, Homo sapiens
agaaaaagagaaaataatttttattatagattatcagtagttatgtatattaatgaagaatttggcttcatttacctaattagattaatcataaatcatttatgaatagtaatagacttgaattgttactttatattacacagttggccctctgtacctgcaggttctgcatcctgggattcaactgtggatcaaaaatatttgggggaaaaaaagcaatacaacaataaaaaataatacaaattagg

SEQ ID NO: 223515 - DNA, 375 bp, Homo sapiens
atctcatgttgttggtttctttcgtcatttattgtggttttaatttacatttccctgattaccaaggaggttgagcatcttttcatgtttcttggtcattcaggtttcctcttctgtgaaaggcttgttcatatcttttacttgcttttcttctggattatctttttttttgtttgtttttttgagatgaggtctccaatctgttgcctaggctggagtgcagtggcgcaatcatagctcactgcagttgcaaactcctgggcttaagtgatccttccacctcagcctcctgagtagttgggactacaggcatgagccaccatgtcctgataattttttttttctttttttttttcttagagatgaggtttcact

SEQ ID NO: 223516 - DNA, 437 bp, Homo sapiens
gtgatctacagttgcatttctggaaaatggggataccactacttaaagggatgctatggtgagtagaacatctaatatatattagatgtgcctggcacatttcagccaataaatgacaacatctcaaactccttcagaattgagctcttggtcactcaaactttcaaactgttccccctccatttttcatctcatccatccaaggagtagctcactccactctctcttttcttctatcagccctagcaaaccagtccatcataaagtcctgctgtccatttttattgcaaaatctctttcaaaccggtctgattttcagtccccactattctgccatcctaatgcaagccactgtactgtattatctttttccttggtgcggtgcctcctgcacacactctgcaccccttgcagtctgttttactaccagcagcctg

SEQ ID NO: 223517 - DNA, 131 bp, Homo sapiens
cctgtgtcatccagagctttccagatttaatgtgggctgggaacattacagtattttcacagcacagcctgccccaaacagcagtttgagaaacgatgctctgggcccctcgttctcttctttgtcttctg

SEQ ID NO: 223518 - DNA, 359 bp, Homo sapiens
gttgtttgccctcctgcaatttaatttcttcagatttctttttaattttacctccaaactttcatttatgatggatgccatattctatatcatacaaaaaactataaaataaagtataaggattctcacttttctaccagaaaatttccagtgaaaagtgttcacagatttttcactttagtcacataaggacctctctaatggccgtatatatagagcactcctgtacctgtgtttatattgcactgggattgtatacaacacatagctttgtaatgattaccctggccaaacaagaccgaatcttctattaccacatgctttcccaaagcccctagtcctgtgctttgcattagtgg

SEQ ID NO: 223519 - DNA, 285 bp, Homo sapiens
ctttttttctaggcattctgcaaatttcagctgcttcagtagtttcttctgtttgttgctgaaccgattatactgttctgcacttgatcggtggaagaatcctgagtccatcttgccgcctcgcttggagatcgctccctatcccagggtgcaccgcctattttatagttttaatttgcatttccctgatgactaatgatattgagcatcttttcatgtgcttattgaccatttgcatgtcttctttggaagtatgtctattaaaatccccatttaaaaactgga

SEQ ID NO: 223520 - DNA, 369 bp, Homo sapiens
tgttgcataatagcctggaggctccttgagtgtttagtataatgagggaacattgcactgtttcctataccattgcacagttattatacctattgcacggttatgtttaccattttaatggcttgctttacttatattggcaatgccagcctctctgttactcagatctatcccacccttcatgcccaatacacatcttaacatcccctttttaaagccatcaacttcagcagccttcatcagtttccctttgatttccaaagcagcttgctgttataaataacaacaggtgtaaggtactgaatgtagtgagtgcactgtttttgtcaccacttgatgatgtaacctctgcctaggtgatcctagcca

SEQ ID NO: 223521 - DNA, 456 bp, Homo sapiens
cacatttgttatctccctttatcttcacaatacaccctcaaaaatatggtattattttcattgatggaggtaagccctgagagactccacaatttgccccaagcacacaaccacaaaacagacagttaagaaccaacttcgtacctgaagcctgtgaaggctggctgccataccttgcttcacaggccatcccatagctgatgtatttattagaacagagggagggagtctctggataatggaatcaaatttaaaaggcaaacaaattttcagctatcttccaagcacatgacaatgttatgaaaaagtctatttggctcagaaagggcactatcatttaccccttttccttttaaggtggagctctacctggagaacacccatctaagaaactgaaattgcaaagctccctctggcttaagtactcctagccttagctctatgctgagctaaaaa

SEQ ID NO: 223522 - DNA, 499 bp, Homo sapiens
gaggaaccccgtctctactaaagaggaaattacgcatggtggcgcaagcctgtaatcccagctactccggaggctgaggcaggagaatcgcttgattctcgagttacagtgagccgagatccggcgattgccctccagcctgggcaacaagagcgaaacgtctcaaaaaaaaaaagggaaaaaagaaaaaggggcctccagaaggaagtcatctgctccctgctgtggaggctgcatctaatgcttgtaccggggcagtcatatgacaagtaggagctagcccttatcataagatgttgatgtgaatttagaaatactgtatctttataaacgtttgcaacatttcaagataaaaccaggttccatgccaggcgcggtggcacatgcctgtaatcccagcacttggggagactgaggcaggtggatcacctgaggtcaggagttcaagaccagcctgaccaacattgtgaaatctcgtctctactaaaaaaaatacaaa

SEQ ID NO: 223523 - DNA, 284 bp, Homo sapiens
aactctataggtaatgttcttatgagggcacacataatcaccaccactcacaatacctagttttggaatcttaattattccttccataatattttcttaatctgctataatgtgagatatatgactacagctgagagatattaaaagcagaacaggaaaccacagaagtttcttaaaataaaaatacaaactgagctcagaaacatgatttttatatacatatctgaaaaagaaatgtagccagtgagcagaatatactcaaagccaaccacaaataagcagta

SEQ ID NO: 223524 - DNA, 575 bp, Homo sapiens
atgtctcagatatggaggaataatatgcaacaatatctgttccctgcctgccctgtgccttggaccatgttgaatccacaagggtaaagtgagaaacagaagctgttggcaaaggtctaggtgacaaaatagcccagagttaagaaaagggcataaaacctattgcctataaggtactcctctaaaatttggcaacttctctgaatggtacctttttgttgttatttttcatttaaaaactgtcttgtatctaatcaactctatggttctcaaatagattatcaattaattctcttgggattgctagtcaccttttctataattttgcctcctaatactttctgctttattatatttgctgtaacaaatattcttttaaaattagttgtaaagatgaaacagtgttgaagtttcaaatagatatgggaagtagagatttgatgaaaggatatttacattctggtgatcagatttttggatttcaaagaccagtcaattttcttttagtgtttaggggactgatataaggctgaaacatttttacatttccaatttatgaacaataaaacaaatag

SEQ ID NO: 223525 - DNA, 487 bp, Homo sapiens
gagaattgtctgaaaagttatgtgtgtttgttatcatgaaaacattaataatattaggatttggctataatccatttttactttgagaacctcgacattttaacgggtacatgtaactgataaatcctttttgtggttgtcaaaacaagcaaagctaactttgtacatttcctattataactaaaagcactttgacagtctgaaattgggtgtatcagtatggagagcaaacagcctattcattttatcaccatacttctctaaggattttgacatttctgagatacatatcacttctaaacagtgaagcacaaagttggtaaaggttgtgatggctgcagttcatggaggttgaccatcctgttgggattgccagttcccttggcaggtgccttgctaggccagcctgccatgcatctggtcatgtggagaccatcaggagaccatcgcatggtctatccacatctttgaggcccaactgatcatt

SEQ ID NO: 223526 - DNA, 565 bp, Homo sapiens
aatgttagctataatcacatagaagatatagtgatgaagtattttttcaggtatttcagcaaaaattaaatgcctaggaataaacttagatgtgcaggacttttatcaaggacaggacaaaattttgctgagtggaatgaaagatttgcattctatgttcctggatgagcagatttcatgttataaatatgttagttatcaccatgtcttcatattaatttgtaaatgtaatttctgctgggcacagtggctcatacctgtaatccaaacagtttgggaagctgaggcgggtagatgacaattagctgggtgtctgtggcacacacttctcccacctcagcctccagagtagctgggactacaggtgtgtactactccacctagctaattttttgtattttttgtagatacagggttttgccataggtattcaaatagaaagttttgttgttgttttagtatataaagaaatataactttccatgttgaaaaaattttaaaaacctttttttaaattataaaactcataagcaaccattgttgagaaaattagtaaagtacagaa

SEQ ID NO: 223527 - DNA, 505 bp, Homo sapiens
ataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaa

SEQ ID NO: 223528 - DNA, 360 bp, Homo sapiens
ttagagctaacaagagacagaccccaataaaattacagcataatattggcataaaaacagacacatggaccaatggaacagaacagagaactcagaaataaattcatatatgtacagtaaattcattttggacaagggcgccaaggacatacattggaaaaaggatattcttttcaataaatggtactgggaaaactggatatccatatgcagaagaatgaaactagacccctcatatggttaggctttgtgcccccacccaaatctcatcttgaatcgtaatcctcataatccccatgtgtcaacggagagacccggtggaggtaatggaatcatggaatcggtttcctgcatgctgtt

SEQ ID NO: 223529 - DNA, 342 bp, Homo sapiens
caatttagtatttttatgttagtatcgtaagttactatacatgtatgtgcttttattttaagaagtgaagaaagaaattaagatcctttccatttttaaaaactgtttatttatgtttgtggagagtatactaaagagctcatctttgtgcctaaacctcaggtttttagctgagctactgaatcagttccaactttaagttatgtaagactaataggactgtctcaggtttcacctcctgactttttgcccctctttctgagttaaataattaaatctttcttaaaggaagaacttaagtcttcaagaatatgttttgaaatgaaagaaacctgagcctca

SEQ ID NO: 223530 - DNA, 457 bp, Homo sapiens
tgggaaaatgaaagaagaatacagaaagaaaaattaccaatggcaagggtgtctttgccaggtttctagatattaagcatatacctatctatcttattcatttccaaatcattacattcatctgctcatttaacttaacatctacccattaaggaacacttatttccttaattttgatgaatctcagtagtgcttaaagatcctaagtagtggtagatgaaaatgggttttgtggtcaagtacgtttggggaataatagaccataaaggattgttcatagcagaacttcttgccctttaatatcttattcagaaccttaccctggaacttaattttttctggcatatggtttacttttaaaaggaaaaactgtaatatataatattaaacatttggcaagcatttcagtaattgtaactatgaatttctatattaaaatatctggataagtgaagga

SEQ ID NO: 223531 - DNA, 203 bp, Homo sapiens
agtggaagtggatcatcataaaagtcttcatctttgttgtcttcacattgagtgggctgaggaggtggaggaagaggatgggttggttttattgtctcaggggtgacagaggtggaagaaaatctgtgtataagccagccacagtcgttcacatctgtaatcccagcactttgggaggccgagatgggagctcagggctgaca

SEQ ID NO: 223532 - DNA, 590 bp, Homo sapiens
tagaaattgctactctaaaattatcctagttctattgtgtgtgtctcattcttcattacaatgtaagctcagtgagatcagggactatgtctgtcttgttctttgccaaatcccagcactgataagagaacctcctagaaggtagtgggtgagaaataaccatttatgagttgagttatgctttagtttgctgaaggctcctattttctagtacatgcaaatacctacacataagggagataagagtttagggaaaggagaatagacaaccaaatgatataatttatgataggggtaaacgtactttaaaaaaaaaagtagaacagtgaactgaagaccaactactttcactgcgttctactttcgttgaagttattagaaaaagcacttctgattaggtgatgtgagctgagttctacataatgagaaagaaggagctatccaaggggagactattcagggtatagtagcagttgaaacactcctgaaataagaacgtacttggcttatttgaggaataaacgaacagttgaccggcatagctggcatagcatgagccagagagtaacctgtgtgagaggtggtcggaa

SEQ ID NO: 223533 - DNA, 533 bp, Homo sapiens
aaaaatcttttatactgtatttttactgtaccttttctatgtctagatattctcagacgcaccatgttacagttaccaggcagtattcagtacagtaatatggtatacaggtttgtagcctaggagcaatgggctataccgtgtaggcttgtgtaaatacactctgtgatgttagcacagtgagggaatagcctaacaaacacatttctcagaagatatccctgtggttatgtgacgcatgactgtgtatcctttggtgactcaaattgttaaaatttagccagcgagaactcaatcagtctggtttctgtttctttgacatgccccctcatttttatagcaccagtttgctttgtggcacaacaaaacattctctccttaccttatggttttcttaccccagacctggacttggctattttaccaaaagttcttgtttctcttagtggggaatggtatttggaagccaacatcatggatgcattactgggtgtcattgcttctattggttcttttcattagacagaataaga

SEQ ID NO: 223534 - DNA, 727 bp, Homo sapiens
tgggcaacacggcagcattcactcaaaaacaaacaaacaaacaaacaaaaatgtagacagtcccataggcagccagtttttgaaaaggtcactcttgcataatgaaaaattcacttaaatgtgataaggtggagattatggtctctctcagagcccccaaataactgggtcctggatactacccagatctggaagaaagtcctgttagagaaagctatgttgatttaaaaaaaataaaaagaaagataataactaaaacttattgagctctcatcatattccagcccttactctaacaacgttacaagtactaaaccttgtaatctttacatcaaccatatatagtagatactattattatccttaatttatagagaataaaactgaggcataaggaggttaagtaacttggtgaaagtcattagctgacgtatcaggagtagaattagaattccagcattctgactgcagaaacgtccttaaatacatcatgctaatactccccctagatcagagacaaggaagaagagcaccccaggcgtgattctatggagggctttgggcctatacactggattggcatctctagctagcagctatttttaagtccttaagttctaccctttcacctccatgggacatcatgggacaatgcagtggtctggggtcaaccaataatgcaaaagccagtcgcctttgagtgtgattctgccgggggatcctcaag

SEQ ID NO: 223535 - DNA, 244 bp, Homo sapiens
ctttatagcaaccctaggaggaacagactatttggtacccacttaatagataaggaaactgagatttggaaaggagaagtcactttggttgaagttgcacctaagcggaattgctgaggtttgaattaataggatgacccatgggttaagagaccatgattttaactagtaagctatactccctccctaaatacaaagttataatagttaacaggaactggccctcaaattccccctctcagac

SEQ ID NO: 223536 - DNA, 496 bp, Homo sapiens
agggctaatttaggtctctagagcatgccactatcaagactaacccattcagcagggctttgtatagccaaggttttgttgcatattaaaatgtttaggaaaattatccaacatttgggaataaggcacaggatgattgcatgtctttttagcgttttcttggagcacttaagacaccagccaaggatcatgtaattctctaggaaagtgttcctttgtttaacttactttttattaggatccagattctatgaagttagatgttaatttgtagattgatcccctgcaaatgacttctgtctgataaagaagataaccccaaaggttatagttttattgccctataggatagtaactagttttatttctaaattagcaatcttatttcagtattctgtatttcattgactgtatacacttcagtctttcctgtattacattgaaccagatgtgccatcctgctgagttaaaataaatttttgacatatgcttaata

SEQ ID NO: 223537 - DNA, 445 bp, Homo sapiens
ctaggttgcctcttttggctagagagagcaggcttttcatggggttttctcttggtctgaacccatagcttctccagcaccaagtccaggataaatgaggcaaaaagaaaatccagtccactccccaccacactgctcctctggttccaaggtccctagccagtctgtcttctctctgcctttgagattcagctgaatggtttttttttctttttgagacagagttttgctcttgttgcccaggctggagtgcaatggtgcaatctcagcttactgcaaccttcgcttcccgggatcaagcaattctcctgcctcagcctcccaagaagctgggattacaggcatgcgccaccatgcccgactaatcttgtatttttagttgagacagggtttctccatgttggtcagaccggtcttgaactcccaaccttaggtgatccacccg

SEQ ID NO: 223538 - DNA, 1037 bp, Homo sapiens
ggcagacgccgtcgagatgcagggcccaccgctcctgaccgccgcccacctcctctgcgtgtgcaccgccgcgctggccgtggctcccgggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggtaagataaacagcataaagtcttacccttctctacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtttgtagactttaaagtgga

SEQ ID NO: 223539 - DNA, 412 bp, Homo sapiens
cggcacgaggggttgcttggacctgggagtttgaggctgcagtgagctgtgatcatgtcactgcaccccggcctgcatgacattgtgagaccttgtttcaaaaaaaaaaaaaagatgtgaaacgtctgttagcttgtatatatgtcagaataatttccaaatggatgagcgagctaaatgctgaatgttgaaaaaatcatatagatagtagaatcagatggattattgtataacctggagaaagcttttctatatgattcaaaatctagaagcaataaaaaaaattaaatttatgaatgattttaaagtgttttacatgaccatagtagaatcagatggattattgtataacctggagaaagcttttctgtatgattcaaaatctagaagcaataaaaaaatattaaattta

SEQ ID NO: 223540 - DNA, 308 bp, Homo sapiens
aatcccagcaccttggttggctgaggcaggaggatcacttgagcccaggagttcaagaccagcctgggcaacatagggagaccttgtctctaaaaaaaaaaaaaaaaaaaaaaaaaaaaatttgccaggcatggcaggcgtacctgtggtcccagctacttgggaggctgaggtgggaggaccagctgggcccagggggttcaaggctgcagtgattcttgatcgcacctctgcactccagcctgggcatcacagcgaaaccccagcaaccccagtctctaaatagataaataaaaccatgttgttta

SEQ ID NO: 223541 - DNA, 565 bp, Homo sapiens
catggaagttctctttttccacataataatagtccaaaaggtttcatatggaggagtcttgacaggtcaggggagggagaggcccaacctgcctcttagggtttggtagggtttgggaatgtgagagaggcctgttaaccatgagaaaaactcctaatccaaagtaaaataaagaaaagagtttgggccaagacaaacattttaattctctatgccttgtgctgggaactcatcttgccccaattcaaatgtaagccttccttatagaaagtaattttttttttttgagacagagttttgctcttgttcattgcactccatcctggtcaacaagagtgaaactctgtatcaaaaaaaaaaaaaagtatatatatgtgtgtttgataaatcccaaggataaagtaattttacttggctaattgcaattttataaactaaaaggacaaaaaggaatagctgtgacagacgtttctaatgaatcatctttattgctgtaaactcatagaaaactgttaaaattgttactatagtgaataataaaaggaaagtattttcaaaacttaca

SEQ ID NO: 223542 - DNA, 389 bp, Homo sapiens
gctaggtttagaaattaaagtctccgaataggccgggcatggtggctcatgcctgtaattccaacactttgggagactggggcagaaggatggcttttggccaggagttcaaggctgcagtgagctatcatacattgcactccatcctggtcaacaagagtgaaactctgtatcaaaaaaaaaaaaaagtatatatatgtgtgtttgataaatcccaaggataaagtaattttacttggctaattgcaattttataaactaaaaggacaaaaaggaatagctgtgacagacgtttctaatgaatcatctttattgctgtaaactcatagaaaactgttaaaattgttactatagtgaataataaaaggaaagtattttcaaaacttaca

SEQ ID NO: 223543 - DNA, 1410 bp, Homo sapiens
  misc_feature (1317)..(1317): n is a, c, g, or t
acatttttctccaaattttattaatttcatagtgttttgatttgggtggcagatgacttttaagcagtgggtgtttgccggccagatctttcctggcatgcggactgtgaggcaaagcacgggtgaaggtaggcgctaaaggctttgggctaaagccagcacgcggttctgtgctataggagtctcccgtttcccgtggacaggttcagcgttccttctttcgcacaacttttttctaagtgttccagtgaccaagccagtcattcggacactgatttgcagtgcattggcagtaattcacaaattagttattatataagtctctctcatccctttcacactagattctcagacatgaatgaatttgtcgtttggaaggaaagctgggtaacgttttgggcacaggggaaggaggactccggtcttaactcccacgctaactttagctcaagtggagttttcaccgtggtcatttctacctccggagcaaggtgccagcgccagtactagagcctgcttatccacatttgccctggacaggagcaggaggaagtccacttctgtaccggcagacagagcatgtgaacacaaaacacatttctatggcatagtcaactgaacttcatttttacatttaatctaacatgttaacacgttctaacagggtttctatgagcagctgctgtaacatactcatcaactatgatagacttaacacttgttacctaatgaacaaggaggatgtgcatttcgggtttcttttgatattcgtggaggtgattgtcagtgtttaaacaggactactttctccactatgaagatgacttggaaatcgcaacatcatggtacattgctaagtccatgcttgtgtgtgtgacagtaggcttgataatttatcttaaaacacagcagcattgaaatttaggaaaagaatattaaatgcctttggaaacatgaaacaaagttaggagccagtaagaaagtgacagaagcaatgaatgtcttaatgcagtatagttaaaatggcttcccacagggtagataattatccaggatccttccttttccttcttcctccaggtttttcaggggtcacttcacatttctaaagaaagagtgaataggctgggcatggtggctcaagcctctaatctcaacgctttgggaggctgaggcaggaggatcgcttgaggccaggagtttgagaccaccttgggcaacataacgagaccccgtctctacaaaaaaaatttaaaaattagctgagcatggtggcatgtgccagtagtcccagctactcgaaaggctaagactggnggatcgcttgagccaatgagttggaggctgcagtgagctataatcacgccactgcactccagcctgggctgcagggtgaggtcctgtctctgg

SEQ ID NO: 223544 - DNA, 426 bp, Homo sapiens
tccagctttcttttctgttgttggggaagagaaacctttccttctacccttataggtttagcaaatgagggcctgtgaattaaactgacaaaagacagattagcaagagaaaagagagagtatgtggggtgggggggcaccggtagtgggtgcttggtggctcacacctgtaatcccaggactttgggaggctgaggtgggcagatcacgaggtcaggaaatcgagaccatcctggccaacatggtgaaaccctgtctctattaaaatacaaaaaattagctggctgtggtggcgtgcgcctgttttcccagctactctggaggctgaggctggggagtcgcttgaacctgggaggtggaggttgcagtgagctgagatcatgccactgcactccagcctggcgacagagcaagaatcagtctcaa

SEQ ID NO: 223545 - DNA, 273 bp, Homo sapiens
tttcaaagagacacctgcacaccccatgttcattgcagtgctactcacaatagtcaagatatggagtcaacctatgtgtccaacgacagatgaatagatttttaaaaacgtgatatgtacatcatggaatactattcagccataaaaaggctggaattatgtcatttgtagaaggctgaatggaactggaggacattgtgttaagtgaaacaagcatgttaacagaaagctaaacactgtatatttgtattcatatgcagaagcgcaagtatg

SEQ ID NO: 223546 - DNA, 310 bp, Homo sapiens
gcagcagggatgaacttctgcacgcttgggagttctggcgtgcgcagtggaaggagggggcgagggctgggggaggagatcggaaggggaaaggtaatccccggcgttttcagcatcctctttttagaaagactgagtctctcccaggacagctgctgcggtcacaccacaaacttaaaagccgccctcctgtttggagcgtgcctttcctcgccaccctctcctccccaaagctccagctggtgccttgctctccgcctgtcctagcgcggctctcgggggaggcagcagcgccccctgcctcccggcc

SEQ ID NO: 223547 - DNA, 576 bp, Homo sapiens
tgctgagtttaatactcacgggcactgtctgggggaaaggttgggggacatggaaatggcctagttgcagcagagtgggaggcagcatagaacagtacccctcgccaacccggctggccatcacatggccacacagtggacagaggtacagaaagctcttggcacttctgaaatgcgaggctggcagacagcagaaaagctaaatcctagcatcagtcactcatgtgtatgtgtgtgcgtgtacacacacacacagctgccccgccaccctttcacacagtagcacagcaagcttcaggaattatttccagaattctaatggagcatgattcaccggcaagaggatgatgacctaattatccacctgtgtcagttaaatggcaagaagccccctcgccctcccttcgcctggcacagcattcagcatcttcctgctgtctgaagagaggcttgcaaaatgctaatgtgactccagggtctctatcctgaaagcttgcaggtatccaagcagcctggggaaagggaagccaggagcacatggagtccaagaagaaactgaaccccagcaggctctgg

SEQ ID NO: 223548 - DNA, 223 bp, Homo sapiens
gcacacaaaactttctgtttcacaaacagtagcattgattgatccctttaaatgcaagttcaatccttataagctaagtgcagtgatgattttatgtaacatagctaaatgcacacaaaatctgtatattctgaactacaaaagtggtttccatagccacatatggttttagataaggattcattttcataatgaatagtactaacaaatacgttaataaaac

SEQ ID NO: 223549 - DNA, 363 bp, Homo sapiens
gagaatgaacgtgtccgaaagacagacagaagcccggggactgacgtccgtgggagctcctcccgcactgcagaagatgaacatctaagactcgtttagacaaactgatgtagagaaaaataagaaacatcaaaacataccgtgccctgacctgggctttaatcctcatgaggccacactgttcagaatcggctgagggactctgtggcatttcggggtgtccttgctgacagggtatttggtggcccccaagttccctcctcagaggtggcagccgtgggggaccctgcagcagctgtagtggtgtgggacttggtagcggggtcctgacggcggaggacccagcacgtctgttctcagcgg

SEQ ID NO: 223550 - DNA, 467 bp, Homo sapiens
tgctcttcacgcaaagaatatatcatatactgctgtgccacccagggccattctctcacaaattagagctccttgatcctgatcctcagagttgtagaatgaattccaccctaggatccagaaaggagttttggggagggttttggaaatggtgcgagaataacccgcaacctagggaagcaggctgcatcacaaagcatgaataaccaggccccacagtggttcgtggagctccaagcagaatctatctgcccagaggcagcatgtggttggaggggaaagagcctacctggtaggagatgacctagctgtcagtcatccttttaaagctacaggccttgggggaaatatttttcttttggaacctcagttttatcatctgaaaaccaagaggtctgacctcacaccctctgtaaaattcttcctgagttgactttctgattaaaccatttcctcttgctatgtgc

SEQ ID NO: 223551 - DNA, 466 bp, Homo sapiens
tgcattttaatggtcttgacatgaaaatttctggaagcctcctgatctcaccatggttgaaaaccttctctagatgtagtcaaatttccctagtccatttgattaatttacgctaaaagcaattattgcatgccctccatgtagcaggtccattataattcaataaaatagtatgtaaagcagccgggcgtggtggctcacgcctgtaatcccaacacttttcgaggcctaggcggacggatcacctgaggtcaggagttcgagatcagcctggccaacatggtgaaaccccgtctctactaaaaatacaaaaattagccgggcatggtggcacgcgcctgtaatcccagctactcaggaggctgaggcaagagaattgcttgaacccgggaggcggaggttgcagtgagccgagattgcaccattgcactccagcttgggtgacagagcgagactccgtatcaaa

SEQ ID NO: 223552 - DNA, 329 bp, Homo sapiens
accaagaggagcctaaagagacatgaatgtaatgtggcgtcccggatggatcctggaacaggaaaaagacactaaagaaaaactgggaaaaaagtatggattttagttatgaattatttataaatattgagtttattcattgtgataaatgtactatactatcagacataaatactaagaaaaactgagtgtggagtatctgaaaactttttgtactatctttgcaacttttctgtaaatctaaaactgttctaaaatataactttattaaaaatggcaatgataaactcatcgaaagttaacataaataatacatgaattacaaacta

SEQ ID NO: 223553 - DNA, 547 bp, Homo sapiens
gttagaaatattattatatttctgcttattccataggcagatgttagaaatattcaagaatcttgtcttctagtttttgtgattcttggtatttattttagtattattagatttttgatgtattattcaatgatatgaatgaagaaaatgagagccaagcctggatcaatgatgtccactggtggcgtataaatcatatttggtgaatatatgtctggaactctgaggtccaagaaggaaggaatctaggttattgcctcttttagaaataatcctatagattatttaagaatatataaggatcttatttggcctttttaaatgagtttttactctatcataataaattgatcaataaaaggatcaacatatggatacaaatacataaaggtaaatagggtgaagcatcatcaaattatggaaagatgtggtggcaagagaatccacgtgtatgtacactgaagacactgaatgtcattaaaaaaccaatggttcaggctgttacacctggttaaaaatcatgcaggtaacataaataatagcctgt

SEQ ID NO: 223554 - DNA, 545 bp, Homo sapiens
aataaaagggcatttgtctgttgatacataatttcttttaatttaggagtcctctcttaaaatagtttgaaaataatcttagcatcgatcatcaatgtacttttttaatacctagtgactatcacagtgcctagcacatagtaggtgggtggataaatatttactgaacgaatgaataaaatgagatatttactgaacgaatgaataaaatgagaggtaaacaaaaaattttcttcacaaataaagataaccaaaatctacactagtatataagtgtatctttttccccatttctccaagaacagaacaaaaggttggaatcagtagccaaggacactggcttcatcatgttgttgatgaacacatcaggagatgcaaaccgtccacccctggctgaaactgagaagcccgatctgccaccccttgggtgatctatgcagggaattctcatctgcagaagatccaatgggaaaaacaatcacaatcatttaagcaatccacctttagattttcctttctttcaatgtgccatttcacataacatt

SEQ ID NO: 223555 - DNA, 439 bp, Homo sapiens
ctcatggcctttgccccagctgtgtcctctgccctgcaggatgcacctctgctccgtgtggctccctcccactctcactctccaaatgccccgaacccctgagccccactgcagccccactgtaccctggctctgcagcgctgcttcttcatgatgtgtgtcttccaacagcagacggggccatgaatgtggatgcctcattcactgctgtgtgccggcatccagagcaggactggagcccagagcaggcacctgactgatagttgttgaatgagtacagtaatgaatgacaatgaaagcactgtgtagaaacactggctgaatagtacctagaaagagaatgtctcaaatacctacattagcaatgaaaaaaacactgctaattaatgaactaagcatctaattcaagaaacaaagcaacacatctaacttatagaaa

SEQ ID NO: 223556 - DNA, 515 bp, Homo sapiens
tgaaaggaaaaatccctaaatataacaatattttaaaattttctttcttttgaatgcattaaacgcacattgaagaagtaagcctgtgttagacactgaattgatttagttgagttataatcttcatccaagtgcccttcagcctaggagagttagccaaataatttagttaagtagtaattgaaaaccaagattgttgagaagggtagcaaaaaggcactcattgatctattcagttttcctagtcctggaaagttaactgtcagggttttaacatttacatgatgaatgaatattgaaacttaccccccagaaagaaaaaattgggattcttttgatcttaccttttttcccttttaattttacatgtagaagagttactagctaggcatgttggtgtgcacctgtagtttcagccactcagctacatggaaggctgaggcaggaggattgcttgagtccaggagtttgacaccaggctgagtaacataagagaccccgtctcttaaaaaaaa

SEQ ID NO: 223557 - DNA, 463 bp, Homo sapiens
  misc_feature (17)..(17): n is a, c, g, or t
  misc_feature (32)..(32): n is a, c, g, or t
agcgggggagggggggnggaaaaaggaaggcnggtgtaaggcggtgaattgatttagttgagttataatcttcatccaagtgcccttcagcctaggagagttagccaaataatttagttaagtagtaattgaaaaccaagattgttgagaagggtagcaaaaaggcactcattgatctattcagttttcctagtcctggaaagttaactgtcagggttttaacatttacatgatgaatgaatattgaaacttaccccccagaaagaaaaaattgggattcttttgatcttaccttttttcccttttaattttacatgtagaagagttactagctaggcatgttggtgtgcacctgtagtttcagccactcagctacatggaaggctgaggcaggaggattgcttgagtccaggagtttgacaccaggctgagtaacataagagaccccgtctcttaaaaaaaa

SEQ ID NO: 223558 - DNA, 265 bp, Homo sapiens
atgcatcccccttaccacccccttccattgaaaggaaccagtgaagctctttatctgaaacacatttcatggtcatggatggaatcattaactacgttttgccagtaaacccagtttagtggccaagcagatccaatgggatgagattttatttgcttcaataacaaaaatctggtattaagttggattttgtttatatagcatgaggaataaggaaagaaagaaaccctaaaatctcacaggggaataaagtcttgcttaaggt

SEQ ID NO: 223559 - DNA, 711 bp, Homo sapiens
catgggcatacagagcagtagctgtctatcgacagacctcaaagacacagtgagcctttgagtttcttcaaatcccttaagaaatggagaacagtagtctttcttcaggggggttctggaaatgaaagagctgactgtctgctctgagatgtgcttattagtggccaggatccagtttaaggtaaggggtagacaaccctgattgaaaagatctcatttcttctcccgttgctgtactcctttttctaacaaaatctataactggataagcataatccatcttccttcttgtttacttccacagctttacatgataacccttagacataaaattaataccggctttcttactgattaaatatttttctctggtcaggcatcttttactgtttaatttctggaaatgattaaaatgtgtgaagctgatgtatccaactataatgcccatcgttagctcctgggtacctatgcaaaatatgctgtagagagctggggctagaaggattatattccgtttagattgtagtagggcatttgttatttgttagtgaccccttctgggttggaatgtttatttgaatttatgaaattttacatgaagagtagttttggaacggtttggtttgttgtgactctcccaaaatacagaggtaaaaactcatttcaaaataacccatttaataaggaaacactcctatgtctctgacagca

SEQ ID NO: 223560 - DNA, 505 bp, Homo sapiens
ggtatgtctggggggagtgtgttgggagacactgatgaaacaagtctggcaaaatgctgataatcactgatgcaggtgacaggtacaaaggagtcccaccacttttgcatatggtctgtgtgtgtgggttatgtatcatatattgcagaggttgaggggagtgaggtggggaccagcacctgtatccccagctcctgacacagtgccgggcacactggaggtgcatggtacaccatggtaagtgatgcgcagatgccctcggggatggaaaccaggcagtctctggagacagaagactcagtggacttgtggggctgagaagtattcgggaaataagaaaatggaatccacaaggaaaggcttacacataaactgcgcccaggccaatagccaagcacgtgtctttttcccaggatgtaacccagcttggaggccatacagcaccattctgttttcctacaggagaaagactggattgctccaaggtaaaagctgaactttccca

SEQ ID NO: 223561 - DNA, 208 bp, Homo sapiens
ttctcagtggatgctgcagcagcagagtctaggtacaagccagttttccaccaccaccttgcaatagcagtggtgcactctgctgcaaacctgtgagtggaactctagcttccttccattcctgccttgcagaaactggtatccctcctttgctgagcttgtgagtgggatcctgactttcttctccaccctatagtagaagcagcaa

SEQ ID NO: 223562 - DNA, 402 bp, Homo sapiens
gggtgcaggacctcatgcctgtacttacagcactttgggagaccgagataggaggatcacttgatcccaggagtttgagaccagcttagacaacacagggaaactttatctctataaaaataaaaccaatcagccaggcatggtggtgcatgcctgtggccccagctacttgggagattgattgtggcatgatcacttgggcctgggagttcgtgggtacagtaaactgattgtgccacaaacaaggaatgagaggtcctgttgctccccatccttgacagcatttgaccttttcattcttctggattttggttattgtttgattgtttgtgccactgcactccaagcctgggcaacagagactctctctcaaaataaataaaagacttctagtcactatat

SEQ ID NO: 223563 - DNA, 569 bp, Homo sapiens
tatgtgtcagtagtttgttccctttattgtgaagagtatttcattgtatgctataccacaatttgcttatccattcaccagttagtaaatatttgggttgctggattcagtagctattctggcagttacgaacgaaacttctataaacatttatatacaagactttgtgaggatgtatgtgttcattaatcttggataaccacttaagagtggaattggtggttatcttttaagtatatgttaaactttgtgagcagctgtcaaactgtttctcaacatagcagtaccatttgtgttcccaccagctctgtatgagagttcctgtggccccatatctttactaaaatgtgattattctctatctttaaaatgttggtcattcctaatgggtatgtagaactccttttctgcaaacttcttggcaaaattcaggtcaagagggatttggttgggttgagtaattttctaagaggatcattttcatggatgggaaattcattctgaggatataataagtactccaaaagaaaatattttaaatttatatttttaaaaagaaaatcgaccct

SEQ ID NO: 223564 - DNA, 232 bp, Homo sapiens
ctgaggaacaaaattaattcatagcaggaaagactggaactgggtcacttgcaaaaagaatgcattcctgaatgtcaaattcactaagcagaggaaatatcttctgtaatttactgaagaaaacatcaaattcattataaataagacctatgggttggatagtctcagaacatctctatttcttaagtcacttggaaaatgtatgtatatctgcacaaatagaatcgtctga

SEQ ID NO: 223565 - DNA, 252 bp, Homo sapiens
tcgcaacattgaacactcaccccgccacagtaaccaaggcggtcattaagaggagaaacagcaaactaagcctttctccaacctggggtgatgcaacagggacccgggcggggaagaccgtgagggtctggggaataagacagtgagcaagtgagcaggaccttgggagagagaggagggactggggcacactgaagaaaaactgggggaaggtgtatgaagggagctgcgagctgaggtctgactttgatt

SEQ ID NO: 223566 - DNA, 713 bp, Homo sapiens
atctcaccactgtacttccagcctgggtgacagaacaagacccctgtctcaaaaaaaaaaagaaaaagaaagaaagaaatgaggtaagcccattaccacctctgtacataaaatttatggtgaagaaaagcaattaatgaccaaaaacacagcaccacttttctcatttccttcatttaaaacttttttgttgtttctgtatctaagtgatttatccccctccctgaatttataccaactccctgaatgtttcctttcacttagatattgctgaggtagctgtactttgtattatttgcttcaaggaaaagagaaaatacctcagtgtcccagatactcttgtatgtgttgcactaaaaagatctggaacacctggctggtctaatgtctaatggtggtgggttatcagaacttattaacattagtgtcgtccaggtgcagtggcacaagcctgtaatcccagcactttgggaggccaaggcaggaggattggttgagctcaggggttcgagactagcctgggcaatatagcaacaggatctctagaaaaaatatgaaaattagccaggcgtggtgacacacaccagtaatcccagctacttgggaggctgaggtcggaggactgcttgagcccaggaggggaaggctgcagtgagctgatatcacaccagtacactctagcctcggctacagagtaaaaccctgtctcaaaa

SEQ ID NO: 223567 - DNA, 385 bp, Homo sapiens
ggaaaagtgagagtatgtatgattagctttccaaacatgataaaaagtaaaaacgatatacactccctgaaaatgcagaacccagtctgcttgacagtttgggtgggcatattttgaagaaagggatacagtaaaataatagtaaatactcattaagttagctgtgtgccagacacttatttagtgctgtgcatgcattatctcatttaatccttgctacttacgaggtagagttatttccattttacaaacaaggaattcgcaccttaggaaaagttaagtaactggactagcatcacagctgttaagttacagagttaggatgttgtccgtaattatactcttttaaattcatgtgtacactagctgtaaaagtgaatattat

SEQ ID NO: 223568 - DNA, 318 bp, Homo sapiens
gatggtatatgctgattaaagtattagaacagtgttccctacactaagtgctgcctttcaaccctactgtagattctataaatgaagtgaagggatgtgttatggaatagtagctttgtggggagtagccgcaacctgaggcagcaaagctgtggtccctgtgctagttggagagctactgcacatgggaaaagttgaatgacagtacaagtctggtgttagaaggaccaattctgcttctgtatttatggagtaaaaagggatggtgaatgtcctcgtttgtcaactagatgggcaacaaagacagtgaaatgagtg

SEQ ID NO: 223569 - DNA, 267 bp, Homo sapiens
aatcagctcggccctgtggtcatccatcaacctcagtgaaataccagcgtcaaggagcccccaccagcaccgctgtgaagggtaagagtgcgggagaaagaacacagtttacagcagggccaaccgagcgcacagtccctggcttgtagtctgcgaccttgaattaattaatttagtttgtttatgtatttatttatttattttgagatggagtctcattctgtcgcccaggctggagtgcaacagcgtgatctcaggtcactacaa

SEQ ID NO: 223570 - DNA, 439 bp, Homo sapiens
agtcatttattgtattatgccatggaaagtggatgactctcatggtgcaagtgcagtctatgtccgaaagagggagtagtgaaatcacagatagcatcatggtttttctgactttttgcttctgatatttcccaacttaagagccagaggagagtagggaactgggaaagaagagtttatcagctgttggatgaacagatctttggagtaagcagttgtctcgcacactgcagctttacagccattgagcagaacacccagccaccaatgcccttctgtgatttcccaagtcctttcctttaacctaagaattaaatacttttaaacattcaataattatcaagatgatatccttgttgctagaagcttttaattctacttaaatgaactggttagaatctaaaacgtgttcattgttaaataaactggttagaatcta

SEQ ID NO: 223571 - DNA, 455 bp, Homo sapiens
ttttaagtaacatgacaaactctcatgccatcctgctctatcccacctggaatgtgactcatccttttgtccagtgcatccatgctgtaaatactacctgtacaccagttacttaatagcctgctcagttatcagataaaaaaacacaaaatatcaaaatatatatatatatagggtttcatactatctatagttttacacatccacttgaggtcttggaaggtacccctaaggataagaggggactactctattaatcctttcccaagtaactcatggatcctatattagcaggagctctggtactatagtactatagcatatatgaaaaaactgaatgacttctattatttggagagaaacttattagtaaactctcagaagttgtatttggaaattatgtcttctacatgttaaaagagcttattaaatttagtctgttttggttcctaaga

SEQ ID NO: 223572 - DNA, 940 bp, Homo sapiens
ccaaatggagtttatagtacaacttgaaaaagtaagtttatttacagttactaaaatatctggaggtactctctgagtaacaacttgggttcttatagtcagattgctctgaaagtagttctaacaaacttcattttggcttgttacatcattcgacttttgggaaattattcattattgcatcttaggaaaacagtatatacagtcaaatatcaagccagcctgattatgcctaattcatgtgtacaggcaataaatattatagttcccagaagagaagagtaaaaacaggaaatatttttacgttcatgggaatctgggtaactggggtttgtgtgtttcaacttttggtttttggcttcatttttatgtacctacatctacattgagaattgctcttctaaatgattaatctcttacacctggttaattctactctttactgtatagtgggccagaaaacatgcagtataggtttatttcatgtataatagctactgctttctttattgtgatgatacggtttataaagtaatacattttaagttgttagagccaaaggaattattaagaaattgttagaaaaggctgggcgcggtggctaacgcctgtaatcccagcactttgggaggccaaggtgggcggatcacctgaggtcaggagttcaagaccagcctggccaacatggcaaaaccctgtctctactaaaaatataaaaattagccgggcgtaaggacaggtgcctgtaatcccagctactcaggaggctgaggcagggagaattgcttgaacccgggaggcggagattgcagtgagtcaagattgcacccctgccctctagcctgggcaacagagcaagactctgtctcaaaaaataaaataaaataaaaagttgtttgaaaactaaaacatcctttcatcatccttatactttaataga

SEQ ID NO: 223573 - DNA, 403 bp, Homo sapiens
caaaagcgaaactccgtttcaaaaaaaaaaaaaaaaaaaagggatgttaagcaaaacgacccattattctaatcagggtttgagttgctacattgtatcagagaagaactactttccaatctctgtaagtcacacaagtatactttgttatagtccagttatcagctcactttgtttctttgcttctaacaacactaacttgatatttcatattgaggttgtggtcagccagggcccctgaatttttgtttttgttttctgttttctatgccagtgcctgactatcaagtatcttgatattagtatgggctccctgccatttcatttagaactttgtaattgaggcataataaacatgtatataagataacacgtaattatacaacttgatacgttttcacaa

SEQ ID NO: 223574 - DNA, 1003 bp, Homo sapiens
tggatggcttaaacaataggaattcatttctcccggttctggagatgggaagtccaagatcaaggtgccagaagggttggtgtctgtcgagggctccccttgggtcacagacagccattctcttgctctgtcttcaccatgtcctctccatgtgtgggtgggcttgtgagcttgaaagcaagctctctggtgtcttcttataagggcactaatcccatcatgagggccccaccctcatgatcctatctaaccctaattacctcccaaaggccctcgctccaaaataccatcacatggaatttggtggggtggatagaattcagtctatagtacctagctgtcactcaatatccctacttgggatttcaaaggtctcagggaaggaccagactgaggtcacaagcttccttttgtagcctgggttataactggggaagggagggcaatgtcttcccacaaagaaagggagagctgttccagaaggaggaagagtgctgagcagacagtaatagcaatggctgacttttgctgagagcttgttcatgctgggcactgtgctaagcttctgtgtattcagtcatttgatgcttgtgatcatcctgtgtggtgggaactgtcattactcccattttacaggaaaaggaactgaggcccagagaggttactcagcttgccctaggcaatacagccaagagtggcagaaccggaatttgagtccagactgtctcaccccagggtgcatgagcaccacacaccagtatggctgtccttcgcattcctgtggtctctgccgtggatctggcttataccttcctctgggcaatgcattccctgaatatcttgtaatccttggttgccagttcctatttagggtgtggggcactgagataattccagggaacttgggtttcacgagggagcttctctgtctgctggcttcttgttgaggcctccgatgtggtgtgggggcacttctcagtgcttgggggaggccttttctttg

SEQ ID NO: 223575 - DNA, 543 bp, Homo sapiens
cactctcagactcataagcatttaaaatgggagaccctgggaaagcctgttctagtcagtccaccctattgtcattatgaaagcatcatgaacacaagtggcccctgtggcaggccgggacggctctgccctgatgcagtgggcgggatctctggggaaggcaggaaatagaagggcagtatcaggtaccttgtctcccagcttcccactgtgagactgggtgtgccgagtctgacctgccagggcaggactctggaaacaccaggcttctcccttgagatccacattgattcatccacacctctcagagacagctcatggcaggggttttgagcctgccaggctcttgttcccagggaacccttcctctcctccctcctctcatcttcccagtcacctgccacctccagctccacctggtagtaacatttctctctccttttaaaaagaatatattttgtcaagcattttatttctgaggctgagaagtgacttgtcaatttgctggactggatttttataaaattcgcccattcaccagca

SEQ ID NO: 223576 - DNA, 424 bp, Homo sapiens
tacctgtattcccagctacttgagaggctgaggcagaagaatcgcttgaatccaggaggtggaggatgcaggagcagccactccagtgcgggtgacagagcgagactccgtctcaaacaaaaacaacaaaaacaaaaacaaaacaaaacaaagacaactgtttagaaaatataaagtgagaaagggggctataaagtgtgtgactggagggaggtaggacactgaactattagataggatggcagacttttgggtagagtataaaagaggtgaaagagacataagggctctggaggaagagcattctaggaagagagaataggatatgcaaaggccctgaggaaggaatacgtctcataccatccccagacagcaagaacatggaggctgtttgttgcatttcccgtcctgcattacaataata

SEQ ID NO: 223577 - DNA, 471 bp, Homo sapiens
ctgttgttttagatgtttaaaggagatgataaaaatgctgcaacccagataatgatcaccttactcttcaaaaatactgcccaagttctttgttcaagatgccaagaacctggataccctccactggtaacaaatatgactttgtttttagcaagcaactttgcagtgtaattaagttaaggatcttgagatgagatcatcttggaatatctgggtgggccctaaatccaatgacaagtgtcctcataggaagggaagatacacacagaggagaaggtggtgtgaagatggaagccaagactgttgataccagttggagagcaccaagaactacccgcagccactgaaagctaggagagaggcataggactgtctccttcagaccctccagaaagaccaaacctgcccgtgccttgatttcagacttttggcctcccacattgtgagagaataaaattttgtttttgaagc

SEQ ID NO: 223578 - DNA, 749 bp, Homo sapiens
agcgggtccgtggccggtgaggcgcgaggggaggagggcttgcggggctggggcgttagctgcttcccggctggaagcccgcgaacacgaactatgaggaaggcgccgccgtgggccgtgggcgcagttgctcgggcgcgacgagcctatgagcagcgagacccgacgggcggactgccgccgtcggccgtggcgagccggcttgatgcaccgacgcccgcagggcagcgtacgcactggctccactagacgacccgttcgtccatggcgacactctcgcgcccggagaaacatgattcccgtgacagaattccggcagttctctgagcagcagcctgccttccgagtgctgaagccatggtgggatgtgtttaccgattacctctcagtagccatgctcatgatcggcgtgtttggatgtactttacagaattcagagttcaagagctccttaaaggatacacaaaactgtcatcagtagttaagatttcggtggtctgggggtgaattccaggtagcaagagaagagtctaaggagcagcaggcaacgtgctgaagtgcagagccaggtcaaggctgggtttgtctgagcagctggtgagtaagagagctgtgaccagggctctgagaaatatggacaggggccagcctgacaaagacaacaaagaactgcccaggggaaggtgaagaaggtaactgtcaacccttcaaaaagtgaaatggcgttagtaagatgaaggccagcccat

SEQ ID NO: 223579 - DNA, 454 bp, Homo sapiens
acacagtgctacttgaagcttattttatagataacatacttaactgttaacagattcagttagctgtttacagtttagttaactggatatagttctcaacccacatggggtcagtcattttcaacaaatctttttattttctctatagaattcagagttcaagagctccttaaaggatacacaaaactgtcatcagtagttaagatttcggtggtctgggggtgaattccaggtaagtagtccctcttatcaaatgtctctttaacaatgcttgcagctatcttgatgtgacaaccatcacaaaagcaaatattaatcagatcactaaagggacacaaataaccgacactagccaagaaagaattcaaatatatttttgaactagtttggggccaacttttgtgtgagaagaggaattgagttcacttcatctggtgttaactgaaataagagt

SEQ ID NO: 223580 - DNA, 420 bp, Homo sapiens
ataaataaaatatttatttatatttatcaaagcaacacacaacctaggtgaggatggggaggtgtcaaacaagacctaacctctcaacaatcagctggacactgttgtgtaagaatgtgaagcttggcactgctgcagccatcttgttccaggaagggtaaaacctgaggttagaagccaacatcctaatgatggcagagaagacaaagagaaccagagtctaaatgacattgttgagttagatcactacactacctctagtcttctttttatgtgtgataataaatctcacttatacttaagccatttgaagttgagtctaatgttcatttcagaccaaagcagcttaactgacatgttctccgctttgttaccctatccagttgttttcatgcaggaaataaatctcaaattacctca

SEQ ID NO: 223581 - DNA, 449 bp, Homo sapiens
acaaaaccacatgatcatctcagttaatgtcttagtccattttgtgtttctataaaggaatacctgaggctgattagtttataaagaaaaagggtttatttggcttacaattctaatgtctgaaaaagtttaagattgggtctctggcgaaggcctcaggctgcttccactcatggcagaaggtgaaggagagccagtgtgtgcagagatatcatggtgagagagaaatcaagaaagagggggaaggtgccaggctctgtttaacaaccagctgtcatgggaactaatagagcgagagctcacttttccccaagggaaggcatttatctattcttcatggatccacccctatggcccaaacacctcccattatgttctacctccaacattggggatgagatttcaacatgaggttttgaggggacatatccaaaccattgcaaatgtag

SEQ ID NO: 223582 - DNA, 677 bp, Homo sapiens
tggaattatgagtcaagactgggcaggaagcaggaagcaaggatgaggagccaggttatgataactagtgatgcatggggtgtccaggcccagaggcactaaaagggggtcaaggaccagcatggagactgggtaacagagagccatgctgtgctcatggaatctgggcagcaagagtagcagctcccagaggggctggctggcaaccttttgtatcagcttaggaacttttcatgttggtcaggagcagagacgcagttccagttttggctggcctggagcttgcaggataagcccgtgtctggctgcactgtaaaaataacacggagaataggatgggtcttgtccttggtctctagagcagccactacatggaagaaagaggtagaaggcaggtgtctatcaagtgacatcacagaactcaagaggagtgaatgtcacctccattccccagtctcccaacattccctggggaacagggcagagggaagacagagtaggggaattccaggataagcttcatgcacccagaatgtggaatgctcaccaaagaagaacaagagccgtgttcacatcatgatattccgccctcttaattcccaaacagggctcccaggctacagagcagctttgataacagcagtgcactccctctcctctagaaagttaggtggctt

SEQ ID NO: 223583 - DNA, 940 bp, Homo sapiens
gcaacctctgcctcccaggttcaagtgattttcctgcctcagtctcccaagtagctaggattacaggcgcccgccaccacacctgggctgatttttgtatttttagtagagatggggtttcaccatgttggctatgctggtctcgaactcctgacctcaatctgcctgccttggcctcccaaagtgttgggattacaggcgtgctagccacacccagcctaccagagaaatttaacaaggatattgaaataattaaaaaattaaacagaagtcttagaactgataaatagattttctcaactggaaaattcatcagaggctctcagtagcaaaatggatcaagcagaggaaagaagcagtgaccttgaagacaggctgtttgaaaatacaaagaggacaaaaaagaataaaaagcagtgaagatgacctacaggatgtagaaaattatttcaaaagaccaaatctaagaattgttggtcttcaagagggagttgagcaagagcaagggtagaaagcttattcaaagaaatagcagaaaactctccaaaacttgagaaggatataaatatccacatgcaggaaggccagaggacaccaaagagatttgtcccaaataaaaccaccccaaggtatataataaccaactctcagtggtcaaggacaaagagaggatcctaaaagtagcaagagaaaagtagcaaataaccctaatggagcttcagtcagtttgtcaacagacttcttagtacaaaccataaaggtaaggaaggagtggaatgacaccttcaatgtgctgaaagaaaaaaaaaatttaacatctaagaattgtatatccaacaaagttatccttcaaatatgaaggagagatacattctttcccagacagaagtttgagagaattgaccactaccagacccatcccacaagaaatgctaaaggg

SEQ ID NO: 223584 - DNA, 507 bp, Homo sapiens
agaccaggcgggtggggttcaccccaggctcctccccggcccggcccgcatggtcacaggactgcgccttggggttcagacccttgtcccgtgttccagagccagcccttcccgactccaaagtccccttccttgtggccgggccgcccacttgggaagcccgatgaagagttaatagtttaatgtgttacccctcccaggaataggtgccttcagaaacaggtgggccggcgcggtggctcatgcctgtaatcccaacactttgggaggccgaggcgggcggatcacctgaggccaggagttcgagaccagcctggccaacatggtgaaaccccgtctttactaaaaatacaaaaacttagccaggcgtgatggcagatgcctgtaatcccagctacttgggaggctgaggagggagaatcgcttgaacccgggaggcggaggttgcagtgagccgagatcgcaccactgcactccagcctgggcgacaaagcgagactccgtctc

SEQ ID NO: 223585 - DNA, 425 bp, Homo sapiens
gttttttttctgttgagactgcttttactgatgacagttcattagataggaaatgattctgtggtacacaattttgaactttgcacatagggaattatttccaaattgacaaaagttgcccattattacaaatttctgaagcatcctgtttcaaattgatcccgtagtggtacctttgagttagaggggtgatgttaatgttgaccagggtgttaccttgagaatgataatttgggatccagtagaaccctgttaaactttaaaatggtagaaggagcaaaaaggcagttgactgaactgaaggggttgaaggatgtgagttcatccttgttacctgcaaatagcacatgcgtgcacttaccatccgggaactctgggcactaggctgtggcacatctcccaaggttaccccatgcctttctaga

SEQ ID NO: 223586 - DNA, 525 bp, Homo sapiens
gccatggccagcccggagccccggcgcggcggggacggcgccgcccaggccgcgaggaaaacaagagtagagggcaattctcttctttcaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagcagagccccagcatggaggagaacctgagcatagaggacctggaattg

SEQ ID NO: 223587 - DNA, 934 bp, Homo sapiens
agcaagtatataaaaataataatgtttttacttttttaagtattggaagtaccttagaaatcattgactttgcccaactgccccattttacagttgtggaaaccgaggtcatagaattggtaaattacgaagaaaactgtgtttcctagtaggtctccctgccttcactctgcctccaccaccaggagtctctgcacccagtcatctttctaaggggtgtgccatccatcactccccacgcaaaacctctctgtgccctccaatgcagctagactgaagcctgtgatgtcagtgtggtcagatccctgcaacctcagcttgtgttcatggcacactgtgcttctgctaccctggccttctctctgctgtgtgaacacactaaggtttaacccttcccgttgtcttggaggggaaaattctcccagatattcaggcttctttgtgtcattcagtctcactcagctcaaagggcacttcctctgggctgccctaacccccaccagacacccaaactagatgcacaacgctcgtcactctttcccatcagcctgattggatgcctctaaagcatgtaccactatctgtaccactgctcatttattcattgttcatgtttattgtttgtgtccaatcactgacaggaagctgcaggaaggctaggattcgtctctatttccagtgtctagaacataattgattcatagttgatgcagaaaaaatatttgttgaatgactgaacaaacaaatacatattgaaggaaattcaaaaatgcaggatagtataaaaatacaaataaaaatcacccataactcctagttctggtattacttttgttaaaattttttagtatttctttttttcaggtctcttttctatttgtgtacatatgatattcagtatgcatttaataaaattgggactactgtaaattac

SEQ ID NO: 223588 - DNA, 373 bp, Homo sapiens
tctctgcatcctcaccaacacttattatctgttgtttttttaataatagctattctaagtggtgtgaggtcatagctcattgtggttttgatttgcatttccctgataattagtgatgtcaaccaccatttcctatatctgctggtcatttgtaaggccagacttacacaccagccttcctgaagtcaacttttgaaaaatgtctattcaggttctttgcccattttttaaattgggttgtttgatttcttactattgagttgtatgaattcattatattttttggatattaacctcttattacatgtatcgttcacaaatattttttctgaatcctaagttgctggttcatttcgttgattgttttctttac

SEQ ID NO: 223589 - DNA, 269 bp, Homo sapiens
aaaccccacccaatatggaatgcagcaaaagtacaaggacaggcctggtgccattgcttcaaggtcaactggctgacgggctgttgacccaggaacgggagacagttgccaaacaggactggccttgtgttagctgaatgtttgctccatgaacttgtaatttaaagggcactggctaccccactctccaaaataacaacaaacaaaagaccttcattttattttgacacggtacttgaaacctttccaaatagagtcctttgaggttg

SEQ ID NO: 223590 - DNA, 357 bp, Homo sapiens
ttgatcatggctcaccgtaagttcagactcctgcgctcaagtgatttttcccacatcagcctctcgagtagctgggattgactgcaggtgcgctcaaccacgtccagctaatgttttgtttttttgtagagactgagtctcactatgttgcccaggctggcctgaaactcctggcctcaagagcttctcctgcctcagcctcccaacgtgctgggattataggcctgagtcactgctcccagcctggcactgccttaggacagtagctggatgcatctgattaatgttattaactgactaaagccatttattgtttcttcacatacagttttttaataaaagtatggtcgagattac

SEQ ID NO: 223591 - DNA, 473 bp, Homo sapiens
ctccacaagaaagcaactcaggctggatttcaaacagcatacagtctaagctctaggtgatttttgacagttgtgttgttgctatagtatcctttttacaagtgatggtggtggtctttggttctcctcatcccctcaaaggctgttgaatcacagcaccagtaagcctgagaatgctaagggctctagcccaggctttctcccagattctctggtatgtgccctcctggtgacaatgaaattggctaattgctctcagtggtctggagtgactatgtccacagttcatctttcacagtaggaatcactccttttttgcttcatccatactccatagagtctctccttttcagacatcctaggaggaaaggatttagcttctatttttttagactatatatttttgacatctgttttttcttaggctattacatttaagttattaaataatacagataattactgcttttatc

SEQ ID NO: 223592 - DNA, 159 bp, Homo sapiens
tgggagagaccctgtattacaatccagtggggactgaagggattttgactttggctgtagggatgttaatggctgtttattgtgtatttcagtatcaaatgggcagtaatacttaattcattcatgcaccccatcatagcaagcagagagcttcggtag

SEQ ID NO: 223593 - DNA, 250 bp, Homo sapiens
acttctaaccggtcacctgcagctcccacctccctaccagcctcctgctcactgagctcctgcctttgagggagttaattcccctccatgggccagagagaggggccttgagctctgatagccttccagacactaactggctccagctgaccttcctacccatgagtttcacgagtgcctcaggatcctgaaccacagatcccgtctcttgtttagttagtgtgagtgaaattggtttctgatatttgag

SEQ ID NO: 223594 - DNA, 446 bp, Homo sapiens
gagagtccattgctttttaacaggcttcacaaaaggtaagcaccactcagaaggggagacactgtctttattagttgtcaattgctgtgaaacgaattacctcaaaatctagtgacttaaaacaatcaacatttcggctgggcacggtggccctcacctgtaatcccagcattttgggaggctgaagttaggtggatcatgaggtcaggagttcaagaccagcctggccaacatggtgaaaccccacctttactaaaaatacaaaaattagctgggcccgatggcaggcacctgtaatcccagctacttgggaggctgaggcaggagaattgcctgaacccgggtggcagaggttgcagtgagctgagatcacaccactgcactccaggctgggcgacagagtgagaatccatctcaaaaaaataaaaaaccaaaaaccaaaaacc

SEQ ID NO: 223595 - DNA, 1059 bp, Homo sapiens
tgtgtggtgggggaaccatgccctttcaaccaagctatgtggtgttcataagggtagcccctcctccgaccccaggagtggcagttcacagccctgactgatcacagtgttccgtggcctagctgtaaccaccccagggagtgagactgaactcaggggttcattggacctatcaggaaagagagacctttcttgtttctggacttggagctgtgatgaagtaagtgggtcaggggccaacacatagacagcgttggcctacaaatgcagcccaggcagaggacggtgcagccaagccacacagagagacaacttcctagtgacacgctgtgaactcctgcatccacccctgcctgaactggagcttttcctcttcagctcttcagttatgtgaggcaagatgttgccttttttgcttaatgctgtgagttgagtgtacagcagttacaatcaaagaatcctaaataatgctgcaagcatggtgactatctacatgggaatatgcagtactccagtgaagacaaaacataaattaattttggaatctgatgaccataatctaaaaacattcatagaggtatataaaaattataacaaaatttaaagtagcatatctcctcatgaagcaggttaagtgtatacacaaagaaggaggaggaaaaggtgagaaagaatctgcccttgtggggaagtgacagaggcagaagaggctgatgcagtcctgcatccaggcccagctctgccagcagctgagtacccctgaacaagctcccccacctcttcgggcctcactttccccatctatgaaagaaagggagtctagcttccatagctgccccagctgatacgcaaggtgccagtgtgtcctcagtcctgtcaggagaaaccttccccactagaatcccaggaggagcttgaaatcctgtctgggatcctgacggcccaggtgctgaccctgcctcgggttgtgtctgctaagaagtctgatttctgctcatctctccccatttctttcttcccataaagtgggctgatgcgctggaacgtcgatgcagccag

SEQ ID NO: 223596 - DNA, 332 bp, Homo sapiens
agtattgtagctaagaagccattgccaaattcaagatcatgaagatttacctctgctttcttctaagagtttgatcattttagctcttgtacgtaggtctttgatccattttgagtgaaaatttttttttggtgcaaggtaggggtcgtgctttattctattgcatgtagatacttagctgacccagcattctgttgaaaattctaatatttccccatgaatggttttggcacccttattgaaaatcaattggccatagatgtatagactctcaattctggccttattgtctctccttatgccagagtactacacaaaaaaaaaaatcactc

SEQ ID NO: 223597 - DNA, 480 bp, Homo sapiens
caagaaaactgtacagtgctggaggctagaagtcaaaatcaagtgattggttggaccatgctctctctgacagtgacaggggagaaccctccctcgcctctcctggcttctggtatgcaccagcaattcctggcgttccttggctcctagaagcatcactcctatcacatggtcatcttcaccctgtgtgtcttcacactaccctttctctgtgcatgtctgcccgaatccctttttataaggacaccagtcagattagattagggtctaccataatacctcattttaacttaattacctttgtaaagacctttttccaaatatagtcactctctgaggtactgatggttaggatctcaacataccttttttgggaggacacaattgaacccataataaggtgtttgcaaggaagagttaaaatttgaaagaaaggtggtatttgcttagatagatagggcacagctttctaggtgacaa

SEQ ID NO: 223598 - DNA, 168 bp, Homo sapiens
tttttttttttctttagctcccctcaaagcacatggactaatagagtaacacaaacgaattggcataattccttctcctgctattgttactagttcaagtgtgggcacttgccccaacttgaggccaagagtatagggaggatgtttacttgctgcttctgggaagaa

SEQ ID NO: 223599 - DNA, 377 bp, Homo sapiens
attctgtttgtccatatgtagatccaaagaatttcatgtcatcctaagtatctcaataggaaaattaaaaggagaagtaaagatattagaagtcaatgaaaaactaagtttcaggggataatgttttaaattacatgcagagaattaaggagaaataagtggccaagaggacaactgcagcctcacacacggaccacactgactgatggtgaggacagcaagcaggccgcactggagtcggtcatgtctcgttcccaggctggaacaacaacacctacaagtacagctccaaaagcaaagaccaagttcaaaggccccaaactaaatatcactgtaaaagaaagctcctaaaactaaaaggctaattttttctaaat

SEQ ID NO: 223600 - DNA, 164 bp, Homo sapiens
tggattgtctgtttattctgctcactgttccttttgccatgcaaaagctctttagtttaattaagtcccaactgtttatctttgtatttgcttttgggttcttggtgatgaaatctttgcctaagccaatgttatcgtatagagtttttataatttcaggtctt

SEQ ID NO: 223601 - DNA, 337 bp, Homo sapiens
atgataatgctttatacttctcattgtttggtaaactatttgattgccctctttttagtgaataattctactaggtattacttttctactgatgcagaagtgaaaacatttgtgaaacgtggtagagaggcagaagagtgaagaagagcatgtgttctagtaatttacaaaatattaggtctaatatttctgattacatcagctttctcttctccaaatcttggtttccttatctatcatactggcattctgatattggtttcaacaacttcagatgtaaataaaaatgcattaaaatccataaaatactaaataaaagaaaatatatttgtaaagt

SEQ ID NO: 223602 - DNA, 571 bp, Homo sapiens
cacagagctggcctcctctcaatggcacgtgtgaagcaacacactcacccttttacccaaggggaaaaataaaaaaacaaagttcctgtccaaaaagctttaaaactatggacaatctcaaaaatcgcatgcccaagaatttccagtttagaattttttttaaaaagctctgaagtgtattgccaaattattattattcaactttgatgagtttgaacccagcagagccagcatccatttctgatttatgaaatccactgagtgtcttagctttacgtgttaagatacaggctctaaaattaccaattttttttctgttttggttgataatcctgtggaaacaaaaatgactttgcttggtttggcagaaatacaagaaagataagctggttggaaaagagggaacttgttccaatccctgtcccaaagtcttttcataatgtgtgtgtcagcctaagaaattttaatatgtaatgcctaaatctaattatttaatttggctacaatgaattgttgaaggatgtttaatcgttttgctgctagcattgtcacagggcaatgttaaatcatt

SEQ ID NO: 223603 - DNA, 465 bp, Homo sapiens
tttttaaatggtaaagtgaattcagatctcaccaattacatcaactaatttatgtgtctgtgtattctatgcaattttattacatgtgcaaattcatattaccaccacagcagtaaaaatatagaacagttccattacaaggacctttagtgctagcctttcatagggacagtcttccccacctgttagcaaccactgatctgttccccatcactacaattttggcatttcagaaatgttatatacattgaattatatagtatataactttttgagattggctgtttccactcagcatactgcccttgagatccattcaaattattgtgtgaataagttatttgttctttttttatattagagtagtatatcaacaacctgaatgacttttaaagatattatactgagtgaaagtctactttcaagaggttatatactgtattatgacatttatgtggtattatc

SEQ ID NO: 223604 - DNA, 389 bp, Homo sapiens
acccacatgatgtgtagatcaaacactaattacctccagggttaagggaaaaggtgaagactgtggagcatgataccaggctgataatcatcaccttaacctcctgtgagttctgtaaatgaggacaagtgccttgggacaaaggtctccacactgttggaaaagcaacttgggcagtgagggcaggagtcttgggaaatgatacataatatccagctgtcagatcagcctctgtgttcccagtaactcagtcaccatctgtagggttcaactactttcccagctcactgaacacaagaatcactgtttcacctcctcctgcttctcttattcagaaataagctcaattcattcattaaaatgtgccctaaaaggaaaggaaagaggga

SEQ ID NO: 223605 - DNA, 380 bp, Homo sapiens
agccgggaaatcacgaaggaggggaactcatgcttgcatgtttgagataaggactgtctcaaggactttctaaaatagcccccaagaaattccttcttcaggactgcagcaattcaggtaagatgttctccaaagaacactgcccagtaacgtcatctccaccaatgaactgatgccaactctagctttgagcctctgcagccaatgaagtctgtttccaagcagcttatgtgaacttctcttttttttttttttttttttgccaataaaagcttccctttgctgtcccctctccagacgcacctatggcttgccacagctatacttccagagactaatccatttatgcttactcccaaatacattcatcatataggaga

SEQ ID NO: 223606 - DNA, 359 bp, Homo sapiens
caaaaactcagaaaataacaaatgctgaaaaggacacagagaaatgggagcgctcaaacactcttcgtaggaacataaaatagtttatccactatggaaaactgcatggaggttcctcaaagaactaaaaatagaactatcatatgattcagcaatcccactgctgggtatatgcctacaagaaagaaaatcagtatgtcgaagagacatctgcactcccagtttattgcagcactattcacaacagccaaaatatgaaatcaacctaagtatcaacggatgaacggataaagtgtggtacatatatatgaaaaaaaaaggatttgtgaatatactaaaagccattgaattgtatgcct

SEQ ID NO: 223607 - DNA, 108 bp, Homo sapiens
agacttattcatcttcccaggaataaccttaaccagacacaggaggggaaacaggaaacatatctggatatgcttagaatctgcgtgaatactgtgaagtatattaga

SEQ ID NO: 223608 - DNA, 370 bp, Homo sapiens
gtgaagatggggccagccatggtggctcacacctgtaatcccagcactttgggaggccaagatgggtggattgcttgaggtcaggagattgagaccagcctggccaacatggcaaaaccctgtctctactaaaattacaaaaattagccaggcatgatggcacatgactgtaatcccagctgctcaggagactgaggcacgagaatcacttgaacccaggaggcagaggttgcagttagccaagattgtactgctgcactccagcctgagtgacagtgagagactgtgtctcaaaaaaaaagtgaagatgagcaagcagtagccattggctaagtcatttgaattcttaaaaaaaaaaaagatacctaga

SEQ ID NO: 223609 - DNA, 680 bp, Homo sapiens
agggaaaactaaacctcctcaaactggatcagagcaggaaattgcaaaaacgtgtaggttttcatggttacatacaggaggtattgcaacatttggaacatttcaatacaactaaggtttatcattcatacatcctaaaaattatgttccagaaattatactgtcctgggtgctaggaatacatataaaaattgtccctactctcaaagagctcaaagtcaaaaggaaaatcagacaagaacaacatggtttgagaagttttactgataacagatattcagcatactatgggaatataccaaagaaacatgtaacagacttcagtgaccttagaaaggcttcttgaaggtggtgatccccaacctgaatttaaagacatgagcagctgggtgatggagtgagaccccatttaaaaaaaaaaaaaaaaaaaagctttcctccaaaagagcttcaggctctaagcataactttaatcttcctgagtggcctcaaacagctgtcgattaccctgttagggaacatggagggagcacaggttaggtgcactgaggataacatctcatgctagtaatgggcacaaagtaggagctttcagagaattgatgctgatttacaaagtgttctgagcagttctagaatacagaaatatttaacaaagatgactgccttgttaagataac

SEQ ID NO: 223610 - DNA, 524 bp, Homo sapiens
cagagtctcagagctgtgggttccgggactttgcaaagaaatgtcatgaagaaagaactccgatttgaacggaagctggacttccacgttgtggacgatgggctggtcctaagagggaggtggccagtaggttccctcagagaaaggttggtgacatggaaaatcgtttcctgccctgtgctgtttttcccctagagtcagtggtggggagttaggagtcaggctgtgcacatcttggaaaagggggattgagggactgtggccgtccttctccctgttgtgggtctgcactgtggtggtagtgtcatgccaagagaggaccctgacctaggagcatggggaagccgttcccagccagaggcgctaaataccatctgggggaggggtgttcttcctgccacccataggggaggacttgcatattcttatttggtatattcttaaatattcttccagagtgatcttggaaggcagaaaaactagggaacatttgggtaacgtgtaaattcattaaaacatagaat

SEQ ID NO: 223611 - DNA, 496 bp, Homo sapiens
cattaatgctgcctgtctcaggcacagtttttcaatgtactgtgttatttctgtatttctgtcaagtcaatatcatgcttttattaaaatgactttgagtgtgtgtgtgtgatatttttggacagctgcctgtttattatactcatgcacattgtctgtatttcatagagtaggcaaaaaaaggattttaatcaattgcaagagtcaatttcaggcaggacgcagtggctcatgcctgtaataccagcactttgggaggccgaggcaggtgaatcactggaagtcaggagttcgagaccagcctggccaacatggtgaaagctcttctctactaaaagtacaaaaactagttgctcgtggtggcatgtgcctgtaatcccaggtatttgggaggctgaggccggagaatagcttgaactgggaggcagaggttgcagtgagctgatattgcaccactacactccagcctgagggagagagcgagactctgtctcaa

SEQ ID NO: 223612 - DNA, 255 bp, Homo sapiens
atctaattgctcacttattacattatttttccaattaaaggtgtaagatttagacattaaatttaagttataagtgtttccttgaacacctaattgtaactgcaactagaacagtgatcattggtgactattgaaagttcagtgatttttaaatatattttcaatctgtaaagtagtagcatagcccagattgcataggatgaaaaatggaagatcacctaaatcttttcaaatccttggatgaaaacatcctag

SEQ ID NO: 223613 - DNA, 127 bp, Homo sapiens
agaaactacctgaaaaagaaatcaagaaaaatcccatttgcaataataaaaaatatcaggaataaatttagccaaggaggtgaaagatctatacactgaaaactataaagcattgatgaaaaaaaag

SEQ ID NO: 223614 - DNA, 404 bp, Homo sapiens
agtctgagagaattcctgcttcatggcctccgatgtcagctcttcctgggtctccagcctgcaggcttcagactggaacttcacagttggctccctgggcctcccgctggccgacacactctgcagatcttgggactcgtcaccctccatgcgcgagtgagccaatcccttgaaatctccttctctctacacgtgcacagcctattagtttctctggagactcctgacgaatacacaaaccagtgcaggtttgtagcccagcaaacccagtgtgctggagcagctcgtactggcttgcaagaaccaactgttaagtttttaggaatcttgtgtgccagttagaaaaaaaaaaaagatataaacttaaataattatattaccaacaaagataatacatattcaaa

SEQ ID NO: 223615 - DNA, 443 bp, Homo sapiens
caaaatttaccatttaaacatttttaaatgtgcaattcagtgactttcaatacattctaatgtgtttcagtacattctgttgttgtgcaaccattaccacttttcatcatcagaactttttcatcattacagattgaaactctgtacccattaaataattgaccccatttccgcctcccctagtccctataatgtaaaacttagagcatgaaacaaacatcattagatttatagatttgatttattatctaagatatttcacatggttcaaaattctaacctatggaagagtatacacattgaaaaatcccttttacctaagttctccctataggcgactgtatgtagtttttaatcttccctcagaaactgtgtgcatattcaggcaaattcattgttttaaaaagattgtaatataagcataaacattgttttgtactttc

SEQ ID NO: 223616 - DNA, 199 bp, Homo sapiens
ctgtctcaaaatatatatatatatgtgtgtgtgtatgtgtgtgtgtgtgtatgtgtgtctatatatgtgtgtatatatgtatatatgtgtgtgtatatatgtacatatacttatgcaaatacagctacattaaatgtaaatactgcaaggaaatatatcaaatgtaaaaagtgattatctcagagttattgaattatgg

SEQ ID NO: 223617 - DNA, 579 bp, Homo sapiens
tggctacctgaggaccccgatttgacgcgtctcatacgtgactgattttgtgtgtgtggtaaaggagagggaagcatcaggatgacttccagatactgtgtcttggagaattttagaaaatgccagtgccatttgaggagaagctgttttaaaaggaataattagtttgctgtttgaacatgctgaatttgagctggtaaaggatacccagaaagatgtgttctgtaggtatttggatctggaacttcaaaaaagggtttatagttaagaatcaagagtcatcaggattgaattgtttgaaaccgtggaagtagatatgataatctaggaattcaagaagaaaagtgtggtctggtgcgatggctcatgctgggattacaggcgtgagccaccgcgcccggcctcagaagattcttaaatgggtaattaatattaataatcagggaaagattatctggcaagtagaaggtgacgagattccagtaagaggtatcagtttgcagatattaaagtaatcaagccagaaatgacatgggcccaaagtctcaaactaagtgatgaaaactcaaaatggaaatt

SEQ ID NO: 223618 - DNA, 859 bp, Homo sapiens
ccgcgtaaacctcaccctaaccgcgtaaacctcaccctaaccgcgcccggcctcagaagattcttaaatgggtaattaatattaataatcagggaaagattatctggcaagtagaaggtgacaagattccagtaagaggtatcagtttgcagatattaaagtaatcaagccagaaatgacatgggcccaaagtctcaaactaagtgatgaaaaatcaaaatggaaattaggagacaaaaagatgtattagaaacaagatacgtgactgattttgtgtgtgtggtaaaggagagggaagcatcaggatgacttccagatactgtgtcttggagaattttagaaaatgccagtgccatttgaggagaagctgttttaaaaggaataattagtttgctgtttgaacatgctgaatttgagctggtaaaggatacccagaaagatgtgttctgtaggtatttggatctggaacttcaaaaaagggtttatagttaagaatcaagagtcatcaggattgaattgtttgaaaccgtggaagtagatatgataatctaggaattcaagaagaaaagtgtggtctggtgcgatggctcatgctggtaatcccagcactttgggaggctgaggtgggggtatcgcttgagcccaggagtttgaggcaagcttgggcaacatgatgaaaccctgtctctacaaaaaataacaaagattagccgggtgtggtgatgcatgcctgtagtcccagctactcaggaggctgaggtggaaggatcatctgagtctaggaaattggggctgcagtgagccatgatcactccactgcaccccagcctgggtgacagagggagaccctgtctcaaaa

SEQ ID NO: 223619 - DNA, 363 bp, Homo sapiens
gcagtgttcgaggttttaaagataaaactgtgtccctgctttactcgtttgctttcttaaacattgctgtggaagctcttcctccacactgcgcctccattcccaagtgttttctctgctcccctggctcactagtctgaccaaccttttgactgtttcttcccattccctggaaagctcttaattggctggctctttcttgccactcagtttcagcacccatctcaccctgccagggggccttcccaggggagcaagggcagacgtcattgtccgcacttgagaaaggaataatgtatccgccggaaaacaacccagatctcctgagtcacagcccagtgctccttctgcacagatattaaa

SEQ ID NO: 223620 - DNA, 473 bp, Homo sapiens
ccaccttggcctcccaaagggctggaattatgggcgtgagccactgcacctggccagaaatgatttttttaatccatatatctatcagtatataatatcaaagtgtagagacaaaatgaaaacaaaagagaggaggcaaaaataaaaacctattgggaatgaaaatgtgtgcattcccatgtctattggttgatgctggtgtgtagactgagattgtaggtaaggccgttgaacagaacacttcatgcaccctcttcatgtggcttgggatttctcaagggattctagcacctggctgcctgtgatttgccccacttgacagagagtggagcagagacgaaccatccatgtgccaccctcctttaactgcagattcacatgcaaagtagatgatgatgtcttaagccactaaatttggggattatttgtcatacaggagttgatggttggaatagatacctagggaaaatgtt

SEQ ID NO: 223621 - DNA, 294 bp, Homo sapiens
gcacgagaaaaaaatccctggttaacagggaaaagagctatgtaaatagtataatgtgaaaagagctttagtagagatatgagaacacagctattttcaagagcagtggaaaataaggttaaataagtagagtagaccccaaatgatagccctttgatagcaagcagagaagttcagattgggtgtggcagcattttagtgggtcctctgggttcttaggtggggagagagacacgaggaaaacagaaggccaggatgaaggttttggagtaatctacacacaaagtaagagca

SEQ ID NO: 223622 - DNA, 501 bp, Homo sapiens
gagattcaagcttactgggtttgccttgccactgggactatttgtagttttacaggtggacacttcctaagctgtgtgtcataatggataagatgtatatttcataaccagagacagctgggaacaaatctaggccctattatttaccaactgagtgaccttgaagatgacttaacctaagaatcaggttttttttttcatgtaaaataatggacaatcatctatctgatagggttctttgaagattacatggtgtattggttggaaacccaaggcttaataattactagctgttgttgttgttagtattattcagctatgattccattgcctgttatttttctccaacattttattatgaaaagtttgaaacatatggaaaagttaaaataattggacaatgaacactcatgaacctaacatctaaattcaataaataatattttattatatttgatttgtcacatatatattcacctatccatcacttcatctatcttt

SEQ ID NO: 223623 - DNA, 469 bp, Homo sapiens
cgggaaatatttgcccaataagggagagtttgtccccacactgcggcagaacccccctgcgagctctgaccccagcagcacggccaagcccccccaaccccgctcccccctttaggggacaggtatttgtaaataacaactgagctggtcgtcggtaggagaatcagattagaaacatggtccccactctcttcctatctccccagcactcatcacctcacaaagcagggggggacctgtttacttttcctggcgctctcccccaggctagaacgtgatcttcttcctacgcagggacagtgttttattcatctttgtacccactgccatctcatctggcttggaacaggctccggataaatattttttaaatatgtgcatgaattaatgagagactcgagatttagtccccaaactctctgacctccctcgagtgactttaagcctttagagcccttatctgttaaga

SEQ ID NO: 223624 - DNA, 584 bp, Homo sapiens
gggattgggaatatgagaccagagggagcttatccctccccctagttccaacccaggcagagcccggttgctgacaaggctcatagtacccctggaagacagcagctgagcacataaaaaaatatctgcatgaaagtgaggttggggacagattcagagtttcctgcagctcccaatggcatagcagtgaaagtcctcacatctgtagatggcacagatctgaggtccagatgaacaccagctacgatccgggctgactaaaaaccgaagaccaggtggaacgattttcctggagatttggcaaccctctcctgacctccatgtgtggcaataagaaaactgcactgagtttatattcaatcctgaggcaagtgtgagtttggattttggatcatctgggagatgtcttttcgcctgaaactgagctattaaactgagaccgagtcctccatctcttccctctccacctggatgggtcaactttcaaggaacttaattacttttgtaacagaacaaaggctacggaaaatgtctgtaaaatttggaacacaggctatgaaattagaatccaagctctctgcaaa

SEQ ID NO: 223625 - DNA, 430 bp, Homo sapiens
tgggcttcccccatcccttttccaacatccccagactctgggacttttagggtatggcttaccatggggttcctgaaatccccacaccaaggccctgggcatgtgggatttggtgtgtctctgaggagctgactggccagctcggaccttggcttcccagtgaggggccctagggaataaccagccaagcaggcttcagggatgtggggtccacagaacctttcgctgaggtcgtgtcctgccaccaactacctgctagcatcccctctcagggcctcggattctccacccgtccagcaggaagattaagaatcttcctcctggactgttgtgagacaaagccctccgttaagtgcaaagtccaatgtggaggaaaaggcacagacccttgtgggaacacgtttagcccagcaggcgcctctgggagccc

SEQ ID NO: 223626 - DNA, 624 bp, Homo sapiens
gcacgaggaaaaacactaggaattcttacaattcagtaaggggaagaagacatataatcaattgaaaaaataggcaagagacccgagcaggcactttatggaagaggatatacaaatgacaaaaaaatgtaaaacatatagtcaactttattaataattatggcaatgcaaattaaaaccatagtagaaaagatagctgggcacagactccagaaaaatgaggacaaactggaatgcagctgcacctccgaatcttcctttcactgtctctgaacaaagaaaaccagtaatgtgtaatgcctaagccttcatttccaccttccagatctcccgccactttacttttggcaaactttaaccaggaaccatgtaaggaagagtctaagtaatttggttcacagtataaacaagtaaacggttgaacaagccagcacaatgagagtctactacacattcatcatatttgctaaaatttataaaaactgatggtaccaaagatccaggctgtggaatggctggaattctcatacattgctggtggtagtataaattgatagaactttatttggaaacttttgcttctttaacgtattaagttaaatacatataacctaatatccagca

SEQ ID NO: 223627 - DNA, 704 bp, Homo sapiens
ggttattataacaaactttgatgagtaatgataacatagggtattgtgggtgcacagtggtggccagagtatagtgtaggatcaaggaagatctctgctcaaaagaggtgatggagatctctaacctctctgatagttaaacagagacccaaagggataagcaggaattagacaggtgatgggagagagggcaaaaggcttgtgccaggtgagagaatagcataatcaaaggctaagtggtaagactaatcttgaggcatgagaagaactggaagaagttcactatgactggaggaggaggaatagaatggtaagatgaggctggagtgctatggggtcagatagtagaaggccttaaaagccttgttaaaggatttggatttcatcctaacatctgcagaaaactattgttagactttttagtggattacagtgattgatttttgagtttttgaagaattactcttgatgtcatctgcagagtggattggagaacaagattggaggcatttaggaagctgttagcatagttagcaagacagctggaccagaatagtattaataggaaaggagcaaagtgggtagatttgagagaatagaagttcaattgatagcatcttggtaattgataccatgttgggaagagattgaagaagaagtcgagagtcatgtccagattttgggcatgaaccaagctgttcatg

SEQ ID NO: 223628 - DNA, 579 bp, Homo sapiens
tgctagagtatccacctcgggaacgtgttatccacctcttctaacgacaaggtagagccgagagggcaaaaggcttgtgccaggtgagagaatagcataatcaaaggctaagtggtaagactaatcttgaggcatgagaagaactggaagaagttcactatgactggaggaggaggaatagaatggtaagatgaggctggagtgctatggggtcagatagtagaaggccttaaaagccttgttaaaggatttggatttcatcctaacatctgcagaaaactattgttagactttttagtggattacagtgattgatttttgagtttttgaagaattactcttgatgtcatctgcagagtggattggagaacaagattggaggcatttaggaagctgttagcatagttagcaagacagctggaccagaatagtattaataggaaaggagcaaagtgggtagatttgagagaatagaagttcaattgatagcatcttggtaattgataccatgttgggaagagattgaagaagaagtcgagagtcatgtccagattttgggcatgaaccaagctgttcatg

SEQ ID NO: 223629 - DNA, 644 bp, Homo sapiens
ctgggggcctctctcaaggacgagattttgaaggttacgccggtgcagaagcagacccgtgctggccagagcaccaggttcaaagcgtttgttgctatcggggactacaacggccacgtcggtctgggtgttaagtgctccaaggaagtggccaccaccatccgtaaggccatcatcctggccaagctctccattgtccccgtgcacagaggctactgggggaacaagatcggcaagccccacaccgtcccttgcaaggtgacaggccgctgcggctctgtgctggtgtgcctcatccctgcacccaggggcactggcattgtctcggcgcctgtgcccaagaagctgctcatgatggctggtatcgatgactgctacacctcagcccggggctgcaatgccaccctgggcaacttcgccaaggccacctttgatgccatctctaagacctacagctacctgacccccgacctctggaaggatactgtattcaccaagtctccctatcaggagttcactgaccacctcgtcaagacccacaccagagtctccgtgcagcggactcaggctccagctgtggctacaacatagggtttttatacaagaaaaataaagtgaattaagcgctgttaaaaaaataaaaa

SEQ ID NO: 223630 - DNA, 374 bp, Homo sapiens
ttttctcttcttcctaggttctgcccacaggggagattgtgacctattgctggccccaacaccaagtcgaagttacacatttgccttggccttgccctgagaaggtgctgtgacatattgctgggcccagcaccaaggtgatgggactctcctctttctcctggaacctgtccacagtggggattgtgacatattgctgggcccagcaccactgtgatgtgactctcctctcgtgcctggggccagcccactggggtaattgtgacatataactggacctagcccctaggttatgtgacttacctctccttcctgagccctgcccacaagggggcctcatgacatatctctggacccctcacctaggtgatgtg

SEQ ID NO: 223631 - DNA, 288 bp, Homo sapiens
gcgacggagtctccctctgtcaccaggctggagtgcagtggcgcagtctcagctgactgcaccctccacctcccaggagaatcacttgaactcaggaggcagagattgcagtgagccaagaccgtgccattgcactccagcctgggcaacaagagcaaaactctgtctcaaacaaaaaaaaacaaacaaacaaaaaagaaaagtgacggcatttacatcctaaatctgaagaatctaattctgttggcagcttgtaccattgttgccattgaaaacccttctgattct

SEQ ID NO: 223632 - DNA, 393 bp, Homo sapiens
tattaacatttttatctttacaataaaatcccttcttcagtccaaaagagcccaacgttaagctgagtataaatgtttagacttaccaagcagatacataaggaaatactttttaacattttttcttccaggccaggtgtggtagctcacacctgtaatcccagggaaggccgaagtgtggggatccctgtgcccagcctgggcaacatgacaaagccctatctctacaaaaatgtacaaaaattagccaggcatcatggcctgcacctgtggtcccagctactagagaggctgaggtgggaggatagtttgagaccgggaggtctaggcttcagtgagtcgtgatcgcgccactgcactccagcctgtgtgacaaagtgaaaccccatcaca

SEQ ID NO: 223633 - DNA, 413 bp, Homo sapiens
tttcatactataaatatacagtcggtcctctgtatctgtgggatttacaggtgtttattgaaccaaatataaatcaaaaatattcagagaaaaaatccacaaagtttcaaaaagcaaaactatgttgaatggacacaaatgaagctgtgtgtaggctgtatcaggaattataaataatcaagggatgatttcatgtacacaggaggatgtgcatgggttatttgcaaatgctgtgccatttcatgtaagaggcttgagcgtctgcagattgtgctatctgagtggagatcctgaaaccaatcacccacgaatagtgagggatgactgtatataatttttatttctcaattttaaatataaaacataaaaaaattacaataacaagataaaataaacaagtgttttatagtgtg

SEQ ID NO: 223634 - DNA, 830 bp, Homo sapiens
taactctacagtgcggccctgggtccactggtccatattctgacagataattaagaaagcagcagctttttctagacggctcttcctcatgatttgcattttagccagaggcgaccagttataaaaaaaacatgatggaaagatggtaagaagccaattagatggatggatggctgactgacagctctctggtattacgactccagatttcagactacatagcctggcagttttctacaagaaccaacttttttgcagaaggtcatacatatgctattggagagttcacagctagcccctcactactcaaattgtgggtgttattgccagactgcggagatgcacaagaattgacttgagaagcaaggagattattcatgttcctgcacactctgttatctctgggagctcttaatcaatgcagggtgagagccagttagcatgactgaggttagggtaaacgggctgttcagggaaagataaattaaaatgtgattattattcaaattggaatatagagaacataatccatgatggaagagaaggagaataatagaaataaataaaaatttacctactgaatcacttgctctattgaatctagtccttgaaattccaaagacattataatatgctatgactaaagggaatgatttgggagatttatactctatctttattggctcctgcagatatgctgaaatacaaattctcacatgctggaaatgtctactaaatgtaccttgatatacaaattaaattctcctatagaaaactgtactgtactcaaaaacctatatacaaataaaaagactaaattctaaataaca

SEQ ID NO: 223635 - DNA, 423 bp, Homo sapiens
ctaaacaggtttcccacatggagaagcaaataccctataaaaggtatttctttatctttttggcaactggcctaaaaaaaaaatttattgttttatcaatataacgcctgtgctttattaggtttttggttacttacgaaaactgagctttaaaaggattaaggcttttacatccatgtaactttctgcattgcttttaagatcttttgattatcagtatggttaaataagtaacttcacagtggccagcaattttgttttgatcaaatgttttgaacctttgacatctctggcaggtttccccagagtcaagatcctaaattaaggctttccaatctaaaattaactttgagattttctttttctttttttttgagatgtagtttcactcttgttgctcaggctggagcgcaatggtgcgat

SEQ ID NO: 223636 - DNA, 540 bp, Homo sapiens
ttgtacttagcaattctcctgtttgctcagagcaccaggcttttcagaaggggatcgttttgtccctcctgattgaaaagatcacagaatgctttaattttgtgaagcgctttgccaacatattcattttcccctaaactcttactttatgaaatctttgcaaattgtttcacacgtacagtctctgagaatgtgaaaatgattcagaaaagggaaagcctcacttaaaactactggaaaatgcaaatgaaagggaacaaagggaacatggccccactgtgccccacagaatgtaataatatgcctctggcctcttatttcagcaatttccaagtttttgtgattttaaacaacgtcccagcaaaatcctcctaaatacattgttgcttccttcagttaatttattcaatacatatttattgagtgtcttctgccaggcataaatgccaggtgtgcactgctgaatctaataggctggagtcctgctttcctggggtttattgcctcttcccagtagtcagtctggtggggaagttaact

SEQ ID NO: 223637 - DNA, 586 bp, Homo sapiens
ttgtcactagaggatcccgcctaagtggaactgccggaattccctctaggagacaaattatagagaactggtcttttccaaccactgattggatttctgtaaacattgtcttgcagataatgcatttgttttgcattgaaagtttggttgtgtgtgtggtatttgggaattgctggaagacgtatccccagttaggaatacaacttgcaaagttcggtctagggcgtgtagtcagagctctgtgatctcccttgaaagggtgtgattgtgagtgtagtaggtgccactggaatttattttctttttcggagaagtgaagggaccttatgaactggagtaacacccagatctctgcagcagttaagctgggggcctagaactagactagagctagaagaagggacaaatgcaatccgacctttggatctacacattcctcttgcttcaatgggtgtcatttaagaattagaggaaaatattaggagatggagaactagagttgaggaaaccaaaagaagaggagtcacagaaaaccagctctctctgtgcaaggcatcttgaaaggggaattccagagtcaaagaca

SEQ ID NO: 223638 - DNA, 431 bp, Homo sapiens
gtgccttagaaaatcaaattgagtgcctttaaccaagaaataagcaataatttgttgaaaaattctatcaaaatgaaaagtatgcctctttagagtatttttaagctcacctctgcaaacactgttaaagaaaggaaatttaccccagcacaaaggtgaaaatcttggcacaaagggggaaactaacaatacatgttccctgaaaaatatttttaattggctttcaaataagtgtccttacagagatgagccttccctcctccttccctcctggtatactggtgaggcaggaagcacagtaacttggagcatgactttcagagcttgcagaacttgtgcacaaatccaagctctgtgctattcaacaagttacttgttttttctatagtatggtcatatctctctcacacaacattgctgtagtatctaaa

SEQ ID NO: 223639 - DNA, 435 bp, Homo sapiens
aaatagactggaaagagtcattgttcaccttccctcagcatccctggctttccaaccccctggcatcctcctctggtgacacacaggacctgtctcaggaggagaggtcaggcagaggatttactttcaggaagggcaacaaatgtagactttaagttatggacaggcagttatcgtattggtaagtatgttgattccattactctgttaagattgtgtaaccctgttttggcaattccttgcttcaattcttgggagcttcaaacaatggaagaagtccagacccttgtcaagaccccagtcttccttttttttaaacttttaatttttgtgggtacatagtaggtataggccccaggattcttaagtgggaaagtgaaaaaagccttcctggccagggcactccccagaaaaatcatacttcttaaggaaaaa

SEQ ID NO: 223640 - DNA, 507 bp, Homo sapiens
gccatgtgaagtagtgttatctatgtcacatagctttcttgataggcccaaatatagtaaagcctgcttttctgttgaagtctgtgaatatagagaaaacataaaaaggtgacacatgagtaaaattataaatattttatactttgtgggatgctagtgggaaaagcagactagggagtgaaatttgatacgtctaagctactcaaagataagtctgagaagcatgaaaacagtctttgttgcaatattgtaacattataaggaaaaacatcttggattgcagagaaatagaaagatgcagagaagtgggaaaaaaaagtagtgaagaagtagagggagagaagtgagctttcaataggactgaattgagtgtaaaccacttttgatccatttgaatcatgaacttcagaatatataattatcttcctttaaaggctgatgctacttcacaggtttttactgctgtaaggtgccattccaatgagaagtagacccagtagtcaaata

SEQ ID NO: 223641 - DNA, 560 bp, Homo sapiens
cagattttggggcagcacagagacaatcttaaagagcccaactaatatagaattatccaggaataaatggtaatatagcaaattgggcttttattgaatggttctcatttaaggctgttagcacatcaaacagtgatatgaaaaatgacatgccaatttgaccttgggaataaaagagtaagtgtaagcaacacttgtcacactgacagtcttggcagatagtgttttgatttgccagccgccctactccagacagtttcagaaagttccatgtgcctggaagacatttggacaaagcctaattcttccgtctttccctgtcttctatgtttttctatcaagcaggaatcaagacttacatttactccagtaatggggtcaacccaatgtactaatagactccataattccaggttggagtttgttgagatcagagtttcattatggcctttctcactggttctctgactggcaaaagcaaagccatgtctctgagcttggcccaagattcaaccaggtatgttcctcctcctctctgaggatcagcatctgagacctgt

SEQ ID NO: 223642 - DNA, 675 bp, Homo sapiens
ccagcacaagatccactactgccatgtattgcactaagtggaaactggtcaggttgtggggtcccaatcagcctgtgagcttcagaaggcaggcattgtgtctcatggacctagcccaaaacagaagtgtctatggaaatagtgcgatgacctgagtaaaatatgggtggaatgtgacataggcatttaagaaatctatatattgacatacaaaaaacagtttattaaaaggttgtgtaggtagaaggcaaaggctggaaattttaactttttccaaaataataattaacattttatattttagcaacaaaatgtggccgggtgtggtggctcacgcctgtaatcccggcactttgggaggccgaggcaggcggatcacgaggtcaggagatcaacaccatcctggccaccctggtgaaaccccatctctactaaaaatacaaaaattaccaggaaaaaatacggaacgcttcacgaatttgcatgtcatccctgcgcaggggccatgctaatcttctctgtatcgttccaattttagtatatgtgctgcgaaagtgagcacctgagaggccatttttatttaacttgagagatctcagaaaaatgccttttcctttagttttatatacctgacacaaaattgaaaaagctatctccagtcgggcctggtggctc

SEQ ID NO: 223643 - DNA, 419 bp, Homo sapiens
aaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgt

SEQ ID NO: 223644 - DNA, 262 bp, Homo sapiens
agtgtcttttccccttcaaaaaaggtgtagttgccacaccagccaagaaagcagatgtcactccaggcaaaaaggcagcagcaacacctgccaagaagacagttacaccagctgcgtttcacttccgagtgaaaccagctgagggtccaccttcatcaggaagtctgactttcatgacaccccggctctcattacccataccacccaccttctcatttagtcttttttttttttttttaaggtttgaggggaaaagacccgg

SEQ ID NO: 223645 - DNA, 502 bp, Homo sapiens
atatatatgtatatgttgatcagatgtaaatgtggaatgtaaatggagatcttttccttctcactgatcccatcaataccatttgaaacatacttataagcagtggtggtagatagtattaaggaaaaaatatctgtgtctgatttaaatcctcaggtggcagcttaaacgagctgcctcgtgtgtgtacacatagatatgtgtttgtatgtgtgtgagtttcagcagagatagagaacatcaggtgagcagccttgatttataattctggctatacatcctactgtacctctgtcaagggggtaatgagagaaaagatggaatcagtaacctaaagtttaggaataatcacatgttgcatgggctcctgcctgagtgtagagatggaatagtctgtacgtgtatgtgtgatcggtgacacccaggtttgctcaatgtcattttggctgctttgaacatcagaatcccttttaaaataaatgtttgcttattatgaaattga

SEQ ID NO: 223646 - DNA, 420 bp, Homo sapiens
gaacatgacaaggatccatcagcagctgaatggagaaacagaacgtgtccagccacaaaatggaaaattatttccagccttaaaaaggaaggaaatgttgatagacgcgcatggatgaaccttgagggcatcatgctaaaggcaagaagccagtcaggatagagattgtaggattctccctccgtgaggccctagagcagtcagattcccagagacagaaactagaatggtgggtgccacggctgagggagggagaagcggggagtgaggtctgctttggaaagatgaaaaagttctggagatggccagtggtgatagttgtacaacaatgtaaatgtacttaatgtcacagaactgtctgtttttaaatggttaaagtggtaaattttatgtgtattttaccaaacttttaaaaacaca

SEQ ID NO: 223647 - DNA, 424 bp, Homo sapiens
caacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgag

SEQ ID NO: 223648 - DNA, 509 bp, Homo sapiens
aaaaaaaaaaaaaaaagcatccaacccaaggccaggcagagaaggaaccagtggaatagaaacacagactcaatctcctccttctttactttcctgccagtgtctcccactggacaaccccaaccagaagttagaaggtgaaggaatgcagttgacacactccatagaagtcagcctcctggagcatacagctattggaaactggatctctagggacaaataggacatatctagaaaaaaaatgatggaggcctctaggaactgaggtcagcctctggccagcagcctgcaaggagctgaggcccagagttcaacagccctggggaaactgatgtgccaacagccacgtgagtttgtaagcagatcattccccagtcaagcctcagatgaaacacagtaccagctgacacttggaatctttatgagaccctgaggcacaggattcagctaagttgtgcccagattcctgacacaaactaagctaataagtgtgtgtaattttagccaaa

SEQ ID NO: 223649 - DNA, 255 bp, Homo sapiens
ctagtctatgtgtacatcccagcacggtaccttccctgggagttatttatgatgcagattcctttactcacatgttttcctgctgaccttctccccatcatcaccctgttcacgctgttctcctgccgcactccccgtatggagatagtgaaaatagtcatcaataaatactgagggaacccagagaccggtgccggtgcaggtcctcgcgtgctgagtgtgccggtcccctgggctcactgttctttctctgca

SEQ ID NO: 223650 - DNA, 339 bp, Homo sapiens
atataattttttttctaaagcagaaacaagaagctgggcaccatggtggtgcacacctgtagtccccactacttgagaggctggggtgggaggattccttgtgcccaggagtttaaagctgcagtaagctatgatcaagccactacactccacccacaccctgggtgacagggtgaaacacttgtctctaaaacaaaaaaagaaaagaaaaaggaaaaagaaaaaaaccagaaaatgaaaaacaagtaaatgagtagaattaatttgcatacattgcaggaaaccacaatgatagcttttactaaagatagaaacattctttctttggactaattcatt

SEQ ID NO: 223651 - DNA, 383 bp, Homo sapiens
gaatcctagactataaacaaacaagcaaacaaacaaacaagatatcagatattaattgaggacccactgttcagtcttgttgaaaacttggcacacatgcttgaggagtttaatagggatcttgtccagtagggcgatgaaagaacactattgtgtgattgtcagatttcttgaagtagtactgaattactactgttcactcttttccttagaagacatctcaatggttgaatagagagtcttaaggcagcgaggtgatccttgtcaaactatgagagtttcaatccttatgagtaatatagctctaataattttgccattcagcttatttacagagtaatctagagaggctacaccaacctggcatggtaaatgttgtcttc

SEQ ID NO: 223652 - DNA, 426 bp, Homo sapiens
tatttttaaagcttcaatttttgtactaagaaaatgtataaagaaaaaagcgagactggataaaccttcagctaagaaactaagactttgcatctgatttacttaagtattaattaaacatcaatttacttaaaagcacaaaacacaacttaattggcagtagtgaaactggggaaagatacaaaaccagactgttgtcttggtaggttatgtgaaattaattacagtgaatcactgggattatctgtacatttccatatatctgagtgatattacttcctgatagcattcaagtattaggacaacatcaaagctctgtaaacactcattaccctggtttaaatctacaatatgatgttgaaatggtggtccttgaacattttagttcacctaacactggtcattaatctactcagtctatgccca

SEQ ID NO: 223653 - DNA, 521 bp, Homo sapiens
ttctgcagccaagttcattgtcaagtctctggcacatggacttaagctgtgctcagttttggcagggtagttgtaacccggaactatggtcatttggttttaaaaacctgttgtaagcctgagcaccagtgtggagttggctaaaccccactccaagactggatggtagccttggagattaaatcctaaatactccaacaaatgctctgtgaactggaagcctcactggtccatagctaaagagaaggcaggaaagagccacgataaccatcagcccatgagggaggattcaggaagccaactaaggatccgggactactacgtcatttttaggaatttcaaatcaacagtcgcctcctctgggtgtggcacagcgccaggctccctggagaatgaatgagagtagctaattgcagttgctgtcagttctgggctgtgctgtccgggactgagccactagccacatgctgttatttaaatttaaatttaaatcaattaataaaatgtaaaagtcaactgct

SEQ ID NO: 223654 - DNA, 252 bp, Homo sapiens
agcaatcaataaatttacaggaaaggacatcttatgcactgggttacgttgtttagaaagccccagagcactgaacaggtaacaggaactttatcggatcaaagtacactgacttactgcactagttctttccaaatgctacttttatagtagtatctggaatcattctagctaacttccttcaaccagactctgtgagacagatcattctacctttttttttttttttttttggtgagatggagtctcgct

SEQ ID NO: 223655 - DNA, 1189 bp, Homo sapiens
catcaggaatctacaaaggtgttaaaagagctgataaatcttatatgacagtttggttctaaaagcagcacttaaggcaaaaaactgttcacagatggttaaattttttccataaagtagacacagtttgctgtgtacagccctgtacagtacgcacacacagtgcatacagagagcctgtacgtcatgcagtaaaccacgacagctacaaatcggtctgctcctgagaggctactgcatggctttccaatttgtgtgtattcataaattaggtgaggaatgtgactttttgactcaaaataggcaaaaggaagttgtaactgggtgtcaagagacaccagccctgagtgagcagcgcagactgagaacaggtccgagaatgactggagattctatcttgagagtgtctggcattgcctttcacaggagcgatgggcaagtgaaacttactacctggctttaggctcctggggtcctgaattatctacttcattgtaatgaaggcatcagaatgtaacttaatctcacaggagtggcatccctacttttggaaggccccctgatagaaactgtattcaaaaataccattccaaagtggagatctatgatttctcttctcatctctgtttggtgttgtccgatcttctgtaaataactgatcagtgcctcaaaattgtctttattctgtccttataccctccattaacctttcaatctctccccagcaatgtaagccatccctgcttacctgcccagctcccacagcttgtccctcgaacgcacctgcaggaggctgtgacccatgcagtggcaatgcggctagctgtgtccatggcctgtggaaatatgccagcccagcagaacagctggaatcctacactattaatatggttatgttttccaagcaagtactgctcaatttatacaagttaaatgcacatctgtgatttgatagcacagctgagaactgttataacatctaacaattaaatgacagtaacagtatatgacaaattaggggaaagaaccacaacttcaaaaggatagtttccttttaagaagaaactaacatgaaaaaagactgacatccaccccaaaaaacaggcaaataccacattaagtaatttaccaaaaacaagaaaagcaaatggataataaatatatggaaatattcaagctcacaatttat

SEQ ID NO: 223656 - DNA, 496 bp, Homo sapiens
atgcttgaaaagtatctaagttccaatttgcacatctgtaaaatgggtatggaacgtaccacataatactgtgaagaagatcagataaaacaataaataccaaacacacagtgcacgtcatgtggtaatcattcagtgcactttagatattattacatttgctactagattcctccttgtaaaacacaatacatatatatccattagagctcttatgaagatattattatggtcaatattaaatccagctaataccctgtgatctggtggtacagattttataagccatgaagtaagttatctaacaaacagcctttttaaaccaggttaaaaaatagctttataaaaataagtttttaataaatgaagatatatgtttttaatgttttaatttaacagtatattaagagatcaaacatattttgtctgacttgtaaatcctgtgaagttttgttgtagcacatttaaaaactattattaagaacaattattgttt

SEQ ID NO: 223657 - DNA, 511 bp, Homo sapiens
cagacacaattcttcgtgctcatgatcactgggatagaatacccactttttattgagcacctactagatgcccaaaactgtctgatcattttacatgtgttatctagtcattttgcaggcaccattattaacacacaaggagagagatactattctcatccacactttacagatgatataactggcactcactaaagttaagaaatttgttcagaatcccatagtttttaagagcggagctaagaattaaactgtcatctctcttcaacttcaacctcaaaatccaaaaatgacacaaacaccaataatggcatgtattagtgcatcattatgagatgagtatttgggaacaagtgaggagaacacttagtacttttcagggacacccacacactaccgactgcccgctcagattatcactttgcccggaaactcagaggtcccataatgatgggcaaatgagttggggtggtctcagaaccctgaaatgatcacatgcatcagaagtaca

SEQ ID NO: 223658 - DNA, 441 bp, Homo sapiens
ttatatcttatgagtctgttaggttaaaaaaaaaattatcctttttttgctatttctgttctcaatacttgaaaaatagaattttgtgtgcctcaatctaaaaggagaatcatcgagagaatctcattctgtactgcataagctacgaaagacttcaaaattccagaggaaaacagacaaaaactctttgcttattaatgtacacacctccattttcctaaagttgcataactagccgaattaggaaaatgctgtaaacattgcatcactgttgacattgaacattgcatagctagaaagaaaggcatatatgtaatttttttcgtttactatttcaatagtctgagtctcagtggcaaatgaaaatacaattgaatctcaagtgaatggccagaaacaccgtatattttatgaaatatggcagcataatgaataggaggt

SEQ ID NO: 223659 - DNA, 117 bp, Homo sapiens
catcgcaggtgctgtcctgtgcttaggttggacactgagcagcatctctggcctctaggtactcactagatgccaggagcactcccctcccttgagttgtgacaagcaaaaatgtct

SEQ ID NO: 223660 - DNA, 556 bp, Homo sapiens
cgacatcactgaggtacagccagttgcatttcactaggctcaagaggattgctgcctcaagcaggataaccaggcctgcctggaacagtgccatagtccgggatcccagtgacctgggtgagaagttgctattcaggtcaaagaaaatttcttcaggtgaccccactgtctctagccaatagtcctgcttgtggatcttacgtatttgtgtttcaaaactacctgaggtcctgatgtggggtccttacctcctgtgcacagtgactcatgcctgtaatttgagtactttgggagtgtagacagaaggaaaacttgaggccagaacttggacacccggctgggcaacaaagtgagactccatctctacaaagtaataataatatataaaactaaaaaattagcacagtccaatgtcacaggcctgtacttccagctactcgggagactgaggtaggaggtgcccatgaccccaggaagtcaaggttgtagtgagctatgattgtgccactgcactccagcctggatgtcacaggttgattccctgtctttaaaaaaa

SEQ ID NO: 223661 - DNA, 570 bp, Homo sapiens
cttatcatacccatcttggcagctccaaaactttgcatagcacccggcctaaaaactacagtatcatagtacacagtagaagttcaattagtatcaatggtatagaacatcactttccattttctcctctcctccttgatatgatgatcataaaatattagatttcgtgggaacttcagagattatctgctccattatactagtcaatgtagaaattctctgtcaagaaggttttattgtatattcgaacatctccagtggtgggatgctcactacctcttaatccagcatggtccatttcgaaccactcaatcttcaatgaaaaattcttctacattaagctgattattatctccctataacttttacttattggtcctatttctctctgctgcacacacacttggagttatccaaaataagtctgattgtcctccatatggccatcctgaagtacttgaaaacaactgtcatgtcccatttaatattcttttttctcaaattgggccattccatgctaaattagacttcaacggtttctcatataacaggctttctaggccattcctc

SEQ ID NO: 223662 - DNA, 434 bp, Homo sapiens
aagtacctagttctactgggcatgcctagattcccagctactcaggaggccgaaacaggaggatagcttgaacccagaagtttgaatccagcctgacaacatagtaagaccccatctcttaaaaaaaaaaagagtacctagttcttggcaaaaagtgttgggattacaggcgtgagccactgtgcctggcctctctctgcttctggccccttctttgggtccttcctcctttctctcttcatctctcttttgtttttgtttttgagacagggtcgcccaggctggaatgcagtagtgcgatcatagctcactgcagccccaaccttcccaggctgaggcaggagaatcacttgaacccgggaggtagaggctgcagtgagccgagatcacgccactgcactccagcctgggcaacagagtgagactccatctca

SEQ ID NO: 223663 - DNA, 438 bp, Homo sapiens
aacaggttgtcatgctcagagcagcagaagctgaggcgtaacagtgaaagccacgtgaatgtcatctgggaaaaacacggatggccaattcgtaattctttaaaagtcttaaaaaacatggcaccaggctgggcgcggtggctcacgcctgtaatcctagtgctttgggaggctaaggcaggcagatcaggaggtcaggagtttgagaccagcctggccaacatggtgaaaccccgtctctactaaaaatacaaaaattagccaggcgtggtggtgtatgcctgtaatcccagctactcaggaggctgaggcaggaaaattgcttgaacctgggaagtggagcttgcagtgagctgagatcacgccaccgcactccagcctggacaacagagcaaggctctgtctcttaaaaacaaacaaacaaacaaacaaacaaaa

SEQ ID NO: 223664 - DNA, 212 bp, Homo sapiens
gtgcagatactggcgtgagaatcgcagcacagtacatgcaggaagatgaccatctttcccagagcataaaccacagcaatgggtggcagggctgacagacccagctccaccctccccagtgccagcctactatccccagctgccccacctggcaacccttgaagagcagacttccctacctggcagcactaaaccagtttcaggggaaacag

SEQ ID NO: 223665 - DNA, 234 bp, Homo sapiens
cagcactcagaagaaaccagccctgctgacacttcgagttcagacttttagcttccagaactgtgagactatacggttttgttgtttaagacccccggtttgtagtactttgttacagcagtcctagccaatgaatacaggtatattatgaggactttagtcttttacttcttttttctttacaagttttttaaatagaaaagtagaagtaagaaaataaagcagaaaaaaatg

SEQ ID NO: 223666 - DNA, 289 bp, Homo sapiens
  misc_feature (216)..(216): n is a, c, g, or t
  misc_feature (223)..(223): n is a, c, g, or t
cagcactcagaagaaaccagccctgctgacacttcgagttcagacttttagcttccagaactgtgagactatacggttttgttgtttaagacccccggtttgtagtactttgttacagcagtcctagccaatgaatacaggtatattatgaggactttagtcttttacttcttttttctttacaagttttttaaatagggtagtacaagtcaaggnatagggnctgttcgcaaccagggctttttttttttttttttttctccccccccccccccccccccctcccccc

SEQ ID NO: 223667 - DNA, 395 bp, Homo sapiens
taatgggatgttgctgatttgtttcagggtctgaacttgctattagtaggaagctcttggtgaactttggttaggtgcacaggcaaataccaagtgccttgtttttctcataatatttctaagggagttttatttcccttatgtccctctaccaaatgctggtttgatccttattttttttggacaactttattgagatataatttatatattgtatacactagccatttagtactttactgttttttgagacacagtttcactctgtctcctacagccttgaccttccccagctgaggtgggaggatggcttgagcccgggagttcgaggctgcaatgagctataattgcactattacactctagcctaggcaacaaagcaagaccctgtctta

SEQ ID NO: 223668 - DNA, 782 bp, Homo sapiens
tagtatgtttgttgaaaagaattcagatagtactgaaatgcacaaagtaagtctcccatcactcttctgccagtccccctctcctcaggtaatcatcgttaacatttaggggcaatgctttcaccatttcttcttcctccatctggaaattgtggtaagcagaggtcagaaagagaagcctgttggagagtccctggccagtgcaggggggcatgtaaagatgtccctatgttcgctgtgttgaggaaaaagcccaaacgagccgtgcattggtggttctgattcatatggttctgtataggaagctatttggaagtaaagttttctgtaaaccatggtaattatttatcactgtctctcacaccaaggaattcttgatgcttgggagacagagaagccgtaaggccgtgttgcattcccatgagctccttttagcattgtgtttgttctgctgagttggtggcagatcactgtagaaagtgactatggatcagccgggcgtggtggctcacgcctgtaatcccagcactttgggaggccgaggcgggaggatcatgaggttaggagatcaagaccatcctggctaaccggctaacacggtgaaaccccatctctactaaaaatacaaaaaattagccgggcgtggtagtgagtgcctgcagtcccagttacttgggaggctgaggcaggagaatggcatgaacctgggaggtggaggttgcagtgagctcagatcgcatgactgcactccagcctgggtgacagagcgagactccgtctca

SEQ ID NO: 223669 - DNA, 853 bp, Homo sapiens
ctccccaagtactgggattacaggtgaaccactgctcccaacctttaatgacattttctgataaggtcttttataatatggcttcttctaacctttcggttttatgttccgtctcttcctcctcctctcctctaccctcttcctctcaccctcacccccaaacacacactcaaaataaagttccagccattctttatttccctaaactctggtaaagttagtgtatcttctccagcccttcacacatactgtttcctctgcttagaacacttcctctcccatttgatctgagttctcttcaggtcaaagcttagctatcatttcctctgggaaaacatttttgagcctgcaagtgtaaatgaggtattcctcctatgtgatgaacttccattattataatatttattaacctgcattacagatgcctgtcctatttactttatttaacagtaggctgtaatctctgtgagggtagggattgtattgccctatgtatgattgtaccccagaatgaaagaatgaatactagtactcatattatttcaacaaatttgtgtttctcataggttgaaggaactctgtgtgatacagagttgaacataagttcttttattcaggtaacttcaaatctaatggaggagaaataggttacctcataccttgccctactccacatgacctcttaatagtaggaacttcaaaccaaatggtatgatcatacctggtcaaaaccaagctgaaaataaaacctagaaatactgctggcctgtttctgaagcagctaaggattagactgtatcttctctttctcatattagtcaagagtaagctgtgataatgtatagccggggat

SEQ ID NO: 223670 - DNA, 683 bp, Homo sapiens
acttgtcttctgcgtcactcacgctgggagctgtagactggagctgttcctattcggccatcttggaacctcctctgcctatagttctttaaaaaaaaaaatttcaggcagggcatgttggctcatgcctgtaataccagtgtagcaggacaagctgcatacaaaacccctcagacaccgagttaaagaaggaagggctttattcagtcaggagctacagcaagactcacgtctccaaaaactgagctccccgagtgagcaattcctgtccttttaagggcttaaaactctaaacaggtccacgtgagggggtcgtgatcgattgagcaagcaggaggtacgtgactgagggctgcatgcaccagtaaacagaacggaacagaacaggacagagattttcacaatgcttttccataccatgtctggaatctatacataacataactggttaggtcatgagttgatctttaaccagacccagggtgcagcacagcccgtggatttaatttctgccttttagtttttacttctttctttggaggcagaaattgggcataagacaacatgaggggtggtctcctcccttaccagcactttggaaggctgaggcaggtggatcacctgaggtcaggagtttgagacgagcctggccgatatggtgaaactctgtctctactaaaaat

SEQ ID NO: 223671 - DNA, 501 bp, Homo sapiens
  misc_feature (53)..(53): n is a, c, g, or t
tagtactacccgcagaatggctctagtgcatccccaaacaccacatctggganaaggaaatagtacaatggaaagtctatccttggacctactatttgtcattccccatggcatgatggaatatctaaaataaaaagagttgctttggagaaggattgcaaaatattatttcatagaagagatttagaagaggggaaactcccaattacataaggtgggcattatagcttctcaaaacattggttccctatatgggtcatgaagattgatcccagtatcagcctatggcttactaggccagtttaactgaaagatttaatgagcttggaaggatgctgccacctgcactctcactttggcgggtgtttatcaccagtgagtgcggtccctaaaggagcaaaaggacaataagcacccagtggacaacagtgtggcattttgagtgaagatagcaactgaaaaggtcatcggcttggctagattgggctgggcttgtttttt

SEQ ID NO: 223672 - DNA, 1783 bp, Homo sapiens
gtgaaatggagtctcactcaggctggagtggcacgatcttagcccactgcaatctccgcctccgaggttccagcctccccagtagttgggattacaagtggcactaccacacccagctaattttcgtatttttagtagagatggggtttcaccatgttggccaggctggtcttgaactcctgacctcaagtgatctgcctgccttcggcctcccaaagtgctgggattacaggcgttagccactgtgcctgagtcaaatacattcctaatgaatccccaggagacctttgctcacatcttctgtcaccttatcctggctcttgcctcatttttcttttctagagtcatcctagggaatttcttgccctcactgaccttcctccatttctttccccaccttgatgagtttcagtaggtcttttttgctttctctcgtcctaagccatttgtctctaacaagtccccatctgaaagttttattgtgaatgagtgaatgaaaccttagagagtgttgcgagttacattcatgttgcccttggatataaaaagagaggcagatgcatttgcttttggggtcttagtcgtgaatcctttgcctaggccaatgtccagaaaagtttttcctggttatactgtagaaatgtcatggtttcgggtcttagatttaagtcattgttctattttgagttgatttttgtataaggtaagagagatggattcagtttcattcttctacatgtgggctatctacttttcccagcaccatttattaagtaggatgttgtttccccagtttatatttttgtgtgcttagttaacgatcagttggttgtaaatagttggctgtatttctgggttctctattctgttccattggtctatgtgtctacttttataccagtaccacgggtacactaaaatctcagacttcaccactatacaattcatccatgtaaccaaaaaccacttttaccccaaaagttactgaaataagtatttttaaagattttaaaaaatagagaggaaagaggaggctatgaaattccataatggagttacagatgcttgacataatttagtggatattggatttagacttacatgaatgaggcaaacctgagatctgtgatatttgtaaatgaagataggagtgaacttactgcccttaggagtggagggagggaaggaagggagaaaatgagagatgccataaaatctattacttcaatggatttgaagtaatcctttgaagcaggcagtgagacttacttcataaatccatacctttttaatgtggattggagagaagttgttgcgctgtaatacctctgttgctactgtgagagtcattgccagccactattctcatgtcaagctgcccttgaggaggtttctcttgacccaatttagaaacaaccaaaacaaggtttgtaacttagaggaattcttgattctgtgacaaggggtctgtgaccctcttaaagggatcaagtacacaggagaatagtaccaagtaggtactaaaataagccaggtttaacaaatggcctagggacgatgagaccggaccgggcccaatgggtccaaggctccccaaaaccccattctggcttaggaactggtccagggaagctatccgggaccaatattgtcctccctggctgaggaactcacacaaagagctgctttgcgaaggggccatttccgaagaattcaggggaacccctcacgggggagtccaggcctgtggaacaccatctgattggcaaaaggggccacacgg

SEQ ID NO: 223673 - DNA, 1544 bp, Homo sapiens
gtgaaatggagtctcactcaggctggagtggcacgatcttagcccactgcaatctccgcctccgaggttccagcctccccagtagttgggattacaagtggcactaccacacccagctaattttcgtatttttagtagagatggggtttcaccatgttggccaggctggtcttgaactcctgacctcaagtgatctgcctgccttcggcctcccaaagtgctgggattacaggcgttagccactgtgcctgagtcaaatacattcctaatgaatccccaggagacctttgctcacatcttctgtcaccttatcctggctcttgcctcatttttcttttctagagtcatcctagggaatttcttgccctcactgaccttcctccatttctttccccaccttgatgagtttcagtaggtcttttttgctttctctcgtcctaagccatttgtctctaacaagtccccatctgaaagttttattgtgaatgagtgaatgaaaccttagagagtgttgcgagttacattcatgttgcccttggatataaaaagagaggcagatgcatttgcttttggggtcttagtcgtgaatcctttgcctaggccaatgtccagaaaagtttttcctggttatactgtagaaatgtcatggtttcgggtcttagatttaagtcattgttctattttgagttgatttttgtataaggtaagagagatggattcagtttcattcttctacatgtgggctatctacttttcccagcaccatttattaagtaggatgttgtttccccagtttatatttttgtgtgcttagttaacgatcagttggttgtaaatagttggctgtatttctgggttctctattctgttccattggtctatgtgtctacttttataccagtaccacgggtacactaaaatctcagacttcaccactatacaattcatccatgtaaccaaaaaccacttttaccccaaaagttactgaaataagtatttttaaagattttaaaaaatagagaggaaagaggaggctatgaaattccataatggagttacagatgcttgacataatttagtggatattggatttagaaaggaaatagtacaatggaaagtctatccttggacctactatttgtcattccccatggcatgatggaatatctaaaataaaaagagttgctttggagaaggattgcaaaatattatttcatagaagagatttagaagaggggaaactcccaattacataaggtgggcattatagcttctcaaaacattggttccctatatgggtcatgaagattgatcccagtatcagcctatggcttactaggccagtttaactgaaagatttaatgagcttggaaggatgctgccacctgcactctcactttggcgggtgtttatcaccagtgagtgcggtccctaaaggagcaaaaggacaataagcacccagtggacaacagtgtggcattttgagtgaagatagcaactgaaaaggtcatcggcttggctagattgggctgggcttgtttttt

SEQ ID NO: 223674 - DNA, 303 bp, Homo sapiens
caacctctgcctcctgagttcaagcaattctactgcctcagtctctcaagtagctgggactataagcacatggcaccacacccagctaattttcgtatttttagtagagatggggtttcaccatgttggccaggctggtcttgaactcctgacctcaagtgatctgcctgccttcggcctcccaaagtgctgggattacaggcgttagccactgtgcctgagtcaaatacattcctaatgaatccccaggagacctttgctcacatcttctgtcaccttatcctggctcttgcctcatttttc

SEQ ID NO: 223675 - DNA, 126 bp, Homo sapiens
aaccacatatcattgtggagttttatttttaacttcttcagccagctgagttttatgcaccagcttcttttctttggtttatacattgtaccacctgaaaaaccagcggtaatatctatgctgctg

SEQ ID NO: 223676 - DNA, 268 bp, Homo sapiens
gccaagattgtgccactgcactccagcctgccaacagaatgagattctgtctaaaaaaaaaaagaaagaaagaaagaaagaaaaagaattcctgttgcaaaaactgaacaaaatcccacagggacatgtgcagtaataccagctaccacgtgttgacagcttatatgccaggcgctgtgcttaacaccttatgtatgttatctcacttaatcctcccaacatctctttgaggtagatactattattatccccattttacagatgagga

SEQ ID NO: 223677 - DNA, 545 bp, Homo sapiens
tttataaaataattacatattattttgaataacttcacagaatcagtggcaagcagagacttcttcaaaaacatttggaatacggaagtagagattgatgggctttgctttagtctctgaaataatcatatttttctgaaatggatggttaaatttatcatattgttctagacacttggagtgtaataatgaacaagagagaaaattgcctgcccttgtggagcttacattctaatgtcacacacactttgtgcattttagattgttaggggaggagattttttaatgaaactttaaaacctagctgctttcttgtcttaggaactacagtttgaaagagcctacagaagtttgagaaggaggaaggtgtttaccagttggcagtgataggaaagaaagatcttagtttatttcttatttgtaccttttgttattgtcatgaaactttctccatatatttcagttggtaattttaacagatagggatttttttcatgattttaataatgtctttgaaattaataaaacgttgctttatattaaaa

SEQ ID NO: 223678 - DNA, 450 bp, Homo sapiens
agataaggttcatcaggcccttccagctccccaggctccctgaagtcctgggtctaggccaggcattgtccccctgcttcctggaaaccctcattttccttgtctgtaatatgaagtcagcattggccccgccccccaccccctaccatctcccaatggaggggaggttgcaggggagagctgccgccagcccactcctgaggcaccaccacagtcagcatcgacaggggcacagcagtggcagtttgggacctccctgtgcctctcagcactcccttccccacccccatagcccaaggacaaggctaccacagaaggttaccacaggacctgggcttcgtctccaggggacaaggagacactgtcagcctggtgttcaccaggcctggtagatgagatggcttgtctcatccacaccacagaaggaaataaaccatgtggcttaaattt

SEQ ID NO: 223679 - DNA, 199 bp, Homo sapiens
aataatgatataaaattgaatactattcaatagtaaaaagaaatgaaacactgaatccgattatctcaatcaatcaacatggccagatctcaaaaaaagacagtgaaaaaattacagaatgacacatggcacaataccatgaaaatgatactacaaatgtaatttttagaatacatacatttagaaaaagaaaaaatat

SEQ ID NO: 223680 - DNA, 485 bp, Homo sapiens
tgtagaaatgggatctagctatgttgcccaggctgctcttgaactcctgggctcaagccatcttcttgcctcagcctcccaaagtgctgggattacgggcgtgagccaccacgcctggcatgttttttcttcagcagaggaaaaaaatcataatgtatcaggctctgaagccccagatcccggggatgggagtcctgggcggccagaggagagttttagccgtaacctggcgattgcaacgtgcctccggaggcagggaaagggcccaggttggcaccgtggggagaggtggggtctggggaggacctggcagccagccccacttaacgacattcagttaagcagaatatggaaaataaacctgtgagggccaaacaaaatttttttggagacagagcctcactgtatcgcccaggctggagtgcagtagcgtgatcatggctcactgcagcctcaacctcctgggctcaagagatcctcctgcc

SEQ ID NO: 223681 - DNA, 465 bp, Homo sapiens
actggactgtcagccacgccctttcaaccagaggcttcaccatccaaaaagatccaggacgacaaagtcattctcgctgccagtcctcttgttgatttcatcctcatacctgtcaggcgaggcaaaggagcacagaaaggctgcaggctgaccttggctccctgaggtccctccttacagcagaaagcttggaattccccaaacatttgctgtcctgggttcagagaaccctgctcaaggtgctggctgtccattcccagaggctggcactctcatggatgagggcagagccaactcctaggtctgtgggccaacagaggggaccccgggccaacatggaaaacccagagccacagagaaggtccctggaatgtctatttttattttgatgttttacctttgtaaatgtgtcaaactcattcattccttaaaactgagaacatgaaataacaaccacttttacta

SEQ ID NO: 223682 - DNA, 392 bp, Homo sapiens
aaacaaggtaagcttataaaagattagaatggggcttccttgcatagcaattgcttaattagcattcgttgtaatcaataactatttcttgtttatgtaatctatgttcaacactccatgtttgccttatgaatagttctcatttatccattcttcaggctttatacaatccattcttaggcagagaatgtgtccattatgggtcagagttagcctgcttaaaagccctagaacggggctgggcactgtggctcatgcctgtaatcccagcactttgggaagccaaggtgggtggatcacgaggtcaagagatcaagaccatgctggccaatgtggtgaaaccccatctctactaaaaatacaaaaattcactaggtgtggtggtatgcacc

SEQ ID NO: 223683 - DNA, 521 bp, Homo sapiens
agaaaggaacagcactatggatcaggtaattgttaggcatttttatcagtttgaaacaatttacatatctaacagaattttatagaggtgtctaaaaaatttatactcagggatgctacaataataaagttttcagaagcagcattagctttttaccccttttcatcaagatgtgaacagtctacattttctggaagtagccataagaagcaattagaagatgaaaatatccctcctatgttgataggattttggcttgctgccaagattcccaacagtgaattgacagcgttcttctttcctttggaattctgattttcattgctctcttgctggtctcaattttgacagcagaataatgagtaatagaaaagtttcattaattctgaaaagagatgtcttgtcatttgacaattctcagagaacattcttacgataagaagttggcacgtaactgaggaaaaagctcaatttgtataggctaggggatgtgatcaccagaaagatgtgggtggtaacag

SEQ ID NO: 223684 - DNA, 677 bp, Homo sapiens
gagtggcagcagagtgcagagtgctgcccaagggagtggtttgttgaatttcttaatttgtgtattctactgacagtgccagccattggtttttagtaaatgagacacttgcttcctaagagctgtctttataatcataggtgccactggtcaggaggtcttgtactacttcaacctgctatcagatagtcattctgtacattctaattcctgtacctctttgcatctgccaacttctttccttccccactgcttttggttcaggcccccgttcatttccttcctggatattgtataatactagtctcctagccaggtctacatcgcagccatatgaggatcaagctgatctttgtaaacacagaactagccctgtcacttctccttttcaaaacctgtgagtgcccccatccttggcgttgcatactatccggtcattttctgggccagcctgcctttccaacctacttccccctcctctgttcttgcacacaccacctggccatcagtgcctaattacagacatttccccaggttctctgtaatcgtttctttcaatattctattcctcttttgggtcagcttctctcccctggtccacttgggtacttctttaaagaatcacttccagaaaattcttcctggctcatccaaactattaatacttccatctcttg

SEQ ID NO: 223685 - DNA, 488 bp, Homo sapiens
aggctagtgctacattcgtcatggaaaacaacttaaaaattataaaacatggtaatgctttgaatgactgtcttagtttgctggggctgcagtaataaagtgccagagactgggtgacttaatcccaaaaatatgtttcacagttctggaggttggaagttgagaacaaggtgccggcagggtttgttcctttggaggcctctctcctgggcttgctgacagctgccttcttgctatcttcacctggtcttccttctgtgtgtgtctgtgtcttaatctcctcttgtaaagacaccagtcgtattggattggggcccatccatatgatctacttttatcttaatgacctctttaagggccctatcttcaaatatactcacactctaaggtattgggagcaaggacttcaacacatgaatttgaggagatgcaattcagcccccactacatgaatcaaatatttatttcccaattttatttgttacatc

SEQ ID NO: 223686 - DNA, 755 bp, Homo sapiens
cagacaatttgagtgtttttaaaatagtctcataaaaaatatacctttgactgggtgcagtggctcatgcatgtcctcccaaagcggaggccttacaagcattagccaccgcgctcagccgactggatagaatttgagactactgtgcaccaaatactgttctaggcagtagggatacagtaaggaaaaaagacaagaagatccacttaccctcatgctactttttagcagcaagagagagagaatttatttacaaataaatagaatgtgtagtatgtcaactgaccataggtgctaaggagaaaaagcaaataagggagatataaatacaagagaaggggtttgtattttaaataggagagtcagggatggcatcgcagagaagacagcatttgaataaaacctgaaggaagtgaagggatataatggcactgtgcaaaatgattacagaatgcacttctgctatagttaagtcatccagtccatccatctggctgtacctcttcttagattctggactgcatctgaataaataataatttgcccttttctgtgaattggcagaaaattttgctactttggcacaagagactacttggttttagtttaaaataaattattctgaatcaggctttaatttggatttgcttagaaaatagttttcttaggtctgtatgatgcatttacattttgaacacttcaaatattaattagacctaaatctgcctttaaaacattcaacatctagaaggaaa

SEQ ID NO: 223687 - DNA, 433 bp, Homo sapiens
tctgctctcatacttatgggagatagaggagtacaaagaagaaaaaggggaaaaagaaagcagaaaaactgcgtggcaccatacccgactcctctctactgctgttagacaagtatagtaaaaatagttgccacttttgacacattattgccacacagtggtttcttaccctaacttaactggaggaagctgagacttaaagaggataacaaaggcctgtttttcactgttggaagaaacttgaaaaaatacaaataacaaaaatctgtggaatatttagagcagaccaaatgtaaagagctctcctaccccatactggttggatggactaaatatttcaataatttgagagataatatatttcatttatttacctgtaatcttttagcaaaacaataaagattaaatggaattaaaactgtttttaatttaa

SEQ ID NO: 223688 - DNA, 602 bp, Homo sapiens
gtgactttgggaagattatttaccatctctgagccttgggtccttcatggacagcatggaagtaattatattaggattaaacaagatgatgtttataaaaacttagtactgcacttggcacctaacagcactcaataaatgacagctatagtaggttacatcgtactcggcattattgacatttggggctagataaccgttgtgcagggccatcttgtgtgttataggaagtctggtagcattcctggcctctacccattagatgccagtagcaaactccacccaccccgcaagttgtgacaatcaaaaccatctccaagcattgacaaatgtctcctagagtcaaaatcacctctagttgagaaacctgacctagaaaagtcccactgaactttaaaacttcaggtcaaatatcacctcctctgtgaagccttccctgacctactaagcacaattgctttgtactccagattacatcacaggggtcagatcctgacatgctgtgtgtccttggtcacgtcactttgcttctctaaggctccttctctaaggttcatctataacaagaggatatgatgttcctgggaaggatgttgtaaggg

SEQ ID NO: 223689 - DNA, 405 bp, Homo sapiens
ccaatccttacaatgactagtagaagtcctattgtaagagaatccctaacattaacaaatgtgtctgcaaaagaaactgtacaatgaatacaaagtcattaagtggaataaataatcaatttctttgtctttaatggctttttatatgaaaactgccgtaatggcaatactgaggtaaattttacatgcataaacatagtgccttctactaaaaaaacctattatgataaaacaatactgaagtgtcagagttggtaactgttttagggctcaagtcttgtcacgaaaagtactattcatatatcaacactaaagaaaaagtgaagaaaatggtttggaaaactgagttctcagtccggctagaccctgttgttccaatttgcttgtgccttggtttttctgtta

SEQ ID NO: 223690 - DNA, 439 bp, Homo sapiens
atgtgtagctagaagccaatcaaatgagatggagaatgtctgccaagaaatgatgaatctgattttggaattaatcacttgtaggcctatctgatagtagttagcaaggccattcgtttagcccaaaacaatctccaggacatgggaagaaaatactattatcttaccctttaaagtttctagggattttgtgtatatttcataatgaatacaaaatattttgccagtaacacatgtattagtttttaaatacattacctatgttagaaatgtaactcattcttttccccaatgctatgtgtgatttttaaaagttttgaggccaaatgcagtggctcatgcctaattctagcactttgagaggccaagatggaagaatcacctgaagccaggagtttgaaaccaagctgtgcaacaaagcaagaccctgtctctacaa

SEQ ID NO: 223691 - DNA, 439 bp, Homo sapiens
agccccagactccagtggtctaaggcttactcctgtgcaggttaccttccatttgcacccccatctccactttccacctttctctaccatgtttctgtaggagaaggctgagctatccatatatttagcagactcccatgggcccggacttctgtttgagttgaacaataaagagccaagcaggacatgagaaagagggaggagaatgagatcgatgtatttctcttactggcttttgccatgagaagtaatcatgggctaacaccttaacaaaaggtctccattcaactctctccatctgggcttcaggaagtcctccctcctttcctgtcttaggaccctctgctgaagcttctcccatttactagccccagcttgctatatcttcatgatttctttatatcttgagtatagttttgtcaataatcctttttgtaaa

SEQ ID NO: 223692 - DNA, 607 bp, Homo sapiens
attcataaagcccagtgaatccaagaaggggaaataaaattctagacacaacataattcaattgataaatgccgtaaacaaagaatatatatatatatacacacacacacatatgtatttagacagagtctcgctgtgtcacccaggctggagtgcagtggcccaatcttggctcactgcaaactccgcctcccgggttcacaacattctcctgcctcagcctcccatgtagctgggcctacagttgcccgccaccacacctggctaattttttgtatttttagtagagacggggtttcaccgtattagccaggaaggtctcgatctcctgacctcatgatccacccgcctcggactcccaaagtgctgggattacaggtgtgagccaccacacctggccaaagaaaatattttttaaaatatctagtgataaaagatgggttatctttcaaaaggatgtatttccgaagaataacaatagaaaatggcctctgtcggtgatgcactcatctctaagttttctggaaggatggggagggcaggagcctggctcgggaggactctcactagacccagctgggagtggggctctgtgtctaagccaagg

SEQ ID NO: 223693 - DNA, 2761 bp, Homo sapiens
  misc_feature (4)..(4): n is a, c, g, or t
  misc_feature (6)..(8): n is a, c, g, or t
ggcncnnnagctgtggtgatgggtagctaggaggcctgggcctctctgcctgctgtagccgtctgccgcgcccttgttcctgcagctgtccagttatcttttgactgccacatatggaccccaaaagatctcaaaaggaaagtgtcctcattacaggaggaagtggctattttggttttcgcctgggctgtgccctgaaccaaaatggagtccatgtgattctgtttgacatcagcagccctgctcaaaccattccagaaggaatcaagtttatacaaggagacatccgccacctgtctgacgtagagaaagccttccaggatgcagacgtcacttgtgtgttccatattgcctcttatggtatgtcagggcgggagcaactcaatcgaaacctgatcaaagaagtcaacgtcaggggcacagacaacatcctccaggtttgccaaaggagaagggtgcccaggttagtttacaccagcactttcaatgtcatctttggaggtcaagttatcagaaatggggatgaatctctgccctacctgcctcttcacctccaccctgatcactactctcggacaaagtcaattgcagagcagaaggtgctggaggcgaatgctacacccctggacagaggcgacggtgtcttaagaacctgcgctctgaggccagctggcatctatgggcctggagaacaaagacaccttcccaggatagtcagctacatcgagaagggtctgttcaagtttgtctacggggaccccaggagcctggttgagtttgtccacgtggataacttggtgcaggctcacattctggcctcagaagccctgagagctgacaagggccatattgcctctgggcagccctacttcatctcagatggcagacccgtgaacaactttgagttcttccggcctctggttgagggcctgggctacacattcccgtctacccgcctgccattgaccttggtctactgctttgcttttctaacagagatggttcacttcattttgggtcgactctacaacttccagcccttcctcactcgcactgaagtttacaaaactggtgtcacacattattttagcttagagaaagccaagaaagagctaggttataaggctcagccatttgacctccaggaagcagtggaatggtttaaagcccatggtcatggcagaagttctggaagtcgtgactcggagtgttttgtttgggatgggctattggtcttcctcctgattatagcagttctcatgtggctgccttcttctgtgattctgtcactgtgaaggaggggccagaaataaggtgatcacagttggctgagatggttctcaagaaacatgggttttaaaatgtgtacagtgatatctggtgccaaacattggctcttcaaattgctacttaagaataggttcttggattgaatctttatgtcttatttccttgcactaatccagatgggaatgaaaaagcagaagcagagattagtttgaaatttgatttgttatgtgcttctgttttaggtgggtacaatagaagtcagtttggagccatagaagtaggcttagttgagttggagatgcccatcttgaatttctgagagggcaagatatacttatttccattttatgcagtctgcatctacctaaaacctctgactgatgtgggaatggcgaaacactatcaggcttgaatgcgtgtgaaaaacaccaaattggcccagatccctaacagagcaatcctcgaggggatggtggctattgctggagaggcattagctattcacagggtacgttttaggtgttaacttttgccctttatgatatcagggcattatgcctatgtgaacacatggtaatgtttgatgtttaggcctttattctacctcataggattcttttgaggattaaattcaagcatacaaagcgctcctcaacacacatagccattctttttatcagaattgtcatggtacattccttatgagggctttcttcctcagtgttctctttagagggctattgctactggactttctgcaatgtcttttgggtgtgccctcagagcctgcaacaagtgtatttggatatactctatttgtaaagtttaggcctctaagaaggccacaatgaagcaactaaaaatctgatgattaagggagtcaatcaagctgatgccatttttagtttaaaaatgaagcagagctctaaactcatagatgggttttcttactgggaagaagattggctctctgaagacagcttccaatgaggaatgtattgaacaatggcagcactgtctggccacccacaaactgttacagatgatccagttacactgttgcataggaacccaagtggaaagaagacagagtccatgtctgtccatggctccagctacagaaaggatagtatgggaacattacaagggggatacattactgtggaaagttctgctagagttagtcttgagagtatctgtaaaatacaaatagatgagcaatccctgtggaatgctgcctggatattttcagaaaagctctgaacttgatgtcataataccaacaccgtgaatatcgtgtgtggccttaaccaaggaacagaagccctttagaacttagcttcctcacttgggagctgggactgactgcatttgccctttgtataaacccacccaccccatagggttcactgggagcataaagcaagatgtggtgaaagtacttctaatataaattgcaacatcagtatga

SEQ ID NO: 223694 - DNA, 2989 bp, Homo sapiens
  misc_feature (4)..(4): n is a, c, g, or t
  misc_feature (6)..(8): n is a, c, g, or t
ggcncnnnagctgtggtgatgggtagctaggaggcctgggcctctctgcctgctgtagccgtctgccgcgcccttgttcctgcagctggcggaggaaacagaggttcagtgaattgcctagggtaacacagggaattggtggaagagccaagtctaatgcccagatttccaaactgggagtcttaacccttcatcagtgctacctgtgccacatgggagaagatgggccacctccaattcattttctctgggaactgcaggaaccacaatgaggttgcagaatgtgttaacagtgaaagccctcacaggactcaggtccagttatcttttgactgccacatatggaccccaaaagatctcaaaaggaaagtgtcctcattacaggaggaagtggctattttggttttcgcctgggctgtgccctgaaccaaaatggagtccatgtgattctgtttgacatcagcagccctgctcaaaccattccagaaggaatcaagtttatacaaggagacatccgccacctgtctgacgtagagaaagccttccaggatgcagacgtcacttgtgtgttccatattgcctcttatggtatgtcagggcgggagcaactcaatcgaaacctgatcaaagaagtcaacgtcaggggcacagacaacatcctccaggtttgccaaaggagaagggtgcccaggttagtttacaccagcactttcaatgtcatctttggaggtcaagttatcagaaatggggatgaatctctgccctacctgcctcttcacctccaccctgatcactactctcggacaaagtcaattgcagagcagaaggtgctggaggcgaatgctacacccctggacagaggcgacggtgtcttaagaacctgcgctctgaggccagctggcatctatgggcctggagaacaaagacaccttcccaggatagtcagctacatcgagaagggtctgttcaagtttgtctacggggaccccaggagcctggttgagtttgtccacgtggataacttggtgcaggctcacattctggcctcagaagccctgagagctgacaagggccatattgcctctgggcagccctacttcatctcagatggcagacccgtgaacaactttgagttcttccggcctctggttgagggcctgggctacacattcccgtctacccgcctgccattgaccttggtctactgctttgcttttctaacagagatggttcacttcattttgggtcgactctacaacttccagcccttcctcactcgcactgaagtttacaaaactggtgtcacacattattttagcttagagaaagccaagaaagagctaggttataaggctcagccatttgacctccaggaagcagtggaatggtttaaagcccatggtcatggcagaagttctggaagtcgtgactcggagtgttttgtttgggatgggctattggtcttcctcctgattatagcagttctcatgtggctgccttcttctgtgattctgtcactgtgaaggaggggccagaaataaggtgatcacagttggctgagatggttctcaagaaacatgggttttaaaatgtgtacagtgatatctggtgccaaacattggctcttcaaattgctacttaagaataggttcttggattgaatctttatgtcttatttccttgcactaatccagatgggaatgaaaaagcagaagcagagattagtttgaaatttgatttgttatgtgcttctgttttaggtgggtacaatagaagtcagtttggagccatagaagtaggcttagttgagttggagatgcccatcttgaatttctgagagggcaagatatacttatttccattttatgcagtctgcatctacctaaaacctctgactgatgtgggaatggcgaaacactatcaggcttgaatgcgtgtgaaaaacaccaaattggcccagatccctaacagagcaatcctcgaggggatggtggctattgctggagaggcattagctattcacagggtacgttttaggtgttaacttttgccctttatgatatcagggcattatgcctatgtgaacacatggtaatgtttgatgtttaggcctttattctacctcataggattcttttgaggattaaattcaagcatacaaagcgctcctcaacacacatagccattctttttatcagaattgtcatggtacattccttatgagggctttcttcctcagtgttctctttagagggctattgctactggactttctgcaatgtcttttgggtgtgccctcagagcctgcaacaagtgtatttggatatactctatttgtaaagtttaggcctctaagaaggccacaatgaagcaactaaaaatctgatgattaagggagtcaatcaagctgatgccatttttagtttaaaaatgaagcagagctctaaactcatagatgggttttcttactgggaagaagattggctctctgaagacagcttccaatgaggaatgtattgaacaatggcagcactgtctggccacccacaaactgttacagatgatccagttacactgttgcataggaacccaagtggaaagaagacagagtccatgtctgtccatggctccagctacagaaaggatagtatgggaacattacaagggggatacattactgtggaaagttctgctagagttagtcttgagagtatctgtaaaatacaaatagatgagcaatccctgtggaatgctgcctggatattttcagaaaagctctgaacttgatgtcataataccaacaccgtgaatatcgtgtgtggccttaaccaaggaacagaagccctttagaacttagcttcctcacttgggagctgggactgactgcatttgccctttgtataaacccacccaccccatagggttcactgggagcataaagcaagatgtggtgaaagtacttctaatataaattgcaacatcagtatga

SEQ ID NO: 223695 - DNA, 205 bp, Homo sapiens
ctggttatttttattttattttattttattttttgtatttttagtagagatggggtttccccatgttggccaggcgtggtggcaggtgcctgtggcaggagggaaaaaggggctcaggagagttgggctagcaactacttataccttagtgtacattcatttaatcagttttccttccttccttacctaagatggactaactgcc

SEQ ID NO: 223696 - DNA, 121 bp, Homo sapiens
ttcataaccaaaaaacacatactatatagagcagacagcatttgacttcactgaaagcaaacagtatcccttaaagttaaggcaaggccaggtgtggtggctcatacctagaatcccagca

SEQ ID NO: 223697 - DNA, 459 bp, Homo sapiens
tttttagaatagccataaaaaatatgtctttgtttagatcacttcagaaccaaatgctctgaagccagcctatccagagagcctagattgatttgaggccagtccctgcaatgcaagggggggtgtcacaactcaaaggccactcctgagctttcactttctttccaaaataattgaagtcagtggactgtccccagagcttctgtgaggtattcacattttctctggagtgacgtgacttttgtaagacatctaaggcatgtatatgttatactttggcctggctaaatctggagaatgacagaggtctccaaaccccgaggactgttgggttgatttgaattaaatgagatgccccctttctgcagaaaatggaaactaacatggctatctctgtccattacacaagacttttgtaaaacagtcatggtttctttcttaaaatctgttttaaacaaa

SEQ ID NO: 223698 - DNA, 446 bp, Homo sapiens
tgcagtggcacgatcttggctcaccacaacttctgcctcccgggttcaagcgattctcctgcctcagcctcctgagtatctgggattacgggcatgcaccaccacacccagctaattttgtatttttagtagggacagggtttctccgtgttggtcaggctggtctcgaattccctacctcaggtgatcagcctgcctcagcctcccaaagtgttgggattgcaggcataagccaccatgcacagctctgcttcttttttatctgtatttttcactgctctgattttttttcaagtcaagtcctggacttgaggcaaattgggcttctccatacccctctatgcagtgtcttttcacaccccagtgctccagttaggccactccctgtgcctctggagacccaccccttcactcttgcgaatgcttctaccgtccaaagcccttag

SEQ ID NO: 223699 - DNA, 337 bp, Homo sapiens
cacacacacacacacacacacacacacactccccaaatcccagtaaagctgtttagaaattgcttttttcactcaatagtgagtgacggctaggttggccagattatgtgaggattaaagatgcaagatattggtaaagggtttttggacagttgaaactgttctgcctaaagaagagaaactttaagtggtgacttacttatgcctcaaagcttgaagaaccataagctagtagagtgagatttgttgtatgtatggagaaggattatctaaacacacactcacacacacacacacgtacacacacacattatacttttaaccatgtttgcataaa

SEQ ID NO: 223700 - DNA, 460 bp, Homo sapiens
cagacctggagagatatcctctggaaccattacagggcttttcaaagaacacacagtcccactgaaatcagcagaatatttcctggcctctctactgcaccccagggggggtgttcacactcctcaaagcccaggccagactcctgttaatgctaatagcaacacatgtgcactttcaagggagagaggaccacacagtgcttagtatgctagtaagcattaatttgattccttgggtgcaaaacaatgtcaatgggaccattttgaggcatatgctactgctcacaagcccaattaaaccaaaggattattgctatgttgcattatccataggagatgtacatatgatagattattggggatgcaatttgcagtgcattgtttattcccaatgtattgggtgtttggtgttgctttggaaaggttgtttacattgaaagtaaactcacattaaaaaata

SEQ ID NO: 223701 - DNA, 136 bp, Homo sapiens
gatcctgcaggtagaagtgctcacattgctgtgctcccttttctctgaccagccatggaggccctgggggcttggaggagtggctgcttactccctgggggaagtgtgggctgcaagccccttgagtgggcaggtt

SEQ ID NO: 223702 - DNA, 607 bp, Homo sapiens
gatctttgaaacaaagtaaaagttaacagggtcaagaagatacttgaaagagataactgcaggagaaaggagagatggtgcataccaaaggtgaagcatgcttagtggctgagccaagagagatgatttcttgaagtaaagttttataatttgatatgattggagtttaaggaacaaagtggaaagaaatgggagttgaggtaggcagtaaacgaaagtgttaggtatttcttctggcctatgagaaataaggaataatttcctgagatattaagagtaccatgaacaaggaaattttgcagacctctggctttggacataatattaaagaacaaatctgcgaaagcagttcataaagtgttttctgataaatgtgtaaggattgaaacaaaaatatttggaggaatggaactagcttaaactattttttatctaagcattttttgcctcagtccactttacctgaaactagacaatatgaatttgggattttattctttgacaatagacatgtgctagtgttgttgacaacttgccaaggatagacacttaaactttggaaaccaaatggatcgtaggacttatattccattataaatagtgaaaa

SEQ ID NO: 223703 - DNA, 460 bp, Homo sapiens
gtggcttcaggcctttcctttaaatctttaaacaattttaacttgatttttgtgtacagtgtcagataactctccaattttgtttcctttcatattttttctttttttgcatgaggatatccagttttcctaacaccattaattgaaaacaatgatccttttcccattgtgtattcatggcacctttgtcaaagattagttgaccatatatgcatgggtttatttatgggctttctattctgttccattggtctatgtgtctgtttttatgccagtagcatgtttttttggctactatagctttgtaatataatttaaaatcaggagatgtgatgacttcagttttgttcttcctgttaaaaattgcttgggctattcggggtcttttgtggttccctatgaattttaggattgttttttccccctctggtgttaggaaaactggatataatcatgcaaa

SEQ ID NO: 223704 - DNA, 373 bp, Homo sapiens
aaaattaagactataaaattaataaggcaaaataatcacagcaaaaggcattacatgagtttatcaattggtaggagttagaagcctggttactttaatttaaactcattattttctttttttttggcacaaatcgttgtttttatttaatttgggaaaaacatctttacaagttgataaatactagaattgtcaatgagaaaaatgctactgaaatacctatttttctctttgatggcagaatttcctaaatatttgcattttaacatattttatctcatactttagctgacattacttagttgtatatggatctattcttaataaaataaagagaaaaacataaagagaggaaaaggattattaaatttgg

SEQ ID NO: 223705 - DNA, 661 bp, Homo sapiens
gtatactgattaaaaccaacaaacctttaaaaaacttatgtgataatcagggaaatgtaaatctggatatttaatactaaggaggtactgtggttaggtttagtgtcctaatcttttagagcagaggttctcagagtgtggttcatggaccgcctgagagtcaaagctatttttaatagtaatactaacaacatatatttgcttctttcactgtgtttacatttgcactgatggtggaaacatgaataaaactgctgacaccttagcagaactcagggtagcagaaccaaacattactagcagtcatattctccattcaagtgaaggggagaaaagccagttttacttaaaaatgtccttaatgaagcagtgaaaataaatagttttattaaaccttaacccttgagtatacatctctttcatatcctgtgacttttaaaaaaatgaaagtcctcaaccaggcacgatgactcacacctataatcccagcactttgggaggccaaggcaggtggatcacctgaggtcaggagttcgagaccaggctggccaacatgaagaaacccagtctctactaaaaatacaaaaattagccaggcatggtggcaggcacctgtaatcccagctactcaggaggctgaagcaggagaattgcttgaacc

SEQ ID NO: 223706 - DNA, 519 bp, Homo sapiens
tgcctggctcatgctgctttttaaaagcaggagatgaaattcccatttgaaagatgccctcccagaacaacagacactgagacttacttaaaaatggagggtaggaggagggagaggatcagaaaaaataactactgggtactaggcttagtgcctgggtgacaaaataatctgtatagcaaacccctatgacacaagtttgcctatataacaaacctgcacatgtacccctgaacctaaaataaaagttaaaaaaaataaaagaaaagatgccctccctgtactagaaggaaaataacattgttatcaccaaggattaatagttgagactgaattcaaataactcttatcttctagcctcctcacatcatttagttactttttcacaacttactactttttgtccgattcagcatgtaagtgttcaactctgagtctctggatcttcatttccttatagcggctcctatgtcatgtagaacttatattaaataaatttatatgctcttctcctattaa

SEQ ID NO: 223707 - DNA, 400 bp, Homo sapiens
tctggggcatgagccccgtgggatgaagagagcatgcacacatggggacagttggtgcagtttgagcagggagagatgggcatccatagaagccagtccttcacctgactcagcctgaaaggcaaggagggtgtctgtgcaggggacagactggtatggggttcagaacctgagcagggaaaaggtttctgcaggagaccaggtaccagcagaggggaagaaatgtaaaaagaaagctagaatggaccctgtggtattatgttgaaaatggaagtctctgtgtgaacttgaatggaagtctctgtgtgaacttgtggttacaaacatacaaacacacacacacttcagatatctataagatatagaactataggtatgtgtagccatctaaagttatgta

SEQ ID NO: 223708 - DNA, 665 bp, Homo sapiens
ggatcaactactaaaacaccatgagcaaccttttccaagagtcactttaggaaacaatatttatgggccatatttttttccaaaataaaaagaatgtatctgagtatcatttataatcttctaacacagactacttattttactgagtagaacaatgtctgggagaaaactgacatgactttatgaccacaaaaaaaattagggcataatttaaaagtaccaacaaagaagcaactgtgtattccatcatcctttatatttctgtagtattttcgagcctgaagtatattctcatgaattatctaatagcattaccaaaatattctctccaggtgaaaaaaattgaagctcagataggtgaagtaccttgcttgaagacttagcaaagctgggtgctgtggctcacacctgtaatcccagcactttgggaggctagggtgggaggatcatttgagccctgtagttgaagaccagcctgggcaacaaaatgagaacccatctctacaaaaataaaaaataaaaaattagccaggcacgttggtacacgcctgtggtcccaggtactctggaagcccgcggcaggaggatcgcttgagcctgggaggtcgaggctactgttagccgtgatcgctcactccagcactaggtgacagagacctcatctc

SEQ ID NO: 223709 - DNA, 477 bp, Homo sapiens
  misc_feature (49)..(49): n is a, c, g, or t
accaaagctgtgtcattacagaagaataacaaaaataaaagcagcacanacaagaaatgagaaaaaaaaatctacaagaaacacataacaataacagtaaaactggtaatagcaactctattttaaagcaatcattttaaatactaattaattaaactacttaatagaaagaaacataatcctaggatgttgtgaggtcaaagtgggctgatcacttgatcccgggagtttgagatcagcctgagcaacatctcaaaaccctgtctctacaaaaaaaaaacaacaaaacttgctgggtgtgatggcaaatatttgtaacacagctatttgagaggccgaaatgagaggatcatcagagtttggaaagttgaggctgcagtgagccatgatcatgccactgaaaaccaggctgattgacagagtgaaaccctatttcaaaactgaatgaataaataggccaggcatggtggctcatgc

SEQ ID NO: 223710 - DNA, 402 bp, Homo sapiens
cacctggcctgttgctattttacaactgaggaaactgaatcccagaaaagtgaaataacccagccaagatcatggagctactaaactgtggcaacattatttgaatcttagtcctcttacatgtaaagttctttaaatattccatctctctaaagttcccataaaaatatatatgttggtggcactgcctgtaaccccagcactttgggaggccgaagcgggcagatcacttgaggccaggagtttgagacctgcctggccaacatggcaaaaccccatctccataaaaatgcacacacacaataatagccaggtgtggtggcgtgcttataatctcagctacttgggaaggtgaggcatgagaatcatttgaacctgggaggcggaggctgcagtgagccg

SEQ ID NO: 223711 - DNA, 270 bp, Homo sapiens
aaaattatttaactcattcttaagtccatttgcttaccacagctacctgtttgtaacaacttaataacaacagtaaacaaatgtataatacactgctaatcattgcctgagtactttttggccctttcacaggctaagaggtgatgctaacaaaaatatgtttagagtctaatagttataaacaatgatatctctgagatattgttgtaaataatcctgaaattattcaggattaacataggtaaatatacacagacacatctcttgcca

SEQ ID NO: 223712 - DNA, 512 bp, Homo sapiens
cacaggtgtctcatgacccgacctcaaaaaggccatctagtggatgtttgtggtctaacaagccctttcaatgaatacttggcggacagatgctggggcggagtctcttagaagagctgcccccggcccccctcagctggatttgtctgagaactcattcttggcgttcactgcaagctataagctctgcgatgggccctgaaaaaaaaaaatcgatactacgatgactctcatatgtatttcttcagcccagatccagacctttgtctactcagcttctccacgtggatacctaataggcatctcaaatttaaatatccaaaaccaaactcctgacattaaacacaagaagcaagaaatatgaacatattttctgattccactaatataaaagtacataacagtcaacacagctgctctatcactttaagagagtaagcatcccgaaggcaatgaccatcaacctcaaatatacatctatctgtccatcagagtgcataaacaatgctcat

SEQ ID NO: 223713 - DNA, 474 bp, Homo sapiens
tgataagaagaaaccaccagagagtctacacatagtgaggagagtctcaatgcttcccaggtacactgtaggttattacatgatattaactcatttgagaaaagaaaaccgaaattatcaactcaccaaaatggggtttgaagaaacaaaatatgacagtgtgtatacagtgttatccgtgaaaaggaagtcctgcatccaagagatgtgagtaattcagtgaccaaaagtgttctctacttcagttaggactagtttatcaagacccaaggtatgtggcttagggagaacataccttgagacttgccacttcttttggcactaattacaagcctaactgaaccatcttctgattgttgatatggccttttaagctattgttgttcaggaaaagggagaattctgcatgagggcaccaacatttcattctgcacatagtaaatttagagaaattctctggtttaaaaaaaagtc

SEQ ID NO: 223714 - DNA, 508 bp, Homo sapiens
agagaatctagagcccaagagtagaacgggggtcaccaaagcaaggccaagacaggagcagacccagtagctgataggaattgaatccaatgacagtgaagctggaaacctgacttggaacagacaggagcagacatatggacaagtgcaaggtctgaagaggccagcagtagacaggaacaaaacaaaaagctgacctgcaaggggtccagaacacagacatgaagaatgggcaaggagtcaaattcaagcaaccccaaggccacagctccagatgtgctgatgtttctgggaaggcagacacaatctcaaaaattatctgacttgggatttttaggtacagttaaatggaaagtcctgcctagagaagagaatggtgtttggggggaaagtaattcagaaacttccgataatttatttttatgtccccaaaagggcatggcacaattgaaagtgcacagtaaacactccataaacatttgtcaattacctaatagagacggaagtt

SEQ ID NO: 223715 - DNA, 409 bp, Homo sapiens
aaaataaatcaagtgtgatgagtgttatataagaaaggggaaatagcagggttcagtgtggaacataggagagtgggccttcattccctccagttgagggccaaataaggcatccctgaggaagagacattaagctgagatctgaaaggtgagcctgaataagttaggtgaaggagcatgagtaaagggaagcatgaatagcatattgcagagcctctgagatgccacatacaggatgactaggagaacctcagtatgcaggacaaagtgactttttggacatttttaggtttcgcatttttattttaagaacagagggaagctaatgaagtgtttaaattagggagtatggctatggcctgatactctgaatggagtatggagaattgattagagactgaatcactta

SEQ ID NO: 223716 - DNA, 355 bp, Homo sapiens
aacatcaacctaaaacccgctcataacctctcagctccctgctggtgcactccccacagagacaccctgggtcaaacacagccccctggccttattccccatgcctgctagcccacacaatccatgtcacaaaatcagcctcggtgctttggctacaattttccagggaaggaggcaacactgtcccgattatctgtgcacatttccagtgaaatacatgggcaccagcaccaccatgactggagggcatctgtgatctaattgtggagtataaaataacgagaagacactcaacttaactagaaagtgagacccccaaaatctcatttttaaagaaatattgtaaatgcatgtt

SEQ ID NO: 223717 - DNA, 383 bp, Homo sapiens
atctaggggcagattgtgttttttaagatggttacaacaaaatctatcttcctacatgctcttcttaccatgtaacattgatgctcctcccactgaactgcaggggtcaaggttccctctccttgtctccaggcaggctagtgactgctgaggaagtgatgctatgtgacttccaaggctagatcataacggccaatagattcttcctggtcccctaggggtggttgcttttggaaccacataccatgatgtaaggaagcccaagcagccacagcaaagaatacatgtaagtgttaacaactgataaccccagatgaagttccagctgacagccatgaccaaccaccagacacatgaatgagagagtctttgacatcagtcaa

SEQ ID NO: 223718 - DNA, 785 bp, Homo sapiens
cactgtagaagtctcgcatatatgatcatttaaaatttcgctgaagtcatgtctgaattctgcacactgccttatggatgtgggagaggtgactaaactgagtcaacgcagtcaaccacccaggacttgcaattccagggggttgcatccacctaaccctccggggttctggcttcggatagtgtttgatcaatggaagcaacaaaagaagattggaggacatgaagacaggttactggatgatattcgacatgagctgcaatcctccatctgaggtcccaacttttccagaaggcttctgtcctgttgcgctcattggattctgcattatgggattctcttgaagtgtgtgaagaataatgagctaaataaagaggaaaaacaaaagaaaacaaaaactgcagggacttttataactatcattgattgccagcttaagcctgctggactcttcacaaaactatatatgcttcaagcttaatatttaattttgtaattggaacatttataatcatattatgcatttaataaggatgctctaattcagatttactattatcaggaaattaaatttggagttacagtaatgcatgcatatatatgtgtgggtgtgagtgtgcatatacctatatatgtatatacatatataaagtaaacgccttcttttaacgtgtgttttaagtatagcttccatgtcctagttaattcagcaccctcccttttatcctttccttgccattgtcctctctactagactacaataaaaacaaaaaactatgaaagta

SEQ ID NO: 223719 - DNA, 432 bp, Homo sapiens
actgtgagcagacattgccaaatatctcctggattgggggtaggagaacagagtcaccatgaccatatatccatctaaaaaagttaaaatagaccagacgcaatggtgcacatctatagtctcagctactcaggaggctgagatggaagattgcttgggtccgggagttcaggactgcagtgcgccatgattgtgcctgtgaatagccactgctctccagtctggacaatgtagcaagaccctcatccccaaaaaaagttaaaatagtatatatactcgtgttctgagtattttttaatttatgtaaatagtattacattttatttatattatttacataaactacatacaatttatgtaaatggtatatgtatatgttgtatatgcatattcttgtacaactttatttgttcattaaacattgtatatttg

SEQ ID NO: 223720 - DNA, 371 bp, Homo sapiens
aaaaaaaaaaaaaacaagatgaaagagaaaagtctggaaaagaagaaagcagggacagaggaaggcaggtaggaaagtactgtggcacagaaaacagcaggggaaagaaccaaacaccacatgtctcgtaagtggaagctgaacaatgagaaccatggacacagggaggggaacatcacacaccggggcctgtagtggaggtggggagctaggagacggatagcgtcaggagaaatacctaaggtagatgatgggttgatgggtgcagcaaaccagcgtggcacatgtatacctatgtaacaaacctgcacattctgcacatgtatcccagaacttaaagtataataataattttaaaaagaggtaagaca

SEQ ID NO: 223721 - DNA, 530 bp, Homo sapiens
gtgtgaggggaggaggaaggcgccacgccgaaacctgtcgcaaacccgagaaggagagccccggggactgggcgcgcgggatacaaagggccgtgaacgcggccttccatgaggcgacagtgcgcgggcagggagacaaaatggagcgatgggaggaatcggagcccgagcggcagcggcggggaaggggcggcggcggcgggcacgcgccccgccagggcttcctcctccgaccagcgacgggggagggggcgcggcggcggccagttctctccgccgcttacacgcggccccaccgcccgggcctagcgcggcgggaagcgccagccgggtgccgccaacaatagggagcgaggcagcgccggcgagggaggagccggcggcagctgcacagcggcccgcgtccgcgctccgggccccgcggcgactcgccgcgcccgcggcccgtgaaacgacgcggtagaacgaggggcgggggggcgccacgccaggggtcggcggcgcggcccagaggcggcaagggcgcacac

SEQ ID NO: 223722 - DNA, 388 bp, Homo sapiens
gaggcgggtggatcacttgagcccaggatatctggatcaacctgggcaacatggcaaaaccctgtctttataaaaaaaaatacaagaagttagccaggtgtggtggtgtgtgcctgtggtcccagctacttgggaggtgggaggattgcttgagcccaggaagtcgaggctgtggtgagccatgatctcccctccagcctaggccatggccatacagtgagatcctctctcaaaaaaagaaatatgaagaatagaggtttgacagtcacatcatttgagatctccttatccaaatgcatggtcagagtttgagtcacttgtggaatctttgagtaactgaaataaaatccagttgatcagaattctttggtaatttttagtatgtatc

SEQ ID NO: 223723 - DNA, 465 bp, Homo sapiens
gtgtatagtggcttttcaaggtacacgctgaagacagcagagtgacaagctagatggaacctggatcctaaatcaccatgttaaaggccacccaccaaatactcaacattgaacagctctgtgagtgagaaataaacttttattgtgtgaagtctttgaggtttggggccttatgtattatagcaatttgtgttgcttactgtgacccagaaattgcacttctaggaatgtttcctaaagaaataatccaagattcaaaggctgatagaatctgagaacaatggacaaaacccgaaatggctataatcccaatgaatgctgcaaagggctctgaaacatgggaatggaaactgaacagcagaggacagaaaataaattacaaaattgctcaagtagtacaaatacagtatttgtgatgggaattaagaacaatagttgaaaagaaaataaaaacctggtcagcaa

SEQ ID NO: 223724 - DNA, 398 bp, Homo sapiens
agccgcctcagcccccggcgtagcctctccggtgggccaggtcctccgcccgacctgccttagccggtcggagcacacacgcctggccgcggggcgcccgcataaaagtcacagccagcggaggttggaaacagccgtcgacttgggcatcggccggacgaggatggagtgaccagcgcggccctggccacacaggccctgctccacgcccctcgcccgccctcacgacggagcggagctccactcagccgctccaggaaaggaagcccaagaactccggagttccgcaactctccccagacgtccggaagcaaatcgcgtcccaggcaaaacgagctcgcttgagagcgcccttagccccgttgggctgctgcgcgcgcggcgcgggaagctgccat

SEQ ID NO: 223725 - DNA, 745 bp, Homo sapiens
aattgagctttgtttgctattaactatatgactatgattcattctaatttatatgtgctctgattagtaaacttattaaaatacgtatcagggcaccattgcaagacatctattcagaccccccatcatcctctttgatttgtgagagatggaaagacacctgcttaggaaagggaggaaaattaaaaattctgaggttcagaaatagggattccccatttacaatgataacattaacgtgcacatgggatagtcacacttaaatgaattaagaaggatcaaactgaagcatttaaccctcacaaagcccccccactttttttgtcaaggttctagattatctgagagtaagacttctttattcagatcctgttgagatgctgcattctcatatttatgtttatagtggaaatgccccaatacatgattaaatcatagaaaagaattttgctgttgttgttgtttagggcagaggagagaaagacaacagattatacaattctcctggccctattattgttttgatttttgtttaaatttcccttatttgggtgttgaacaggaagatcatgtgactctaagatagaacatttttggagttctgtgtcactagcaattaaagctatcaagtatgtggagtgtcacaaaactctcatacatgtaaagtgcaatttttatattatgattttgatgttgatcttttatgaacttctcatgaagtatttggaactaagcccaaaggcaa

SEQ ID NO: 223726 - DNA, 497 bp, Homo sapiens
cagaaacaaaaaggaaaaactccaatagtctggatgcagccaacaaagcaccttccagacaacagaagcagctgggaaatgaaacaacaaacaaacaaggcaaagccacatctcagaacagggcatgttgtatggactcatgtacttggaaagtgaggttcagggaaattccaagtgaatggcaggaaataaagctggaaacctaaggaaggactaggccctaaggcagagagagattctttaagtacctcagcccatagggacaaatcatcggttttccttttacctaaacggaaacatgtttcttgtcttagagaattatgttttcttttcggtttattttctattttaaatttaaaatttgaattgtaagcctataggatcccaagagttccaaactctatatttttcttactcctttaactctgccttcagcatatgtcatggtaaaatgtaaattaacctaaatctatacaataaaaataaaataaaaatta

SEQ ID NO: 223727 - DNA, 192 bp, Homo sapiens
agatccagtgacccaactttctattttcatgcatgtttgaccacatccttttctatattaaagaggtgactcaaaacttggtaaaaggtaaacataaataggttttattgaatatctaagctgaatctattctaaagaccagaaacagttccgtctaacttcccccaaatttctcgtaacaggagaacaact

SEQ ID NO: 223728 - DNA, 379 bp, Homo sapiens
ttgagacagaatctcgctctgttgcccaggctggagtgcagtggcgctatctcggctcattgcagcccctgcctcctgggttcaagtgattctcctgcctcagcctcctgagtagctgggactacaggcgcatgccaccaggcctggctaatttttgtacttttagtagcgatggggtttcaccgtgttgggcaagatggtctcgatctcctgatctcatgatctgcccacctcggcctcccaaagtgctgggattataggcgtgagccaccacgcccggcctaaggtctgcttttaagacttgttaggaccagagccgcatttagtttaggactgattattctctgctactgaggcaagacccttctgtcgtcttctc

SEQ ID NO: 223729 - DNA, 228 bp, Homo sapiens
gggccgattagacccaggtatgtttaaataccaatgaaaaggttccaggcgagttggagaggttggaaatatggaatgaggaaataatttctagaagaaggtttctaagaaagatccatggagataagattcagagaaaatgtgaaaaaaggatacttcttccacgttaacttgagggaacaaagaaagaagcaaggacttaatatgcccacctctcaagcttcagca

SEQ ID NO: 223730 - DNA, 380 bp, Homo sapiens
caaagcatggtgggatatacacacacattgctaagtcccttgcccttaaggagctcacagtctagcctgaaggcagataattaagcagctctaatacaagtttgaataaatccagacccatgaaggaatttaagtagagtactggcttccagcaactggagcaaatacttgtgtatggggtacaagggaagcttcagagaaaagaactgtggtaaaagaagaggcctaagtctgaaatgtcattgtgaccaaatgcacacaccatcagcttgcattgaaaaagtcaaaccaatccttaaaataatccattatggctgtggtactgggaagatgatcatgaaccaaaaaatgttaagttctttgataatgaaattagtata

SEQ ID NO: 223731 - DNA, 608 bp, Homo sapiens
ctagaggatccccgaacatgtcgtgctggctcaaactctgacttcagatgatccacccgtctcggcctcccaaagtgctgggattacaggcatgagccaccgtggcctggttttgtaaaatatttgagtgctttacaaacacttaatatattgcaaaaaaacaaaaacaaaaatctaataaaacctttttatgatttatctcccataaaccattttttcaggaaagtagataatatgctccaccaaaataaagtacatcaaggaaaaaaggcatcttttgtctttgatggaagaaagaggaagtccagtacaaaagtatggcaaagggaatcatccctagggtaatgaaaaatgtccccaagatgacagctgtacaagagacctagaggcatccagcccagactagagactggagcagtcagaagaaagatttcttcaagaagatgaaattcatagaacacctaaattgtttggatagaggagattaacacataaaggagatttcgtgacactagaggagagttacacataaaagaacacaccaagcaaatgaaaaaaccaaggcaatcctttgggcaaatgtataccagcaaaacactcacattaaa

SEQ ID NO: 223732 - DNA, 639 bp, Homo sapiens
tagtgtagccacttcagctctctttttattgctgtttgcattgtatatctttatcttttacatccttttaatttcaatctagttgtacttttaaatctaaagtgagtctcttggagacagcgtatagttggatcatgttttttaaatctattcttccaatctcttaattggaaagtttaatttatgtgcatttaatataattgaaaaagtaagatttgtctgccactttgctatttattttctatacatcatatgtctttttaaatctcatgttctttcattactgccttcttttatgttaaatagatattttctttcattctcttgtttcatttactatatatttttgaattattctcttggtagttgccctggggattaccattaatatctgaatttataaccatctgttcatgttaataccagcttaatttcaagtatacaaaaatgttgctctaaagtggtcctgttttcccctcccatatgctattattgtcacaaatttcatcttaatacattttgtgcccatcaacatacatttataattattgccatacacattttatttaaatcagaaaaaaagagttaccaacaaaaaataaatttgtattgttttatatctgacttcataatttcttt

SEQ ID NO: 223733 - DNA, 485 bp, Homo sapiens
tcccctagccttggcatcaaccatttctccaaaggagctccaatttcattttcagtaaaaattggtatataaggccaagttctgaggtgtgcttactaactttcagccctttcagtggacaaagctggttagaagacagatgctccaacttcccgggatgctcaggagtgtcagcctagctcctgggattcttgaagcacttgaaatcctactacatcatgcaaaattggatttggattattcaacttccaattttattttttattttaattttatttttgcacattggccagtgccttggagagcaatataaatcagtaagtctctcctggcattttcctgatctctgctacatcatctcaaaaccacaaaattcagatgtacagagtaacaaaacattacttgaagttgatattaatatatagaaaatagaaagttcacatcacattgtatcatattaatggtgaataaaatagaagttactg

SEQ ID NO: 223734 - DNA, 393 bp, Homo sapiens
gagaagctattactgagccgtgaaaaaaaaacaaaaggcagtaggatgggcaataaggagaagacctggataatccatacactagatggttgagtcttgatgattttgaagataattatgtgtgtggctttggaaattagagtaactattactgtaacatctcagttatttagcgtttttgagctcattccatgttagtcatctagaactctttatagataaaatttttgagaattgcagagctagggagaacgggtcttacatgtctgtacattatctttttttttttttttttttttttgagatggaattttgctcttgttggctcaggctggagtgcaatggcatgatctcggctcgtcgcaacctccacctcctgggttcaagtgattc

SEQ ID NO: 223735 - DNA, 330 bp, Homo sapiens
cgtggggtggggggaggggggagggatagcattaggagatacacctaatgtaaatgacgagttagtgggtgcagcacaccaacatggcagatgtatacatatgtaacaaacctgcacgttgtgcacatgtaccctagaacttaaagtattaaaaaaaaaaggtgtctgatttcccaagaaagcaaataatgaaaataatttttttaaaaaggaatctgaaaaaaatttgttaccaaaaaaatacaaacaccaagctgattagtattattattaattattaatgttgttatttctagctaaagaaaatatactgatacatggcataaaaat

SEQ ID NO: 223736 - DNA, 202 bp, Homo sapiens
gtgttgataagttaaggtttattagaacatagccacatccatcccattgacattttacctatggctgctttcctgccatgatggcagaattgagtggttgtgacagagagactggtctgaaagcctaaaatgtttacacaatttagacccttagagaagaatttgccaaaccttgacctaagagatgaagcccacctttgga

SEQ ID NO: 223737 - DNA, 526 bp, Homo sapiens
cagaaacggggttgtctggtgcagatcagtgtatattgtgtaatttgaggaagagccagtaaaataatgaaaaatgaacaaaaccttgggaaacggatatcattaggtgcaccagcatatacaaatgggagtatcaatgtgagagaacagaaagggaaagaaaaattttttgaagaattacagaaacacccacaatttgttgaagaacactaatatattcatccaagaagctcaacaaactcatatgaggataaatgcaaagagacttatacccagacacgttatactgaaagatgtttttatcatgctcttatttgacctgccttataaaagtgataatacaagtgctggtgaggacttacaggaactgaaatgttcatatgtttttgatggcatgtaaaatgctacagtcattctagaaaatagtttgtcagttccatttaaaactaaaaacaaacttagcatgtcaatcactagttgcactgttagacatttatccttgagaaataaaaacttatgttccatc

SEQ ID NO: 223738 - DNA, 256 bp, Homo sapiens
atgtggggttggaaagaaaagattaaaataaacacatttgtatactgttggtgggaatttaaattggtgcaaaatttttggagtacaacttggcaacatattttaaaattttaaatgtcctttgatgcactactaggaatttatcctaaatatatacttacaaatgtaacctaagatggacagtattgtaaaaattgaaaataacctgagtattcatcaattttatcattaaataaagttatttattgctacagtt

SEQ ID NO: 223739 - DNA, 1072 bp, Homo sapiens
ggtgtgcaccaccatgcctggctaatttcagaatgattttcaacttcacattttgtatgtgccagtgaaaagaaatcttttttattatttctactgaaatatctatttctgtttcttagaattttacagttccaagtagattagcttagggactaggacatgtctcataatgggagagcattgcatattcatgtgtttcaaactccaggtcaggacccattagtggattgtgacattgatctagtgcggaaaaccagcatttaaaaaaatgaaatggtgtaagagaaaaatgatcacaatgtaccatacatagctaaggaaaatgttttgtgtaacttgtttacgtgtgtgcagcacatgtgtgcacaggtgtataccggatcatagcgtaaattcatttcttactgaaagttgtagtcaaaacattttcacaacactgttttggatgaagcttatacctcgtcccctgtgttactgggcacaaaacttcaggatgtaagaaagaactgagatcctgtgcagtggaaccagaggtttagtgctgggctctggtctgaggtaaggtgccagtgtctcagtagcgtgagcagggcgggggagccgctgggaggatgacaggagaaggcccagccgggaatttgcatacacaaattctgttgtaatggtgatcacagaataggttggctgatttacacagagagaaaggatctgttgtgttcctcagtgaaatcacaccatttgcagagagcaatcttttcctgttccccactgctcaagttaatgtaaaaacctgtccctatctgtccccatcaagaatgagatgtttttcttgttttattgttggaggaacattgactttcaaaattgaaaaaccttaatggtgtgaagaaatttcgagtttaaaatattacataatgtcatccttcaatacggaaattccttttgaatttccaagttaccagaacaaaagtctaatattttaaaatattcatgtttggaaacaggttggttgtctggttgcgggccatggccgatattctctcagccgcagaatagatgattacaagcacct

SEQ ID NO: 223740 - DNA, 350 bp, Homo sapiens
aagcagacttatccaatgtgaaggaaaggaggcagtttgggcttctgctgatgatagacttgaagaaggtaaaggtcttacaccttgtataatatagtggtaggcctgtccaagaagttagaagcattatgtctagcagtggcttattctcttccgtagatctcactgcttgggaattttgatacattccaagaatttaacacaatgaagaaccagaaatgtatattaaatacttggaaatgatattcttaataagcactggtaaaacagttaacttgtctctattttagagatatatctttttcagtggctataatgcatcgttacatatcagaatcacttggggactt

SEQ ID NO: 223741 - DNA, 432 bp, Homo sapiens
gcacgagcaggtctctgacatgtagaaataagacatacatgaaaaaagtgagataaatatcagtttaacacaataacactatgtacattatgaatagttaagtcttatacttctagggaaggaaggagacttttctgaactgatagtttgggtagggttactgtaggaggagagaactgagctggacttgtaggatggggttgaatttccttgagaggagtaaagcgggtatatgagcaaatgcttagacatgaggtataaattgagcttgggcaatagaaagaattcagctgtggcttgagtagagtgttaggaagctgaatagttagaggaaatttcaaaaattaacttggggccagactgtagaagaccttgaattttaacagtaggagtttggactctaagaagttaagagttggggcagaaaaaaaa

SEQ ID NO: 223742 - DNA, 546 bp, Homo sapiens
gaaatgagcaaggggaggggttccctgctagcttgtgccttatctaccagaaagctgagttggcaccttcctgggcagaagtaagttgtaaaactggccaagtgtgcatgctttcggcatgctctcctgaggtgaccccctggatgtgggagttccaacctggagcacatagatgaacttgccctggagggaatgttcaacaaagctgacaaaaacaagcaatgaggagaggactccctattcagtaaatggtgctgcggttactggctaggtatatgcagaagaatgaaagtagatccttacctttcaccatatacaaaaattaactgaagatggattaaatatttaaatgtaagatctcaaacaaaaaattccagaagcaaacctagggaatacccttcttaacgttggctttggcgaagaatttatggccaagttcccaaaagcaattgcaatagaaacaaattgacaagtagggcctaaataaataaaagagcttccgaacagttaaaaagaaagaaagaaagaaagaaagaaagaaagaaa

SEQ ID NO: 223743 - DNA, 363 bp, Homo sapiens
agtgctatcaggaacccatgggagagacaggaatgttttcagaaacctcagcctgtcctctttttactgaaataggggcccttgttgatggtagtcactgcccatgctgtttagcctaaggaaggtgacagtgggtgggccacctcaggccatatggaggaaggcctggcacagaaacacaaggccaggcaggctgtggctagcctgaatttagctgtagcctcagaatcaggggacttgggcttgacagctgacattacatggtgcacaactctggttaagtcacttaacttaaatcttatcccctcatctgtagatggcttgaagaccaaattaaggagctccttcaacaaatacattaaa

SEQ ID NO: 223744 - DNA, 415 bp, Homo sapiens
caaatatataatatgcaaatgaaaaagactgggctccaagaaagctttattacaaaaaccagcaaaaggcagaacttgacagccaaaccctgctcttcaatatatacccaaaggctggattcgccccatgcctttgagagtcttggttttttggttttaaaaataataacttgcttaagttgtgttactgttgccataggttactgtccatggtgttcagattttttagtataacctaaggaaatcaagctctgaaagcagcagcagaataaaagaggggccagccgggcacagcagctcacgcctataatcccagcactttgggaggccaagacaggcagatcacttgaggccaggagttagaaaccagtctggccaacatggcgaatcacggtctctgctaaaaatacaaaaa

SEQ ID NO: 223745 - DNA, 266 bp, Homo sapiens
attctggagatggtatggtgcagtggtcaagtttaaacaaatagaaattcatatataatcgcaggtttccacacatgaaataggtgatgaaaatttagataaatagaaaactaatctcaaaagtgttaaaaaaatgagttatttttggttttatgaagattatgaccaattaaagtaacgggataatgaaaagtaaataatgacaacaaaatcaagctttaacatgtatgctggtgacacccagaattgggtcctcagaaatttga

SEQ ID NO: 223746 - DNA, 295 bp, Homo sapiens
ggtttattttcaacagctgtctttcaagagctgcaaacagagagcaaatgtgaatgactgggaaaaggctatttccctatttcttcaatgaacctggtaaattgcaatttccaaatcagaggaactaccggatcaatacaaccaactttgaaggaatgtgtgaacgaagaagaagaaggccaggtgggatggctcacgcctgtaatctcagcactttgggaggccgaggcatgcggatcagctgaggtcaggaattcgagaccagcgtggccaacttggcaaaacctcgtctcta

SEQ ID NO: 223747 - DNA, 268 bp, Homo sapiens
gtaagaatatgatttcagaatataaacttgtggaaatattcttggtatagtggcaagaagtcagcttttagaatgggatatatagtcccatgcatctcactctcactgggtcacatctggatcaaggcataaggtttctttgactcttagatttgtcacctgtaaactcggaatacgaactctccaagttcttatgaggattagactagttagctgatgacaagtacctatcacagtgcttgacacaaggagatactcaataaattat

SEQ ID NO: 223748 - DNA, 410 bp, Homo sapiens
accatggaatactatgcagccataaaaaagaatgacatcatgtcgtttgcaggaacatggatggagctggaagccattatccatagcaaactatgcaggagcagaaaaccaaacaccacatattctcgcttagtgggagctaaatgatgagaacacatgggcacatagaagggaacaacagacactacacctaagggtggaggttggaaggagggagaggatcacgaaaaatagcaaatatgtactaggcttagtacctgggtgacaaaataatatgtacaacaaacccccataacacgtaacaaaataatctgtatgacaaacctgtacatgtacccctaaagttgaaacagaagttaaaaacaaaacacaaaaaacatgatcctgagttctttcaatggcaacaatcc

SEQ ID NO: 223749 - DNA, 495 bp, Homo sapiens
ttccagtcacatgcattgggcaccattacatgtccaagctgtgccaggatctagataaatggctgggctcagtccaaggggccttcctatctggcagtgaaaataagaggagataccaagggccctgagcctgagtctggaggaaaagtcatgagcacagggcagtgccagggcctgggagctgccacagaggagcccaccttggtgacagacacctgtaggctcatatgatgccgagtgcccaacacagggaactggacaaaggtttcatgcacgactcttttccctccttggctaccttgaggaccttgattataatagttagcctttttttttttttctttttttgagactcttgctctgtcgcccaggttggaatgcagtggcaaaatcttggctcactgcaatcttcgcctctcaggttcaagtgactctccttcctcagcctccctagtagctgggattacaggcgtgcaccactatgctcggctaatt

SEQ ID NO: 223750 - DNA, 239 bp, Homo sapiens
tcttgccacttctaatgttgcctcttctaatccctcttctgttatttatgcatatgggggaaggaaggaagagggaggtagtacgtgggtaaaggtaagaaacctcaaaatggaatgtggacttagggccgtatctacatcaggaatacaaaactttgtttaattttactttctaatatcatcattttttttttttttgagacgcagtctcgctctgttgcccaggctggagtgcagtg

SEQ ID NO: 223751 - DNA, 486 bp, Homo sapiens
gagactgtctcaaaaacaaaaaaaagaagtcagtggcctgataaaaataattcacatatgaaatgactacaaacataaaaaaaaaaaaagaaaaaagatctaaaatataatccctctcttctctgttttgcataccttaaactttatcttgttgcacaagtatttattggctaccttctctgctagtaaccacagagtaataaagataagttagagattggaaggatacaaagagagactgccagctgttttagttgtgttttataaacctctggatgattttgacattttgttatactttagcaatcttctttctgtctatactgtagtgacacattcatttattgtagccatggataatgtcagtagacttttggggaaaatattctttcatgttgtcttctgtagactagaataatatttttcattctgtcttttgggagcagagaattaagaggtacctaataaagtgagatggaggtggat

SEQ ID NO: 223752 - DNA, 186 bp, Homo sapiens
ctctaagaaataaaggataccaccttaagtgttagtaatgctaaaaactaaaataggaagtactaactttagcactcagggcttaaaagaaacttggatcatgacaagattcgaaagagtgttcatgaggcaatagcatagttattgtggggaatttagcagctgaattgaatatgttaaaagtaa

SEQ ID NO: 223753 - DNA, 448 bp, Homo sapiens
cgtgtgttctttggcaagtcacatctctctgaacttattgtccaccatcaaatgaagataataaagtatttcccaggggtatgatgtgttagttataattgtcaaataatagaatgcaagtgaaaagattttttaatctataaactctattgcaaatgtgaataattttttttctgttaataactaacattattcctcaataatctgtttagactgactctcacgctcacgaacattgctctttgttatctattgatggattttatgattagcccataaaatggtatttttagtagtatatattggcaagtaaatcttcctgatgtgactgctgataataggtactagctgatttggacgtgtattgttataaatttcatactgttagtaaaagatgaaaagccaagggaagaataaaaagaaatccttttaaataaaacaagataac

SEQ ID NO: 223754 - DNA, 401 bp, Homo sapiens
caggacacagtacactgctccaaatttgatgcggtataattaacacaacatcacctactgtatttatgccaaaaatgttaacttgaatgacatcaacagacactataagagtagttcagattgatgggtgttctgtgagacaaggaaaatatcagggtcatgaaggatagaaaaaggatagaagaattgtagattaaaggaaactaaagaaatatgacaactaaatacagtttctgattttgatcggattccagattttaaaaacatacccagctagaaggacattattgagtaaatgagggacatttgaatatggactgtgcattagataatgttgtatcagtgttaaaattcttcagattaacaatgatatgattctgttggagaatattcttgttctt

SEQ ID NO: 223755 - DNA, 352 bp, Homo sapiens
gctttgtctagcaatcacattcagtggattggccttgctcattgggagccactcaaggctacttagaagagatgtgcatctcaaacactgtctgctcagtccagggccactgacaagtcaactggtctgtgaatcctagggccggcttcagcattcaggaaaacgctttgaacttttaccagggaaggcacacaatttcaagtgaagccaaaagtcatgtgtttgtttctccttctgattagtctgatcatcaactgggactttatcatcatgggaacaaaaatactcagattatctgacaagtatcttagtaaccattttctgatagtaacatgtatatgtggatgatgaa

SEQ ID NO: 223756 - DNA, 400 bp, Homo sapiens
ggcaaaaggaaatactggatatgtgtaggggttacaaatttaagtgggagtgtgatagtgcaggtcttattctatcatgttattagatgaaagttacaaagatatatttctatgtacatgcaaaaagatatcaataaattcaactagccataggactgaaaatgcatttaaaatactttttaagattctatttgatacaaatagtcagaattatgcattcccaaagagttccattcaagccagaaagaagttagagatgccaaccaaatccatttaacactggtctgtaagtgctttaaaaaaaggtaatttaataaggaaataagataaataagcaaaattttaaaagggcatagatactagaaaaggggagtatggattattttaaagcaatgtaatt

SEQ ID NO: 223757 - DNA, 549 bp, Homo sapiens
tgcactgatgcatatacaattgaaagatagcaaaaagaaaagaggtcagagccttagcaaggcagaatggagaaacttctgaagtactgtaaaagattttcataagagagaaggaaggagaggatgactataagcctttctattcttcataaacttcataaaagcttaccaactgtctgcagaacgaaaagaattctatatagcctcttatgtcccaaaaacgttgatactcctctaaaagtgaatttttttcagacacttgaggaccactcactgattccacatcccttatattggaattaaacagctgctaatagcataacattagaaacaacctaaaagcccatcattatggaactaattaaataaattacaatcggccctctgtatccacgggttccgcacctgtggattcaaacaaccatagatggaaaatattcagagaaaaaacaaaattatgtctgtactcaacatttacagacttttttcttgtcattattccctaaccaatgtagcatttacattgcattggtattacttttatgttta

SEQ ID NO: 223758 - DNA, 421 bp, Homo sapiens
gccatggatcattccctcaaaagaaaggacacacacgcaaaatctcctctctatgtctggaggttcttagacttctggcgctcatggagctcaggatccgaactcctatcttgaacagaggcaccactgaaatgtaaacgtttgcaaatgtttattaagactgtattatgtgccaggcactttgctaattgccagggatgtaaagatcagtactactcaaggagaaaaacaggaaagggatctgtgtttctgagtatctctgtggagcttggcactgttcaagccctttatataggctatcttgcttcgttcttgtaacaatacgtttgaggtcggcattatcctctttttttcgtgggaagaatttgagtctcagaggtgaaatggccttttcaaggtcacccagctggtcagtaaaaga

SEQ ID NO: 223759 - DNA, 235 bp, Homo sapiens
atagctatcactgtacatatgaatactgtccaggatatcagatcaattatcaaatccaaggtctctggtgttttgtctcacagtgttgaatatatgaatgcttctctattatactgacttgtattattttcaacaaataattatgtggactcaaaatcttacatttttatttcttttcttttttttttttttttttttgagacagagtcttactctgtcgcccaggctggagtgc

SEQ ID NO: 223760 - DNA, 349 bp, Homo sapiens
tagtggaaaatggtttgctaaggttgtgctttgggctcaccaggctgctgaatggggttcctcagctttgggcatctggtggcagggaccttcaggagtctttcccatgtttggaccagtgcatcagtgaggctgtcactgcagagaaagacgctaggggtcaggtgatggactgctgcttctttagagcatcaccttcatgactggctgagtcaccaggatggctgaaaaacaggttctagaaaatcaaacattctggaaagccctggaggaaccactgggagacagagaaaatattccgaaataaggagtttagaatggggatagtctctgagcctgctaactggtt

SEQ ID NO: 223761 - DNA, 470 bp, Homo sapiens
gaatacatttaagtgaatatgtgacttctaaaaaattaccagggataactttagttttattaatgtgattaaaattattttagctttatcaagagctggtattttgtttcttaaggtagattttaacaaactgaagaaacattaaaagccatatttatatatgtatatgtgtgtatagataggaataacaagggctggccatggtagctcacacctgtaatcccaaaggaggccaaagtgggcagatcacgaggtcaggagttcgagaccaggctggccaatatggtgaaaacccgtctctactaaaaataacaaaatttagcggggtgtggtggcatgtgcctgtaatcccagctactcaggaggctaaagcaggagaattgcttgaacccaggaggcagaggttgcagtgagctgagatcaagccactgcatcccagcctgggtgacagagcaagactccatctcagg

SEQ ID NO: 223762 - DNA, 375 bp, Homo sapiens
gaagattagcaaaggtgctaatccagtggaaatcaggagaggtgtgatgttagttgttgatgctgtaattgctgaacttaaaaagcagtctaaacctgtgaccacccctgaagaaattgcacaggttgctacaatttctgcaaacggagacaaagaaattggcaatatctctgatgcaatgaaaaaggttggaagaaagggtgtcatcacagtaaaggatggaaaaacactgaatgatgaattagaaattattgaaggcataaagtttgatcgaggctatatttctccatactttattaatacatcaaaaggtcagaaatgtgaattccaggatgcctatgttctgttgagcgaaaagaaaatttctagtgtcca

SEQ ID NO: 223763 - DNA, 503 bp, Homo sapiens
tggaacagtttcatcctgaaaccattccccctgtcgccctgtccgtggaaaaattgtcttccacaaaaccatttcctggtcccaaaaagattggggaccattgatctagaatatttattccttccaatcatacattggtatgtcttcagataatccaaattaacctgaatactactttaggtcaagcattttcagaaaacacttgctaagaaagaaattatgacatagtcccggatgtcataatgtgacgtaatatgtcatactgttctcggaccaaagtgaggatcactctatttctcgtggcccaataacgagatgcaggtgaactggagaggaagagagtttttattttctgcaaccagttatagggagaaggcctggaaattattgccagaccaactcaaaattacaaagttttccagagcttatatgccttctaagctatatgtctatgcgtaagtgtgcattcatctaaatacataagtgattaacttcttttaatc

SEQ ID NO: 223764 - DNA, 322 bp, Homo sapiens
tatctgtacataatgtgtctttttttctttggctgcttctaaggttttctctttcccaattgtatcaatcaatttgattctaatgtgccttagtgtagttttctttatgttctttgtgttttcagtttgttgagtgtcttggatctatcagtttatgctttttgtcaaatttgtttcttttttttttttttgggaaaagaatttttcttttttcccccagcttgggtgccagggggggaatttgggtttattgaaagctccgcctccaaggttaaccccttttttttgcttaaacctccggagggggtggaatttaaggccc

SEQ ID NO: 223765 - DNA, 266 bp, Homo sapiens
gcttcatcatctcatcattaaagatttctttctttctttaaagaaaaaatcttagaaatctttcctgaatctaaaaaagaagtatcaaatggactaggaaagctttacagtaacaaggagttctggaagatgatttagtattcaatcatttgatactcagatgacaacaaagtctccctttccacacatgaataaaatgtcacattccatgagtttatttcaagaaggaatgtgaaggactaatattaaaaattcattaagaaaat

SEQ ID NO: 223766 - DNA, 522 bp, Homo sapiens
tcctataggtggacccagccgaactccgcagcagcccaggccagcgccccacctccgggtcaccggcatgatccgcctctccccgggcccccgcggccctggcacccgaggtcagcgggccgtgggtacagctcagccgcggaccctgctccgcgagtgcgggagctttggacttgaacgcgacgtgctcgcccggctcccaacaaacttgcaatttccgcgcgcaccccttaaacaggaactgttccccaaaccttgacccagctaccccgctgtgctctggcccgcggacctgtgtccgaacccgggctcggctgccggaaccggtttgagaaaacaaaagagttgtggggcagttttccctgtggggggcaggggcgcctcccaggtccctgcaccccgactcccggctgctcccctggcaactaatccggagaagggaagtggtgccacgagcccccactgcccggggagggagggagagagaagggggaactgggaaataaactgaattctcttact

SEQ ID NO: 223767 - DNA, 360 bp, Homo sapiens
agctctctatttagtgcttttcttccctgggaaataaaaggtgtgtttagaatctccaccttgttagtacaaccactgtgaagatgtctggaggtttctcaaaaaactaaaagtatgattcagctatccctcttctgggtatataccccaaagaaaggaaatcagtgtatcaaagagatatctgcactcccacatttgttgcagcattgttcaccatagctaagatttggaagcaacctaagtgtccatcagcaggtgaatgaataaagaaaatttggtttatatacacaatggagtactattcagccataaaaattaatgagatcctggcatttgcaacaacatggatggaactggaga

SEQ ID NO: 223768 - DNA, 362 bp, Homo sapiens
tggataaagggcataatcaagaccagctgggagaatgaggagtgttatatgtttagtgaaaatgtggaaaagtcattgggacaaattgtggagtcttgaatgcaaagccaagatgtagcctaagtcgaggagggatgtgatgaaggtgtgaagtcctccattatgcttcttcctgaaatttctctgaagtctgtctcctagcttttactccccattgcctttgctctgggtccagtccacattacctcttgcctggaccattcaaacagctcctgcctgattgctcctcttcctcaccttctccattgttctacatcaacttaaccttcctaaagcacatctctccatcagtgtttctctct

SEQ ID NO: 223769 - DNA, 541 bp, Homo sapiens
actgcctttcattgagtaggcactcaaatgttaaatttcattcttgtcctatattatgtgcccttatcattttatcacttaaagggactttactcagtgtcactaaccagattgactccatctatccttccatatttatctacagattgtctccatcaaagtgggtattaggaagctagcttgtacttgatgaacctgtttcagtttctcgtcctccctgaaaaggtttaccccaggcagtctggctatcagtgcagtggacctcacatctatgttggttatgtaggtggatggatgaaactaggtgggcctatgttccatcttttttctctcttttaggtagatgacagatttcccaagggagtgagggtctacatagtagcatcattctgtatgtgctgtgagatcagctcttggccaaagtaggctcaaatctacatggattagcctaggacctactttctcattattaccatctcaagaatgggtgttgtcattcaggttggtagtttttccctggtttctctaactgagctaggtc

SEQ ID NO: 223770 - DNA, 522 bp, Homo sapiens
cataatttcccactgttccttataggtctttgcatagaagtatgcaaacatacacatttgtgttcttaaaaacaccccaaaactccaacaggttaagctctacccatttgttctacacttcactttttttttcacttaacagcatgtcttgatgatcagcccataccagtatgtatataatgcatcattccttttgctggctgcatggtattccaccacaggaatgtgtactggcaggcagtattgcatagagaccaagaacctgtggtctgaatcctcaatttaccacttattagctatgcatcttgggtaagttacttaagctcactctgttttaactttcttatctaaaataggacgtataacagtacttaactcataaggttgttgttaggcacgtagaaagtacctaatgtattttatctgtcactatgtatagtaatttatttaaggagaccctattgaaggatagtgaagtttttgtcaacattttgcttttagaagcatcacagcaatgaatag

SEQ ID NO: 223771 - DNA, 603 bp, Homo sapiens
gcaccggcgcacacatcagccgccgcgcttccgggaagccacccatcagccggaggaggcccgcgggtgctgagggctctgccgccgctagcggggtggactccgcagggccagcgccgcagtctccgccccacgtcccgcgtgcccccgggcaccggcaccgggcgccgggcacctaccgtcctcctggtccaacaccatggtcccgacggctccagccggactagcgccgaggatacggaggggcgcgtggctccgactcccgccgccggccgcctgcgctgctcccgccggccccgcgcgggcgccgagtccggagagccgcgaccgccgacgggggcagacggaccggagtccggagcgcagccccgcgggcagggagcgcaggaggagggactggggggaaggcgcgggggcgagacggccaggccgggatcgcgggagcctcgcgagcagcagctgcccgggccgggccgcagccggagcctgagccgcgcgcgcgtccttcctccgcgccggccgtactcgcctcagcagagtgaaggctgcatttcccagggcccctcagattcccctgttaattaaatcaattcattatgctca

SEQ ID NO: 223772 - DNA, 719 bp, Homo sapiens
gtctaggtggcaaagccagactccgtctcaaaaaaaaaaagaagaggaaattgaggtcttgcatggcaaggcatcttggtttagttgttcttgtctcataaaacttttgacagggaaaatagaaagtcctgtttaatgctctgaaataaagctgatgtgtttgagctatcacccacgtagcttctagtcatggacaggtcttgtttgtagctagttaaggtatctgcaaggtgatgtctctgggtagcagcctctcctcctaaggagtatacagttgtccctcagtatctacaaggattgcttccaggacccccacagataactaaaatcaacagatgctcaagtcctttatgtaaaatggcatggtgtttgcatacaacctacacacatcttcccatatacattaagtcatctctggattacctatacctaatacagtgtaaatgatgtgtatactgttgttataccattttgtttacgacatgaaaatgatatgaaaaaaagtctgtatgtgttcagtacaggtgcttcttttcccgaatattttcagcctgaggtggttgaatccacaggtgcagtacccatggatatggagtgctgactgtatttgaaaatggtcacaaacatttcagccctattgcctgcttctctctttccaataggctgcaggcagttaggccttttatcccggagatgtgccacactttgaaattgtcata

SEQ ID NO: 223773 - DNA, 189 bp, Homo sapiens
ccactatgtttctcatttggtgttaatattgtggcctcagatttcctctcataattgcttcaataattacaatctatacataaaaactgaaactcattatttatgagcttgtagttctgttgtatgtgtacaagagctattcaaagaatagttgaaaaggaaaactatgaataaaatattattctcatg

SEQ ID NO: 223774 - DNA, 403 bp, Homo sapiens
aggtgtaagtaacaataaaacaaactaaaattggcttaagtaataaaggaatacaagatcttgcatagccagaagtacaaaggctgcagggatgcttggctcagcagttcttgtgttacaagggcatgacaggacaaagaccttatggccctagaatgtttgctatctgaccttttacagataatgtttgcttaaccctgacctaagagagcatcctctgatcatagaagcatattctcagccctctctaacaggtgctggaagctgggataggacagacactgagtttccgaaaattgaaaagtcccttctgagctttcttgcattgctgtgttccttggctccaagaggggttcgggggaagatgaagggcaatgcagcaaaggaggggctgaggagcaaa

SEQ ID NO: 223775 - DNA, 135 bp, Homo sapiens
aggcttattaaaacacattgccaggacttatatccagagtttctcactcagtgggcctggggtggggccaagaatgtgcatttctaacaggttcttaggtgatgctgctactgctaatccagggacaaccctctg

SEQ ID NO: 223776 - DNA, 374 bp, Homo sapiens
agctgagccaagagattattttcatttaaactataataactagcatcatcagagaataggtcctgctgcctaatttaacatccggttaacgaaagttaatatatgtatgtctctctcattcctctcctctccccgtctctcaatacacatacacatacatacaacaaacagaccaagaataaaactagctttattgtaacatttgtttagattggaaagttccacttaatcatgtatatctcctttcagaattctaaagcaaatgagaaatagatacataaatcacgtatggatcaatttattatcaacctcattattgttaatgcgggagtagaaaacaaaacgtgcatgagagaccaagcccttcccttccc

SEQ ID NO: 223777 - DNA, 402 bp, Homo sapiens
tgggtgacagagcgcaattttgtctgaaaaacaaaaacaaaaaaagctgctagttaagttttaatactcttgaaggcagtggaactgcatttatttaaaatgtttcatactttaggaatttagccatctttttccgtttagcaaaccaggaaataatttaagcaatatggctttatttgcagaaataatttttaataccagaatatatagttttgagaatttttgtctatcaaagcatttagtatacttgatgtttagtaaacttttttaaatgactaagcagtttaaaatgaaaaagataaaatagaaatatgatgtagtctgactataattgggtcaaacctttattgagagaagatacatttctcaggtcatcttccagaaagtggtatctcttcttag

SEQ ID NO: 223778 - DNA, 343 bp, Homo sapiens
acaagccataaattttacccactcaaaatgtacaattcaatcacttttaatattctcatagagtcctgcagccattagcacaatcaattttagaatgttttatcatttataagcaaaattcaatgtccatagagcagtcacttcccatttcccttcaattttcccactcctaggcaaccgttaatctattttctgtctctatagatttccctatttttgactttccacataaatggtatcatagaatatgtggtcttctgggactggcttcttttacttgacataatgttttcaaggttcatacatgttgtagtatatgtcagtacttcattccttttttttt

SEQ ID NO: 223779 - DNA, 238 bp, Homo sapiens
ccccaggaccctcccagatgctctgttggcagatgctgcccgctcgtttaagccaagtgatgccatttaaattacattgcaggcctgctccatgccacagctgtgcttcctcagccctcttgatggaatgctttcctgtaggcagcgccctgcacaagcagcctgtgccagcttggcacccctgacccagggctgtctgggtgtgagctgcaaggagcggggggcacaggtaggggct

SEQ ID NO: 223780 - DNA, 601 bp, Homo sapiens
agccattcatgagggatccacccctatgacccaaacaccttccaccaggccccacttctgatattggggattacatttcaacatgagatttggtggggacaaacatccaaacaatattaaatgagtcatctattgaatgtcactctttggggtggacaagggaagaggatgtgaagaggaacaagacatgggtcccagcctcaaggagaggggccatccggatatattgggctaaacaaagtatgctattaacatttattttactttttacttttctaaatgtgggaactagaagattttggctaatgaaatatgagcaaatttttacatttatggctcctattatatttctactgcattatattattctaaacagaagatacagcaagtgcaaaggccctgtggtagggaccgagcttcctgtgtttggtggttctgtactcagtctgcatgttgatacttacttgctaatgtcactagacctggagaggtgatgtgggaagccctgttgaacttacaagggggagtctatgagtctttgtcctttcttctcaagcagagagcaaggtcatgaaattcagcccttcagactgatgcctcc

SEQ ID NO: 223781 - DNA, 347 bp, Homo sapiens
caatgtcacatgacatgagagaagccttagagatcattttgcctacaaattctaaaatgaagcaggttagactgggatagagaggggaagtgatttacccaaggtccatcagctaggtaatggttttagctgttaagcctcagattgaacatactacattatgctttttttttttttaaagtcatagtataacatcagtaacaaaaatgagcatctcccttgccccagaaggctgccaaaagaatggaaagaagtgttttcattttttatttaggtacgtgtttatgtaaaggtgatggatgagtatttatacgaccagaacaatactacactgtatgaaaatggtg

SEQ ID NO: 223782 - DNA, 536 bp, Homo sapiens
gcactcactttttgtgtgcttttgtgcacagttctgtagcatttgatcccaggtaaccaccatcaataatcaagacatggaactgttctgtcaccacaaaagaactcgctcgtgctgcccgtttagagtcgcgctatccctcccctcaacctctgcaaccacttctctgggttccctctctacaattttgtcatttcaagcacattatataaaaggaatcatataataccttaccttttaagattggcatttctcagccaagtgtggtggcccacgcctgtaatcccagcactctgggaggctgaggcaggtggatggcttgagcctcagaagttcgagaccagcctgggccacatggtgaaaccccatctctacaaaagtacaaaaattagccaggtgcgatggcatgtacctgtagtcccagctacttgggaggctgaggtgagagggctacctgagcccagggaggttgaggctgtgttgagatcacaccactgcacttcagcctgggtgatggagtgaggtcctgtctcaaa

SEQ ID NO: 223783 - DNA, 372 bp, Homo sapiens
agccccagctctaactccaaacctgagagcacatgggaagtcattcttctgggccaacacagcaagtgcaatactaaaaactcatttaaagtccccagtatgtggccggccctttgcagacacttcacacatactctcatggccttaggagctgggtatatttttttttttccccagaaaagtgaggctcaaagaggttaaatccaagttgcccaaaaagatttgaacagacatttcaccaaaaaagataaacaaatggtgaagaagcacgtcaaaagatgctcagccttaaaatagttattagggaaatgcaaatcaaagcccaatgagataccacttcacacccacaaatatgactgttcttggttttaa

SEQ ID NO: 223784 - DNA, 914 bp, Homo sapiens
tcgatcgagctcggtccaatgccgacatacacccatgtgctgtgccctccctgtctccctctcccaagctcctgcatggaaacagaggtggacacgaaacctacctacccaccccctcccaggttaccgccatcactttcatcacaaaacagagtctggattcagggattcagcccagggcaggagctcaggtcatcttcctctttcagaagggagatttctgctgcctctggcccagcctttccctctctttccccccatgagctgccattggagcacccacctgggtgcaggtgagagagaggaggaaggagaccaggtgaccccttcctggctggttaccctatgtcccggtaacagacggttagagctgattctcatggcagaagcgtgactgccagagaccacctgcggcgcttctaatgctctggtccgtgtattcgtcttgtagcgttgccgagtgttacagagatccacagaccaggtggtttaaacaaaagatacttattctctcacagctgtagaggctacatgtctgaggtcaccgtgtcggtaggcttgctttctctctggcttgtagacgccgtcttctccctgtgtcctcacagagtccttcctctgtgtgtgtctgtgtcctcatctcttcttatgaaatgtcttagtctatttcaggctgctgtcacagaataccataggctggatgacttacaaacaagacatttattctcccacagtcctggaggctggatgtctgagatcagggtatgggcaaggctgattcctcctgaggtctctctcctggacttggagatgctgtcttctccctgtgtcctcacagagtccttcctctgtctgtgtctgtgtcctcatctcctcttcttatgagatatctagtccatttcaggctgctatca

SEQ ID NO: 223785 - DNA, 949 bp, Homo sapiens
ttttaggtcaagaaagactgtgacacacgtgtccagcacgccaagcacacagcccgtggggtgtcatccatgtgctgtgccctccctgtctccctctcccaagctcctgcatggaaacagaggtggacacgaaacctacctacccaccccctcccaggttaccgccatcactttcatcacaaaacagagtctggattcagggattcagcccagggcaggagctcaggtcatcttcctctttcagaagggagatttctgctgcctctggcccagcctttccctctctttccccccatgagctgccattggagcacccacctgggtgcaggtgagagagaggaggaaggagaccaggtgaccccttcctggctggttaccctatgtcccggtaacagacggttagagctgattctcatggcagaagcgtgactgccagagaccacctgcggcgcttctaatgctctggtccgtgtattcgtcttgtagcgttgccgagtgttacagagatccacagaccaggtggtttaaacaaaagatacttattctctcacagctgtagaggctacatgtctgaggtcaccgtgtcggtaggcttgctttctctctggcttgtagacgccgtcttctccctgtgtcctcacagagtccttcctctgtgtgtgtctgtgtcctcatctcttcttatgaaatgtcttagtctatttcaggctgctgtcacagaataccataggctggatgacttacaaacaagacatttattctcccacagtcctggaggctggatgtctgagatcagggtatgggcaaggctgattcctcctgaggtctctctcctggacttggagatgctgtcttctccctgtgtcctcacagagtccttcctctgtctgtgtctgtgtcctcatctcctcttcttatgagatatctagtccatttcaggctgctatca

SEQ ID NO: 223786 - DNA, 543 bp, Homo sapiens
ctgctctctggccttgctagggaagagagagtgagtgcacggcccctcgccctcccccttacccccaccctggagggggagacagatgttctgaatcccaggctctctgtgagttctacctgtcttccaggtgcagtgctagcagggaggacaaagagctgaggagtcaggccacaaggtcaagggaatgccttccctgcagcaggaagagccccatagccaggggagggccaagaaaccagggggagggaaccccaaactggagttggaagggacctcagggccataagccccaaatgctcacttcagatgagagaatgcaggccctgaacagggaagtgattccccagaaccccagaactcgcaggtcagtggcataaccaggacggaggccttccagatcctgggtccaggtccttcatgttatgcggtgctcttatgcctcctctgccagttactgtcctctgggcctggtggtcccctctgaggtagcagagatgcaggcttaggaggagctaaggaagcccctagagggcccctgca

SEQ ID NO: 223787 - DNA, 522 bp, Homo sapiens
taaacttggtcttagaacttagtgtcaggaactggtctctctggtttatctttgtcctttccccctactttagacttgtggacaatataatgtagtgcttaagaatgtgttggcagtcctgagaatgtgccatatggaacttgagagatagggagcataatggaccatgggccacagatgctgtgttcaagaactcacggcttcacttgcactgacacacacctcccactggctgctcctggttactgactaagcacagtagggagctaaagggaagccctgtcctgggagacagggaactcctctaatggcaactttggcctgaggactgtctgatggtcttgccaaaccttccttagattgccttgctgtccagatcacttgcatccaccctttcctttcctttttaaaaattctgtaatgacttatatagtagtttgacatctctccaattcttttctgacttctttctcattttaccatagacaatttctgaaataaaatacttatgttttttattct

SEQ ID NO: 223788 - DNA, 389 bp, Homo sapiens
gtaaaattaaaatactagctccagtcttccatcacgagtccactttacgttatagacatatccaatcccctttaggagaaaaaagaagttctatttttattttcaaggcaggccagcgcccaagttgtctgggcatggtacttcagccagcccagtaggcagccaggactgtggggtcatgagaacttccactctcagccccgggaggacctgggccaattatactgctagaggactttacaattttttggcaggatggggcatttttccctctatcagattcttggtcacataaagaatcaagcttgaggggttgggacttccagaaggacagagtcaggagctcagctgaccctctccgcagcaaacaacaatttgatgaaaattat

SEQ ID NO: 223789 - DNA, 395 bp, Homo sapiens
cagtgtggtctatccatgcaatggaatattactgggcaataaaaaggaatgaaatactgatatatgctccatatggatgcaccttgaaaacattacgctaagtgaaagaagtcaaacttaatgactacatatggtaggatttcatttacctgaaatgtccagaaagggcagattagtgactgcttggtgctgggggttgactgaaaatggtcatgactattcttttcatggatggtggtgaggaaatgttctaaaaactggattgtggtgaagactgcaaaactctgaaaatttattaaaaatcattgagttgcacttttactaggggtgaattttatggtatgtaaattgtaactcaaaaagtgttaaaaatgaagacaaagtggtatctgtaa

SEQ ID NO: 223790 - DNA, 402 bp, Homo sapiens
tccacttaccggatttcttttggataacaaagacaggtgaattccagatagaaaaagattgctcgatgtgtcccaattttaactgttcaaggatcaaaatatggagtgcctccagcttatttttagggagcggccactgatttacccaaaccggtttctgagttttccaagtcaaggggatgggatttggaggcttgatagtgaccacttctaaaaagaataaccaagtcccgtaaaatctgatttatgggtaggtataataggctcggtgatgccttgtgctgatttccctaagcccataacttgaacaaatcccatttttgtcataatgtctttactttgctggctgtaattgccttgtggaaaagaaatctgtgcccctcgttgttgtaaaagttctct

SEQ ID NO: 223791 - DNA, 427 bp, Homo sapiens
tgcgctgtggtgttttgatgtgttgcctacctgtttttattactacccaccagctcgctatcaagtagtccttgacctggctatcattgataggtacactagtcttgagtaattggtactttaacttatcaactacttttaaccactgtgtaaaaatgaaagcaagaatagtacgttaataattgccaggcattcccttctgtactgtacatacaaatagaatttttacacatgtgcctgtatgtatatataggttgagtatccctaaatcagaatatgtgaaatctcaaatgttccaaattctgaaactttttgaatgtgaggtgacattcaaaggaaatgttcacgggtacatttcagatttctggttttcgaatgaggggtacttaactagtttagtatataatgcaagtattttaaaatgaga

SEQ ID NO: 223792 - DNA, 572 bp, Homo sapiens
ctgagaataacactgaaatgatgaaaaagaagacctgatgcttgaagagatacttgtaatcaggatgcaagaaagtggaaaaagagccatttttggagtcaggctgacaagagtttggatataagctccgtctctagatagatgaccttaggcacatttcctatttttgcccaacttcagtttataaactgtaatgtggggataataatttagaactgtaatattgttgtttgaattaaattacattccagctttgaaaactcctaaagagtgtctggtctatagtacacatttaataacactgtctaaggggagctcaaccaagtctaccccgagataacaaaaacatgcttagttatggaggaagttggtaccctagaatatagctaggaaaaggatttctctcttttcaagttggagcaaggaaagcatttccttctcctagagcttttatgttgctgcctacattaaatttgaagatgagaatcattagtaggaaaaaaatgtaaaaggaagaaggcattgaaaaagaaacaagtacaagatgcactctcagctttctccttcttcta

SEQ ID NO: 223793 - DNA, 379 bp, Homo sapiens
acatctctggcctccccaaacagatgtccaacatcccacccattctggcttccctgctttttcatggagacttttgtcctaccacttctgacccgggagtccacagaagaacaattcaggtcagtttctggaacagtccttccctggagtctctcttgcaagaccgttgcctctctgattcccgcacagctccatctcccaggcacgaggtcccattttattatcaaacatcaactgcatctccccgtcttggccagacacatccagaaatgcagggccagaattatgacgtgccgacttgccttcataaataatattttgcaatttccttgtctgggggcatggataaattattcttccacgtcaaggttacgatgat

SEQ ID NO: 223794 - DNA, 621 bp, Homo sapiens
agatgactaagtgccttgttccctcactaaatatctctgtaaaggaacccaaaaaaacaccttttgtcctctttaagccataaatttatattaataatatccaaatccatgttgaaccagtatttttgaagattgaccttcaggataaactaatagcacaatcttcatgccctttcattcataactaactgaaaaggttgacttttgtaccaggaacccaacgaagaaaacttgtatcttgtcagggttggtaacctggctgccattgactgagaccaaaatatcccaacagtttgtcctcagctgctaagctgctgtggttagaatcaaacgtagagtttctggcctggtgcggtggctcatgcctgtaatcccaacactttgacagtcctaggtgggaagattgcttgggctcaggagttcgagactaaactgggtgacttagtgagagttcaactctacaaaaaaatcaaaaaattagctgggcatgatagcacacgcctgtggtcccagctacttgggaggctgaggtaggagaatcacttgagctcagacagttgaggctgtagtgaccgtgattgtgccactttactccagcctgggcaacagagtgagacctcg

SEQ ID NO: 223795 - DNA, 468 bp, Homo sapiens
ttctggacccacagtccgcctcgctcttttactttagaaggaattgctccaagcagagtctacacaggtttcccctgtggcttttcttcagagagcgtgttgaccccagctagtgtcacggttctcacactgtgatctcagggccgttgacattccccaggattacggaggacctcagagagctttcccttttgaaactcactgttgcagagtccagacacaaagtggatcttagaagtctagaatgtgaagctgactttgggttgatctggaggtagtgatccttggaaaatttggaaataacctggcaaatgtcacctcgtgagctggcaagcgttttgtgacaaaaatgacaaaggcttgtgaccagaagggtccagactgacccctgcgacccaagccagggaagggggacaaaaaggaatggacagctgtcctgcaggaagcagcctgacctgagagctcccc

SEQ ID NO: 223796 - DNA, 432 bp, Homo sapiens
gtttagtgccttttataaaagaatatttaattcagttgaaacacatggatgaactaggctgaagagaatataaattatgattatttgggacagtctgaaacttattttttatttcatgaggactgtggcaaagtagacacttgaagataggctgggtgcaagagggagactccatctcagaaaaaaaaaaaaaagctgattacactataggtcaaagattattattaagtgccaccagagtaatacaaaaagaatcagcagagggaaagagtaattttttagaggagttacttagaatttctctgctgagtttgagagaccctggaagaattgatcagcagagtttaaggggaggacttccaggtcacgggaaaatcttaaccaagggaatggcagcagaaaattgtagagcagactttcattttgcttagc

SEQ ID NO: 223797 - DNA, 413 bp, Homo sapiens
tgacacagagattctcaactagagggcagggtgccctggtatttttaattcttatttatctccttgtggagatttaataatgtggaccattttaaacctcatgttaaaaatagtttcttttggccgggtacggtggctcacgcctgtaatcccagcactttgggaggccgaggcaggtggatcatgaggtcaggagatcgagaccatcctggctaacacggtgaaaccccgtctctactaaaaatacaaaaaattagctgggcgtggtggcgggcgcctgtggtcccagctactagggaggctgaggcaggagaatggtgtgaacccaggaggcggagcttgcagtaagccgagatcaccccactgcactccagcctgggcaacagagtgagactccgtctcaaaaaaaaaaa

SEQ ID NO: 223798 - DNA, 1186 bp, Homo sapiens
gtgcaggttagttacatatgtatacatgtgccatgttggtgtgctgcacccattaactcgtcatttacattaggtatatctcttaatgctatccctccccccaccccacaacaggccccggggtgcaatgttccccttcctgtgtccaagtgttctcattgttcagttcccacctatgagtgagaacatgcggtgtttggtttttctgtccttgcgatagtttgctgaaaatgatggtttccagcttcatccatgtccctacaaaggacatgaactcatcattttttatggctgcatagtattccatgctgtatatgtgccacattttcttaatccagtctatcattgttggacatatggcttggttccaagtctttgctattgtgagtagtgccacaataaacatacgtgtgcatgtgtttggatatatactcggaagtgagattgctgggtcccatgtgcaatagcatcaaaaagaataaaatgcttaggaataaacttaaccaaagagataaaatatttctacactgagaactacataagattaataaaagaaattgaagaaaacacaaataaaggggaagaaagcccatgttcatggattgaaagacctactactggtaaaatatccatactatccaaagcaatctgcagacacaatgcaatccctactaaaatcctaatggtattttctacaaaaatttttttaaaaatcctaacattcatatggaacaactaaggactccaaatagtcaaacacaaactttagaaagaacaaatttggaggcatcatacttcctgatttctaaatttattacgaatttacagtaactttaacagtacagcaatggcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaaattaacatgtcacaatgtaacggatgaccatatgcacaattccatgaattaaatctgtttcctgtgttagtcagtattcttaaataaaatttataattg

SEQ ID NO: 223799 - DNA, 381 bp, Homo sapiens
aaaaaaaaaaaaagaaatattaacagagattctctgggtattcaagtcttatagaattccagctgatatttgaggaatgaacttttatcagatatttgatacattttagaaagagaatatttctaattttgtaaccccctaatgaaataatggatctcaccctcctaagaacacaccaccaccagtttactcttgccaaaaaatggaacctgatctgcctctggactagacaggaaatgtaagaaataggacaacatgttaaaggctgggcatggtggttcacgcctgtaatcccagcactttgggaggctgaggcgggcggatcatgaggtcaggagatcgagaccatcttggctaacacggtgaaactccgtctctact

SEQ ID NO: 223800 - DNA, 335 bp, Homo sapiens
ccagccctttgggaggccaaggcaggtggatcacctgtggtcgggagtttgggagttcagcctaacacagagaaactccgtctctactgaaaataaaaaattagtggggcatggtggcgcatgcctatagtcccacctcctgagaagctggtactgcatgtgcacaccaccacacctggcttaaaaatgttttttgaactaatggatgaacctgtattccaggttgttgcttttcttttttatgacaaggtctcactctgtcaggccatcttgaaccaggaggcggtggttgcagtgggctgagattgcacaattgcactctagcctgggcaaca

SEQ ID NO: 223801 - DNA, 449 bp, Homo sapiens
gtaacgctcaaagtagtattggcaaaacagagtgctgaactgattgtcagtaccctgttttcccagcgtgtttattttatgactctaagcaaagcagttgagcttactgaacgttcactcagtttctccgacagtgaaatgaggaaaataaggcctgctcacgtactttatcatcactcaccatgaggtggggtgaggcatgggtgaatgaatagcagaacatttttcaggagaaataataccctccattctggctttcatgctttctacctaataggtagttgctattgtgaaaatgcacatattcaagtctaaaatcaagtagctagccatatgactttaggccatccacttaacatttcttgttttatttataccaaagagagagagagagagagggagagttaggctgaattaacttgatgttggacttttttgcggggtgggga

SEQ ID NO: 223802 - DNA, 331 bp, Homo sapiens
gcctttaaaaaaggggcagctttatatcctgatatgtcacaatctccaagttatgtttggtgtggtagggaacgtggggaacaccgtggataatatctaccttttgtgtttttaaaaaaaaaaaagcaagaagaaaatgtatgtaggtgtttagaaatgcatggagctgtctctgcaagcatatgccacttaacaagagttccctacggggaaagagaattgggcatggaggacaagggaacaagggaaatttgcttttctctctctacttattgtaccctttgaatgttgtcccatgtgcaagtattattaaatacattagagaagaaga

SEQ ID NO: 223803 - DNA, 252 bp, Homo sapiens
tgaggtgatgtggaatacatttcaaagttgttccatccagggggtgaacatattgaagcatttatagcctggctcccatccgtcactggctgaggaatggtcccagggcatcaactctctggcttttttttttctttttctttttcttttttagacacagtcttgctctgtcacccaggctggattgcaatggcatgatctctgctcactgtcacctccgcctcccgggttcaagcgattgtcctgcctcag

SEQ ID NO: 223804 - DNA, 813 bp, Homo sapiens
agggcagggaacatcacacaccagggcctgtcgtgggggagggatagcattaggagatatacctaatgtaaatgacgagttaatgggtgcagcacaccaacacggcacatgtatacataagtaacaaacctgcacgttgtgcacatgtaccctagaacttaaagtataataaaaagtaataataaaaacacagtgaagctaagcactccggagaatgaggcccggagaggagcagtaaggctggagggcaaggtagatgcctggggcgtttgggctttctgcaagttctgtaggccttggggccactgaaagtgtttaggggcactcattagaaaattgcatttggaagtgtttccatggcctggactaggctggctgatgaggacaggaagaagctactgcaaagcccgctataataggacctgagcagggacccgtgagagaaaggcttaggaggcagaaaggatggtactctatccgtagcccaacctcatcagccagtgttctgtgactcatttctatttgtacaggcagtacttgtactgttcattggttttggttcttgtctcttgtacaatattgaaaggatcttggagacaggaacgcaattgcttcttcagtgttcgtttagcatcgggcaggtcagaattatttttgcaaaatggctccatcctacggccatgtcacaccatgtcatgcaagccttagccctcaccaggaaggttctgtctgttgcaccacattcatccacattctactcacaaacactggtcattgtgttaggcgatttggtagtgcccctgggtgatgtgt

SEQ ID NO: 223805 - DNA, 331 bp, Homo sapiens
ctgcttattctgtttctagtaactcttacagaaacaagtgtagtcagtagccaacatacatccatgtcagcctatatatgacttactaggagggcttagttttttaaaagagatgaaaaataaagagaaggtctagtattttcctcccacattccaacagatcattttatgtgccccctttgggtgagcacattccatgttgtagaccattgatcatagtagtcagagcatggagctctggagttcagaaaaattattttattattgttgttatgacaaaaataattaccatgtaaaggaaaagaaaagaaactcagcgaaaaaatttatg

SEQ ID NO: 223806 - DNA, 451 bp, Homo sapiens
accaatggtttgttttgagcttatcttcagttgtttggaagcaacctaattgctcaacacataggaaagggcctcattcacaattctgtcatcatgagtactacagagtctgttatgagtaggttggtttaatacacgggaaagtctaaggacatttttattatgccccaatacttgtttgaattggtaagtactgcttagtatttagtaacttaggaaactcttgggttcaatgggtgactgggaatacagcaagtagagttccatgttgaaccttggtagtatccacatctaaatcataaattactcaacaggagaaaagaaaatttatttttgtttgaatttactcattccatattgagctccatcatataccagacactatgttgaccctagctatataaattagaagcagacaattttgccattcttgacattggaaacaagagaa

SEQ ID NO: 223807 - DNA, 430 bp, Homo sapiens
aagagatctaagggagcatttctccagttatccccattcctggttgttttctatttctagatttcaaagcaggactcagtaaactaagtcaagggaattctatgtccggtgacaactgtcctagtgatatttcattacctctctctaccccatttattcccactgctctgcagtggtgtcttgggtctcctactcctagctcaccctccgaggagctggcaatcaagtacctgaatccctaaggagttgacagtcaacagtacctacttgagtagtcactgtcaactaagtactgcacaagggcaagatcacatctaggtgggttacaaaaaaattatctttcttaaatgatttctgggttacaaaaaattattttccttaaatgatctcaggtgcacagaactggattaaagctcaagcactcaccaaa

SEQ ID NO: 223808 - DNA, 502 bp, Homo sapiens
caaatcgtggttgaggtcaattgccgactgtttactgagaggatccatcattggagggcactgagggagctccaggaagcatgccttcatgcaacaagcatgcattgagcacctcctgtttatttttcaaatttattattatttttaaatttatttttctttcaataggtttttaggaagcaggcggtatttggttatataaataagttctttagtgagcacctcctgtttatgaggagaaactaggtttacaaatgagacagtgacaaatgccacaaggtgacactggtggggttttatctggggaggatgcttctttccattcccagtttggtttcaactgagaatttaaaacatgagagaggctgggtgcattgggctcacacctataatcccaacactttgggaggctgaggcttgcatattgcttgagcccaggagtttgagaccagcatgggcaacatagtgagaccccacctctaattattttttttacttaaaa

SEQ ID NO: 223809 - DNA, 414 bp, Homo sapiens
caaagtctctgtggcactgcatttggaagcttctaaaggctgcctgcattccttggctcatggcctgcatcattccaactttgcttctgtcatcacatctcttctaactctgacgctcctgcatccctctataacaacgcttgtgattacgttaggtccacctcataatccaaggtcattgttgagagacaaaatgagatcatgtctgggaaaatacttctaaattatcaactccctttctatggaagagggatgaccaaagaaggatgcactccttgtctggaattatgccagaggtcttaaaatgctcagaaatgaaatcagccttcttccctgtcctaagaggctcaggttttcggcaagtaactcataaaattaatgctccactgaaaataaaatctgatttgagtagta

SEQ ID NO: 223810 - DNA, 570 bp, Homo sapiens
cgtgcacagagaggcacagcccgcaggaacacagatgcacgcacacaggcacaggcacgctccctcactcactctctctcacacaccccaggtgcagacacccccacccagaggttgcagctcggatggagaaacaggctgggtcacaaaagccccgggaggcagcccctgctgtctggcgtcttctctggggaaagctttccggagcctgatggaggaagacagaggaaagagacctgtgttccctgatgcactggccagccgcttcccggggaggaggaggcagaaatacacagtaactgattgttgcctttggtctgtgaactgtactatggaacactggaacttactccttcacctgactgcatgtttgtgccccataaccagcctcactttctgtctgcctctcacccacacaccctgcctagcctctgggaaccaccagccaactctctgcctctgtaagagccactctttcagtgcccacaaatgagtgagaacatggtacatttgtctttctaccccggcttacttcccttaacatgacagccttcaattccatccatgttg

SEQ ID NO: 223811 - DNA, 455 bp, Homo sapiens
tctagaagcacccattcagaagacagttttgatagcaaatctaccgtcagagccaagagcaacacacttgacctctttgtttgagttacaaaagggcaccccactttctggctgacaaagctccacaccagaacatagagaatactgcaggtagatcaagagctggattttgctgggccaagtggctcatgcctgtaatctcagcacttcgggaggccaaggttaacagattgcttgagcctaggagttcgagactagcctaagcaacgtagtgaaaccccatctctacaaaacatacaaaaattagccgggcatggtggcacatgcctgtagtcctagctactcaggaggctgaggtgggagtatccctttagcctgggaagtggaggctgtagtgggccgagatcatgccactgcactccagcctgggtgacagagcaagaccctgtctaaaa

SEQ ID NO: 223812 - DNA, 486 bp, Homo sapiens
gtgggcaatggaagtctctttaggttggatacagttacctttggacatggtcccattaatttggttggttctttgttttcttgtatgatgaaatgtttcaggcttatctggtacatttcccagtcttcatatggaaccagccatttctctcgagtcctggttcttttacatgagaaatggtatttagagatcatggtctgaccactaaagatgttcattgctactgggttgattattgtttttaggccttttcaatgcgtagagctaggaattttttttttcaatgagaaaatatgagttcatactatttaccattcagatttatgaatataggctcttcgattttattactgcgcctcttctctctcacattgaaaatcatggcttcaggttgggcacggtagtttacacttgtaatcccagcactttgcgatgctgaggtgggaggatcacatgagcccagggattcgagaccagcttgggcaa

SEQ ID NO: 223813 - DNA, 555 bp, Homo sapiens
tgtaggcaagttctaccacaacttcaagaaagagataaccctatcttacataaattgttgtagaaaatggaaaaaaaaagttgtgagttcattttatggggctagtgtaactttgatactatattaccaggcagatataatatgagaaaggaaaactaaaggacagtttcacctaaaacatagatgcagaaattataaataaataaataattagctaaataaatccatgtgaaaaataccaaattgaaaacatcctgaacatgttggctttatcctatgaatggaaagatggttttaacattaggaaatctattaatataattaaccatattaatagactaaaagaaaaaatttgttgtgatgtaaggggaaaagcatgaattatatatgattcatgacaaaaactcgtaaaactaggaataagaaacaaccttcttaatatattagagacccgcaggaaacatttagtggtgaaacattaaaaatattttaacacttaaaataatgaatgaaataaatacatactattttgtctgtcaatttaaaaaataaaaa

SEQ ID NO: 223814 - DNA, 434 bp, Homo sapiens
gcacgagattcctgtgcaaaatgcacagccagatattccactctgagaataatccaggaacaaacttgcttgcaaaagcaggggaaataatgttgtgtgactaacttagtttcacttaaactcatagtaaagatcaccagttggggcatggaaaaggtaagagttagagataaaaaggaacataacgattatatgagaagttgatgtttataaaagaggttgatccatttatccaaatatgtgtgtttgcagccgtaggctgtgtctgccctattatgtatcctttttggataaggtttttgtttcgtttcgttttgtttatttgtttgtttgtttgagatggagttttgctcttgttgtccaggcggaggttgcagtgagctgagatcatgccactgcacttcaacctgggtgatagagccagacttgtctca

SEQ ID NO: 223815 - DNA, 562 bp, Homo sapiens
cactgtccatattattgagtcaaaatgcaagtttctaggtaaatactgctggtcaaaatttgaccttaaaagtttctcattatatagaagctttaattgaaaaacagcatttaattgaaaaaattgctatttaatcagtaatatttaagtaaaatgtgcgaacataatgtcacaaactgtataaatacaaagaaaatatatatgtgacaaaaattagcttgaaataaacctgtatgcccttaaaacataactatttttaaaatgattgaaaatgtatttcttgcctccaagaaatctgactgtgatcaaagaataatcccacacagatctgctaatttttaacatttccttcaaatctttttagaataaaaagttataaaatattacagatgaagttgaagtcctcaatagtttcattaccatctctcattccaaaggcaattactttaataaattttaaataatttacatatattttaatttgtatgtctggacaataatattgttattgtgtcttcaaagttatttataaatggtgtcaaataaaatatgccattctgta

SEQ ID NO: 223816 - DNA, 488 bp, Homo sapiens
  misc_feature (457)..(457): n is a, c, g, or t
aaaacataaagtggagaaaggacacccttttcaacaaatggtgctgagataatcggctagccacaggtaggagaatgaaactggatcctcatctctcactttatacaaaaatcaactcaagatggattaaggacttaaatctaagacctgcaactataaaaattatagaagataacattggaaaaacccttataaacgttggcttaagcaaggatttcatgacgaagaatccaaaagcaaatacaatagaaacaaagataaatagttggaacttaattaaagagcttttgcatagcaaagaaacagcaaagtaaacagacaacccacagagtgggagaaactctccacattctacacatctgacagaggactaatatccaggatctacaacaaactcaaacaaattagtaaggaaaaaaaaatcccatcaaaaagtgagactaagcccatgaatagncggttctcaaaagaagatatgcaaatggccc

SEQ ID NO: 223817 - DNA, 332 bp, Homo sapiens
aatggagtctgagctctcagcaatggcatgttaactgtactcaaagttattaaatctcaaacatgtggaaaagaaaaagtcataatgctaccagtggagaggagacagtgcacacgaaatctatgaatgtgaagacagcatgttgggaaatgaagcaaaagggaatttttcattacttgtatctggttttatgttacagtgaaagctatctggctactacagttggttttatgtagacctcatctataactacctaagcactccactgggctaaaatttaatcaaatatcttggtttctagttagtagatttgtggcaagcatcagtgattt

SEQ ID NO: 223818 - DNA, 552 bp, Homo sapiens
caatgggaagggaactcattctgggtccaaacaaaaagctggttggtgaccttaacgaatacaaccacgacatgtttaagactgtctgcacacgaaaatcagcaaacatcaaagatagcattgcacaatacggagtgtggcacatccagaaaattcagggggaatgaaattgcaaatgtaagggatagagtcaaagactgcattttaagtttatttccacccaaactggttcttcctctgccatggaataaggaacaactcagcaaagggagagaaagaaagcaaagcaatgaggagtttcagccgcctattctttcaggggaaagctggcgtgtgcttttcccaaactcagctataggcagaaaaccagaagtgaggccgcttcatcaggaaaaagagatgcagacagcccaagttacacaaatccctgagccttgtctgcacaagggtgtttcatttcatgtggctgctcagtatgtaaaggatgaaagtctcattttaagtaaatagtgacatggactgtggtgttgattaacaatcaaccatgtctca

SEQ ID NO: 223819 - DNA, 522 bp, Homo sapiens
  misc_feature (356)..(356): n is a, c, g, or t
  misc_feature (458)..(458): n is a, c, g, or t
ggaaagattaatttgcccaaggtcaaacaactagtaaaagaagtaaggattccaacccagatcttttgactctattatccttacatatagttttatagtgatttaaattgatacaaggataggtttaaatacaagtagagagaatgtaggttcatataaaactgattttatcctcatgttagaaaacatatacactgtaacagagggaggaccatcaagtgaccaagatattttagtcaaaagatgaatttttctgcaatttgaaaatgccaaaaatattcaaagaaaatataattcttgtaggcagtcttctatcaaaacccactgaaccaccgggcacggtggctcgcgcctgnaattccagcactttgggaggccaaggctggtggatcacctgaggtcaggagtttgagaccagcctggccgacatggtctctactaaaaatacaaaaaattgnccgggcctgatggtggcgcctgtagtcccagctactgaggaggctgaggtaggagaatcgtttg

SEQ ID NO: 223820 - DNA, 431 bp, Homo sapiens
aattgcaactcggtttatttaagcatctatcatggcagggtaaacgaggcagtttatctggcacctccattttgcttgttgctacctttatggtgtgtgtgtttgtgtgtgtgctctcacacaaagggggatgcggccggggggcgccgttgagagaggaggttaattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggagagctgagaaacttgctgggaaggttctgggctgagggtggcctcttttggttgggcgccgtt

SEQ ID NO: 223821 - DNA, 606 bp, Homo sapiens
atataattttacttattgctaatagagaaggcagtttattcttgtttgcatgtcctaaaaaccagtattcatttctttctaaaaatgtttatgtagactgggcacagtggcacacgcctgtaatcccagcactttgggaggccaaggcagaagggttgcttgaggccaggagtttgagactagcctggccaacatagcaaggccccatatctgaatgaatgaatgaatgaatgaaaaacaaaggagattattatttccaatagtcttagtaatggaacatttccagttttcttgaggaatgagtttctttggttttaatgaattaaaatggcctttggaagtcccctccctctttctgagtctcttctccagatgagtttggtatccttaaattgtccctgatactttttcttttattcctctctcgttctcattcttttcctattttaaaaattgtcatatggaattgttgcatacactccttaggaatatgtcacactagaattaggaggtatccacgaggttatctaatcaaatcatttcaaaatgcaggaattccttctatagcatctgacaggtattcacccagcatctgctaaaatactt

SEQ ID NO: 223822 - DNA, 641 bp, Homo sapiens
aacatgtcgaggctcatactgtaatcccagtgctctggaaggcaaggtggtaggatcacctgaggccaggagttcgagacaaacccgggcaacacagcaagaccccgtctccacaaaaatttaaaaaattagctgggcacagtggcacacgcctgtaatcccagcactttgggaggccaaggcagaagggttgcttgaggccaggagtttgagactagcctggccaacatagcaaggccccatatctgaatgaatgaatgaatgaatgaaaaacaaaggagattattatttccaatagtcttagtaatggaacatttccagttttcttgaggaatgagtttctttggttttaatgaattaaaatggcctttggaagtcccctccctctttctgagtctcttctccagatgagtttggtatccttaaattgtccctgatactttttcttttattcctctctcgttctcattcttttcctattttaaaaattgtcatatggaattgttgcatacactccttaggaatatgtcacactagaattaggaggtatccacgaggttatctaatcaaatcatttcaaaatgcaggaattccttctatagcatctgacaggtattcacccagcatctgctaaaatactt

SEQ ID NO: 223823 - DNA, 250 bp, Homo sapiens
tgatacagaatatattttctaaaaatcacgctgatttatgacacattactctgaaatacacatctcaagtccttaaaagaatatatgacaactgtaagaagccattttagataagtaatttgaaacattcttttctacttccaaatgacttttttcctatcccttatttttgaaatgtttattcaataaatatgtatacagaactgatgaaataattaaatcaataaacggcatatcctgccctgaagtt

SEQ ID NO: 223824 - DNA, 579 bp, Homo sapiens
tctgaacatttccagataaatggaatcatacaatatgtggtcttttgtgtctgcctttttttcacttaggttcataatgttttcaagatttatttatattgtctcatgtattagcactttggagatttttttaatggctgtataatattctatacggatataccatgttttgtttatccacttactagttgatgaacatttggattatttctaccctttggctattatgaattatgctactgtgaataatcctgtgtatacctacaggtgaactgctgagttaagagtctttttggcctggcgcggtggctcacgcctgtaatcccagctctttgggaggccaaggtgggcggatcacttgaggtcaggagttcatgaccagcctggccaacatggtgaaacccgatctctactaaaaatacaaaaaattagctgggtgtggtggcgggcgcctgtaatcccagctactcgggaggctgaagcaggagaatttgctggaacccgggaggtggaggttgcagtgagccgagattgtgccattgcactccagcctgggcaacagagcaagactcgatctca

SEQ ID NO: 223825 - DNA, 495 bp, Homo sapiens
tctgaacatttccagataaatggaatcatacaatatgtggtcttttgtgtctgcctttttttcacttaggttcataatgttttcaagatttatttatattgtctcatgtattagcactttggagatttttttaatggctgtataatattctatacggatataccatgttttgtttatccacttactagttgatgaacatttggattatttctaccctttggctattatgaattatgctactgtgaataatcctgtgtatacctacaggtgaactgctgagttaagagtctttatgagccaccgtgcccagcctgttacaccattttatataaaggatttgagcatcctgaaatgttggtatctgtaggagtcctggaaccaacctcctattcgataccaagggacaacttttcatttttagctatgataaagtttataaattaggcatgagagactagcaatgataactaataaatagaacaagtgtaactatag

SEQ ID NO: 223826 - DNA, 334 bp, Homo sapiens
gccctaggcagagggctggggactgcggatccgtccctgaagcgggacgcgaaccggcagagttgggagaagagcctccaaccccaggagccgagcatgtgcgtatcaacaaaatgaaactcggggagacaggagggcagatagctccaggttctcggagcccccgcccgggccgctcgacctccccaccgtacccatctcccgccgcagcccctacgcccggccggagcccgcggggaagttgcagccctggcgcgcccccgcccgcccgcgccccctcgccggcccgggggcgctttgccgcagtcattaataaagaaggtcgccaagctca

SEQ ID NO: 223827 - DNA, 292 bp, Homo sapiens
tgagcccagcgcgaggtcatgtgcaccggctcagcccggttcggcgcccggacgtgctgcgtatcaacaaaatgaaactcggggagacaggagggcagatagctccaggttctcggagcccccgcccgggccgctcgacctccccaccgtacccatctcccgccgcagcccctacgcccggccggagcccgcggggaagttgcagccctggcgcgcccccgcccgcccgcgccccctcgccggcccgggggcgctttgccgcagtcattaataaagaaggtcgccaagctca

SEQ ID NO: 223828 - DNA, 429 bp, Homo sapiens
catcttaaccttaagatgaatagatgtaaccatatggatatacatacatgtatgtatatacatgtatcattttagctttttttttctgtcagaggaaagctgcaacatactaaagtttgacagtaatccctagaatcttaatttgtaaaaagtaaaaaactacaaggtttctactttcaaaacagttatagtctttactcaaaatgtaaattaataaatgtataaagtttgtaatagtataataatgtataataatagtataaatgaagttgcataacctgcttttaaaatgtgtgtaattttatgtatttgacaacttaagcatgataaacacttaactgtttatattctacaagctcagtgtaatgtaaaaaatttgctaaagtcattttgttttaacttcaagtaaacaatgttttctgaattttt

SEQ ID NO: 223829 - DNA, 2139 bp, Homo sapiens
  misc_feature (1542)..(1542): n is a, c, g, or t
  misc_feature (1578)..(1578): n is a, c, g, or t
  misc_feature (1588)..(1588): n is a, c, g, or t
  misc_feature (1590)..(1590): n is a, c, g, or t
  misc_feature (1632)..(1632): n is a, c, g, or t
  misc_feature (1651)..(1651): n is a, c, g, or t
gaattcatgtttggatgtgttaactttgagatgcctattagacgtctaatggagacagcaagtagcaattgaatgtacaaggcaggaaagagggctgggataaagatgcgcctcttagagatatcagcgctttcagccatgggactaactgggatcacctgggagtaaatatacactaggagtgggctgagaattgagcccttgggctccctggagtttagaggtcaggaaaatgagggcaatgtcataaaggacactgaggaagagtagctggagtagaagaaaaaagagaatggcattcattccaggggtcaagtgaaaaaggatgtaatgagtttcctcaaatgctgctgctagagtaagatgaggactgagagttgactactgaatctagcaacatggaaatggtgaccttgacagaaacagtgtcattgaagtgagagcaatggaagcaaactcaagcaggtttggactcagggagtaaatggctttgtaggggaagcaaaatttccttctaccctcttcagttctgttgttggtccaagaattaaactgacataagacagattaacaggagaaaagcataccaattttattaatatttttacacggacgtggcagtcttcaaaagggaaatgaagaccctaggaagacagtaggccgtgaagcttatatacattttcacgcaaagaacaataaattatggggatgtgacaagacaaaggggcttgggcttggggcattaaattgtaggacagtgcctaggaaatacatgggggaaattaacgaaagacagggtcgttttggtagtttgttgtggaagtccatttcggcatcaactcctagtctctggtgataagaatgttctcttcctagtacagggaaggcacctttttcatggaaaattttatgatctgtttttaggtagaaatgaggaggtcagagagcctatgttagtttgttttgcatcgctgtaaaggaatacctgagactcagtaatttataaagaaaagaggtttaattggctcacagtttggcaagctgctcaagcatggaaccagcatttgcttggcttctggcgaggcctcaggaagtttttactcatggcagaaggtgaagcgggagcaggcatgtcacatggtgagaaagaagcaggagcgagaggaggagcttccaggctcagctctgcatgaatgaacagagtgagaactcactcattatcgcagggacagcatgaagacattcatgagggatctgcccccatgacccaaacacctcccactaggctcatctctaacactggaggtcacaatgcaacataaaatttggaggggaaacacatccataccatatcagagcccttctgcatgagctgtttctcaagtgccttcagattaaaataatcaatatgccaaaacagcatattttgggatggcacgaatcccttcagccccctttttttttgggaatagagtcttgctcttgttgcccaggctggagtgcagtggtgccatctcagttcactgcaacctccacctcccnggttcaagtgattcttgtgcctcagcttctcaagtngctgggattncnggtgtgtgccaccactcccggctaatttttgtatttttagtngagacaggggttcaccatnttggccaggctggtctcaaaactcttgacctcaggcgatccacccacctctgcctcccaaagtgctgggattacaggcatgagccagtacacctgttccccttcagctcttttgaggagttttgctgtcaatatgaacactggaacagtggctggggaggatgagatctcaatacttccctgacatcccttaagactcaagtcttgatactttgtctgctctctggctctttctttgtcattactattatttttatcttcttgatgttgactcttgctaaaattttttgtcttccttattgttaatgcttatagaaaatgattccttgttatcttttagcccatgtcatccgaatcatttgctgtttctagcctaggtgctttgactatgccagcttgtatttcttcagaattttcattaactatatgtgtggtattgtaggcattacatattttaaaataaatttagccattgcttcaatcacatcc

SEQ ID NO: 223830 - DNA, 220 bp, Homo sapiens
aagaaaaggaagaagcagcagcagaagtgattaaacttgctcagcgtaagatgggattcctgcagcctggaggtggcgtttcatttactgtggcagttacataccttcagttgatctgctctgatcagtagcctgtttatccccaccaggtgcttttggccctttgggcttccacatactgacctggtttttggctcatggtgttatctgttggggttta

SEQ ID NO: 223831 - DNA, 422 bp, Homo sapiens
tgctgtcttgccttcccccattccatcagttgccattgcaacgccaatcctgttacacgatacagactcgcatcgccgaacggggagaggaggaagaggaggaggaggaagaggaggagtggggctaggggaacgggggtggggaagagggaagggaggagggagagcaaggaggaggaaagggtccaacagggagcggagtgtgcgtctggagctcgcttgggcacaccagcccagccgccaccgccaccgctctccaaaatagcctttagcgcccggccagcgtagaggtgctctggccggccgcaccaattcccggagccgaaagcagagtccaggcaccgccacttgcaagagagggagaatgccaggcaaatacccgatccgcacacacgtctacgcgtgcccaccggcactgcgcg

SEQ ID NO: 223832 - DNA, 680 bp, Homo sapiens
aggtttctttgagatgataaaaatgttacaaaattggcaatggttgtacattatctgtgactctactgaaaacactaaattatacacaataagtgaactaattatactgtatgtcgattatttcttaataaagctgctttttaaaagttcagattcgatggagccatcaaagcccaaaatttttaagttcttaaatcttaaaggacagattactatctgagttggtgaccgtgctaggggcttcaaataccttgtcaatcaattttacaacaatcttatcaagcatatgaggaaagtgaggcacggataagtaatctgcccaaaggaacactgtacagctaagtcagagctagaacctgaacccaggtcagtcaactcccaagtcctatgttgtttccactatttctatttgtagatttggtcctttactgaacccagaaaagatgccaacatcacattaacttattaactaatcagaatgccaggctgaacactccagctgaaatatgaaattatcaacagaactaataaaaaataaaatacataccaataggtgctgggttattacatacagaaataagtaaacaaacagagaccctaccattacctcagtaatttcctttcttttactatcttctacagagcttccccttttctctcagcatgaaattttacctttc

SEQ ID NO: 223833 - DNA, 731 bp, Homo sapiens
  misc_feature (270)..(270): n is a, c, g, or t
  misc_feature (438)..(438): n is a, c, g, or t
  misc_feature (447)..(447): n is a, c, g, or t
  misc_feature (489)..(489): n is a, c, g, or t
  misc_feature (491)..(491): n is a, c, g, or t
  misc_feature (507)..(507): n is a, c, g, or t
cgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagttctatgccttcaacatgaaagcaactgttgaagatgagaaacttcaaggcaagattaacgatgaggacaaacagaagattctggacaagtgtaatgaaattatcaactggcttgataagaatnagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccnccattgaanaggttgattaagccaaccaagtgtagatgtagcattgttccncncatttaaaacatttgnacgaatttaggtccttcaaatgttttaaatgtgtggacctaaattcgtagcaaattctgtggcagttttaaaaagttaagctgctatagtaagttactgggcatctcaatacttgaatatggaacatatgcacaggggaaggaaataacattgcactttataaacactgtattgtaagtggaaaatgcaatgttttaaataaaactatttaaaattggcaccaa

SEQ ID NO: 223834 - DNA, 698 bp, Homo sapiens
  misc_feature (270)..(270): n is a, c, g, or t
  misc_feature (438)..(438): n is a, c, g, or t
  misc_feature (447)..(447): n is a, c, g, or t
  misc_feature (489)..(489): n is a, c, g, or t
  misc_feature (491)..(491): n is a, c, g, or t
  misc_feature (507)..(507): n is a, c, g, or t
cgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagttctatgccttcaacatgaaagcaactgttgaagatgagaaacttcaaggcaagattaacgatgaggacaaacagaagattctggacaagtgtaatgaaattatcaactggcttgataagaatnagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccnccattgaanaggttgattaagccaaccaagtgtagatgtagcattgttccncncatttaaaacatttgnaggacctaaattcgtagcaaattctgtggcagttttaaaaagttaagctgctatagtaagttactgggcatctcaatacttgaatatggaacatatgcacaggggaaggaaataacattgcactttataaacactgtattgtaagtggaaaatgcaatgttttaaataaaactatttaaaattggcaccaa

SEQ ID NO: 223835 - DNA, 435 bp, Homo sapiens
gattacaggtgtgagccaccatgcccgaactgacctggtttcctagcagtacgattgtgttggtaagtattttgttggtgtatagctttccttctctctcatttcttaaatgcctgattgtacaaccatcctcctaccagtctgatcgtaaatctggccttttggctgtataactgctggagtatctgatacaaccaccacaccgtctaactgtctgatcagatgataatcctagagaaggaatggttttatacctgaacacctttctggctgtcttactcagtgctgggctaggtgactatagcagggataagattattccatagctccactggttcgctgtctgaggatatgtctctgctgtcccctggatagaactccctattttttctttttgagacggagtcttgctgtgtcgcccaggctggggtgcaa

SEQ ID NO: 223836 - DNA, 279 bp, Homo sapiens
tggagacagagttacctctattctggttatattccctgttggggcatgattctggtttgcctctcagattaccatttcctcacctacaaaatagatcttcaactacatttatcccttcccttgcacacatccatttattccaagaaatttcaagaatagaaattcaagaaaacttcttccccttgacactctcccatttcccttaataactgctgtgtttgcagaattccatgccatacctcaagccttcctctactccctctcccctcctccccttcc

SEQ ID NO: 223837 - DNA, 444 bp, Homo sapiens
catttcccggaatttatgtgatacaccctgctaacccccgggcttcagtaataccagtgcgtgctgtttagatgtgcagataaaatacacttcctcatggtaaaagggtaaagtgtcatggatgagggcacaggctgttgagacaaactggttcaaatctttcctacagttcatctcacctttgtgttctggtttccttatctttgaagagatggggattacatgatttaattctgtagggacagcatctggtacatttattacattggcagcttctaagtcaaaaataagaaatatctcttgaaagaatttaaaagtttattgtaaattaggttataattttcctgaaccctcccactttctggctctgatgctgacatcatggtctctttgctcacaacctcaaaagttttcataatactgccattaggaaaacactgtttc

SEQ ID NO: 223838 - DNA, 527 bp, Homo sapiens
tttaattgccaattagcagtttgttttagatgtgtttgttgagccattcagtcccacttgtaatattagaccagatagaatattgttttcaaccactataacataacaatataccagtagtaaaagatttttacacttggattgctaccctgtaccattagctgtctgtctgaacctaccatcagctatggagtactcattgcaggccttttggtaagtcattcaactctaaaatgccattccaacatctgctttttgggccattcctggtgccaactatgtaagctgggttttctggattgcaaatgccaggatggagattaatactcaggaggattgttaaggagtagttttctggatagaagaaataaatcatatttaggtaggaaattgagagcgatatagtctcaacaagtctccaatgattgcatgggacattctaaaactgggatgaacaatccatgttcttctgaattgagttaatcaattttcaatattgatcaaataccgtagtaaagctaaatcag

SEQ ID NO: 223839 - DNA, 593 bp, Homo sapiens
gagtgccgtggctagagtgtaaaatcctgtggaatgaaacagtcatagttggtgaaagttgttcaggcaaatcatatatcattcctgatagttggtgagctgttataattctcattaaactttttaaatggagactttcctctagattgatcaactttctcatggctatattgaaatatttttattagattatttagtcttagtttagactttctgtgttcacagaggtttggaatctatttatatctaagttaatgtaagattattttaatctttttcttgtgaaaagaaatgtgaattgtattttttattagaatttgttcagatagatcagtctttccttcttattggtaagtgcttctatccccccatctgactatagttactgaacagaatatctttctttgtctgctctctcaggctgcctgagcgagtgattgagcagaaggtgggatcccaggttttcttgagcctgctttagtttcagttagaaagataatgtaagttaaaaatgccagcaaaatagataatgtaaatgagcagaacatactcctccttctgataaatgttactggaaaaatgaagaactaaga

SEQ ID NO: 223840 - DNA, 766 bp, Homo sapiens
aatcctgttcctgccttgggtttggtaaatactgctaggtttgacagaaagatgggaaggagtaggactgacttcatcgtttcttttcagtgggtcatactcttttatgcctgttcattgtctgaaaagaggtgggaagtctttccaagtcccaattgctctgttgtgcctataagccacatcgtactgtatttgaactactgattggtggagagaattatgctaaagtagacctactgtgctgtggcaaatttgcagtgaaaaatctttcatggctaataaagtgccacatcttagtctttgtagccctttctgtttagttgtgaagtcatttcattttgtgtaatatgtactcaatagaaatagtgtcagtgcagtgccattgtagatgcttttgccacagatgactgccagatagtgtccatgtttgtatagcagcatctaatatgtttatgtttcacagtatgtcttaaggaaacctaaacatttttagtgagaaagcctgaaaattgctccaagcagcttatgtttagaaaagtgaatacattttaaagcaatttaaaataaactgtttcaggttattcctaatggcaattactatattattagctctttaggaatgacatggaaaacttaattacaaaatctcatagaaaacttggaaaacataaaaaggttcaaagagaattataagcctgtgttagaaaaattaatggtgttatattttgatacatttcctttcagttcattctctgtgcaaatacag

SEQ ID NO: 223841 - DNA, 186 bp, Homo sapiens
acatgcacctaatatgcaacttgaaagtccaactcacaattcatgattcaaaaagcagaagtttcaaaccattgttttcagaagtccataatataaaatactccaaacataaattcaacattgcatgcaacaactggccatttgcttcaaaagaagtgatcacagtgtttatatatttaaaaaaga

SEQ ID NO: 223842 - DNA, 373 bp, Homo sapiens
tcctctctgttgctcaacgagctggcaacattgggctcccaatctttttcctgccagcccccagtttcctctcatttctgggtcgtgactgatcacgggctctaggatgatctgtcatttgaaggttcccacctcatttatcccaaacctattgattcctatttcttgacattttttttacttctagtggaatctgcctcacttgtgactaagcttgttgcatttttggacccatcctggtgtctgtgtgcacatgcgtgtgtgtgtgtgtgtgcatgtgggtgtggatgcacacgtgtgagagaaagaaatagctctccctccatttcagcacatatttgctctaattccaccttcctttagtctccattct

SEQ ID NO: 223843 - DNA, 589 bp, Homo sapiens
gggtcggagtcagagcccggggctctgatgtcaccgcgcggctgcgacggcccaggagcgcgtctcggcgggagcctcaggtacgcggcgggggcgggggagcgggaagcgggcggctgggtccgcttcccccgggaggccggcggggctgcgggcggacgggggtgaagagcgggcggcgaggcggtggtcgcggggcagcccgggcatcgttcggccgggacgtgtctggctcggcgccgcgtcaggttgcgccagtggagtcggaccccagcgcgcctctcccagctgcagagctgcagggcggagaggcggcccactctaagctggcggcgcggctcaggggcgcggctgggcgcgccgcgtgtggcgccggcgggcagcgcggtctcactccgccaccctccgctcctgccctttgtcgccaagcatctggagaagccgggtccttccctcccgggctcgcgctgtcccctgcgcgcgatccttccccgacggtgaacccaacgggaaaggcccagaactgcgcggggctgcggccatctgctgtcgagccgctccgcgtgtctctgccgccccctgcggccgc

SEQ ID NO: 223844 - DNA, 361 bp, Homo sapiens
ccgtgcaccctgagggctgtgatcttatcgggattgggtgagctcacaggctcgtggcagggatggagggaacggggaacggaggcatccggcggccatacctgggtcttctcggggcctggacctgccgcacttctctggggaggggctttcacagtctcctcgtccaccccgttggagatcctcctcatgggccagggtcaccatacgtgggcaccaaccttcccaaactgatccttctcatgggccagggtcgccatgcgtgggcaccaaccttcccaaactggaacatctccaatgactcccctttccttaaaagagttttgaagatcaataaaacatatttttaaaattaataaaa

SEQ ID NO: 223845 - DNA, 472 bp, Homo sapiens
cagaaaagttgtccaactggctacacttgaattatatcccctgattattaaactcaggcttctttagttttcatttattttatttcattgcatggagatgttttaaaagaggaaggcaaggggtgtgggggaaggattctgggatagcgaccattctcaccacatgcagaaggccaatactgcttccagaaggagacacaaggaatccttcactgagtgaaagttttttttcttccagagaatatcagtattcctactttataacaagccaggagctttttctgcttcctgatttaaaaattgattcctgactgcatagttctcacacaatagcttccttctcgcaggggcagtgtgattgcctggaatataaattcttagtgggttgaccagggatcacgagcagttattatgttctctgctgctcttaacatgttgtgattctcaataaataatccagagccaaagcatg

SEQ ID NO: 223846 - DNA, 450 bp, Homo sapiens
ggaacatttccctgctgtgagaggaggataaagggacccaaggaaaggagactgatggtgacattgagtggcattgatcgggtggaccaggccctctcttggatgcttgcaggtgcattatctcaatgaacctccactgggacccctccaggcaggcaccattagcctcccattttacagaaaagaccaggatgcagacaggggacatgacttgctcaaggccacacagctgagatctgaaagaggaccttccatgtcatgccactgcctgggatgggctcagcaaagcttggagtcctgcaaggccttccccaagacacctgggtccatttcccttccctgcagacagcccatcaccactcatttctactcctgccccacctcccttcacctgttcaccctgttccttcagcccaaatgtcaaatgcagcacaaaagaaaacaaagtga

SEQ ID NO: 223847 - DNA, 372 bp, Homo sapiens
agtaatcatgacaatgtcttatattctcagatgattttaaaaaagggtaattaacttttgtgtatctaggtaaacaagatacttaaaacatttttttttttttaaaatagataacactaagccttagagcaacggttcttcattctgggcagttttgctctccatgggatatttggtaatgtctgcagatatttttgatagttaggatatggaggggctgctattgtcatctagtgggcaaagatcaggggtgctgctgaacatcctacagtgcacagaaaacagcttcacacaacaaagaactatctagttcaaaacgttggtagtgcaagtttcagaaaccctgcactagagatatttaccatgagaaac

SEQ ID NO: 223848 - DNA, 188 bp, Homo sapiens
attcctcccttctcccaacttcccatacttcttttatttgtttggctcattttcaagagcattctagaatttctctaaaggagggccttagtggtggccatctatttgaagcgctaaggtgggtagaacgatgctagaggacatgtttcaaagttgcctggcagagcaggtaagctcctttccttcac

SEQ ID NO: 223849 - DNA, 410 bp, Homo sapiens
tgatctgtcatggtgagcacatggactcctgggccatccctaagaataacttctgggtgaagcaacaatgtcagctactggcccctacagcatttacctatgagtggtctcacgttcaaagcaggcttttctgggcatctctgagaagaggctcccatgatgatattggcacctttgggcaccatgtgcaccagcctgggacttctatgcgtgcccctcttctcattgtccctgctgggcttgcaggttaggagaggttctccatgacctccaaattaagaccatctgataaaaccatatttttctcccccacctcccatagccatcctgtcaaataaataccttcttatgtatcttgggaaggtaacattaggtatttttctccccatatacacaaaattaattaattt

SEQ ID NO: 223850 - DNA, 550 bp, Homo sapiens
ggatccctgccttgatgtactgctttggacagtaaagtatgtggataccctagtactacatgtaactctagagttatctacactgtaccctggggacacaaaggatggagggaggtgggtctgactgtagaaaggtggatggtaaccatggaaatgagcctgaaatatgcacaggattacaccaagtggagagggataggaagggcataagaagcagagggaccagcatttgccaagaagcgaggcttaacaatcctgggcatacttagttagataacataaagaaggccaaatggcttgagtccaggaggcatgcaagaagatgaggctttctgcagtgggaactggagaaagtttttgagtaggggtagacatgagccaatggcttcacaaaagagaccagttgaggagctggagccgaaattgtagcagaagagataatgaggcttgaacagggcagtgcatgtaaacccaggaacaaagggtgagattccataagcattttggagataaaacagataggacttcgatgtgagcatcagaggacagg

SEQ ID NO: 223851 - DNA, 551 bp, Homo sapiens
ggttaaaccaaatttgagactgagtgcagtggctcaagcccataatcccagcactttgggaggccgaggtgggcagattgcttgaggctgggaggtggagaccagcctggccaacatagaaaaaccccgtctctactaaaaatacaaaaattagccgggcacggtggtaggcacctgtagtcccagctactggggaggctgaggcacgagaattgcttgaactcaggaggcggaggttgcagtgagctgagatcgcaccactgcactccagcctgagcaacagagcgagattctgtctcaaaaaaaataatttttttttaacctaaagaagagatgagtgcagccaagaatgaggataagacgctgtcttcaagtatttggacactgggctagctttgttttgtgtgaactcagaaaacagaactggagtcagtgggtgttagagggagtcggggcagtcagtgccctacccagatcttgccttaccaggtattttcaatcccaagttgctgtaaggactggctgcaaacttctcacagctgcaccctttt

SEQ ID NO: 223852 - DNA, 844 bp, Homo sapiens
ggctgatgtgcaagtgacaatggctttcagaaaaaagactagtgatgttaaaaatgaatacaagagggtataattgaatatgacagaaggaaagctatacctgtcagagaatcttaccagagttgtgagcatctcctaaatgggcttaaaactactagcacaaataactaagaaataatactttttaaacagcaggtgatcaaatttagtgcatgttagtttgtcaaagctgcattttcaagttgtaacagattggtgccttagactatgggatggacatggacagaagaaaaatctgatggtgaatataagaaaagctgtgaaaaaagaaatggagaggagtgtggggatggttaattcacagagaagggaagccggccttgcctggagtcagcagccaggagtccagcattcacattctccccagaaggaacaaaaggccacatgtgccctgttttgcagatgtgccttccccacgcctccatgggggcctttggcccagttctcattggcagtgtcacttcctgatactcattttccagaagcctcccaggtgattagccatcatatgtctccaagaaaggaagtgttcggcacataatctgccaatgattgctgatgacaacacaagtgtcagacactgtgttagcaatgacaaggacatggtctctgccttctaccccactgtgcctctgtatctgccatgagaagggcatgcctgggagctgctggtccaagaacaaggagtcagagaacagccctgaaatcaacccacagcctgatgcagagtggccccaacccacagacctgtgagcaagaaaaataaatgtttgttgctgtagga

SEQ ID NO: 223853 - DNA, 1398 bp, Homo sapiens
ggctgatgtgcaagtgacaatggctttcagaaaaaagactagtgatgttaaaaatgaatacaagagggtataattgaatatgacagaaggaaagctatacctgtcagagaatcttaccagagttgtgagcatctcctaaatgggcttaaaactactagcacaaataactaagaaataatactttttaaacagcaggtgatcaaatttagtgcatgttagtttgtcaaagctgcattttcaagttgtaacagattggtgccttagactatgggatggacatggacagaagaaaaatctgatggtgaatataagaaaagctgtgaaaaaagaaatggagaggagtgtggggatggttaattcacagagaagggaagccggccttgcctggagtcagcagccaggagtccagcattcacattctccccagaaggaacaaaaggccacatgtgccctgttttgcagatgtgccttccccacgcctccatgggggcctttggcccagttctcattggcagtgtcacttcctgatactcattttccagaagcctcccaggtgattagccatcatatgtctccaagaaaggaagtgttcggcacataatctgccaatgattgctgatgacaacacaagtgtcagacactgtgttagcaatgacaaggacatggtctctgccttctagtacgtgaggagtctggccttgagcctcaccctgaggctgcagtgtactcaaagttgtaacagaccaggacagagggctgagggtacaggagaaagggtgcccagccttgaagagtcaggagagacatcagtacagttaatacaggctccatggagtggggaggaacaggagggacagacagcagcaggaaactcatctggaaaggtgtgcaagggtcagagcacaggctagtggagagagccaggaaaaggcatgtgggccttgaaagcagacggacccagctcatctaatgactggctgtaaaaccttaggcaaattacatcatttctgaagcttcagagcttcttatatgtggattgggagaaactagttactcacaattcttccttcccaccccacctttcccaaggcccactgtaggcagagaatgctccctatgctgttgctgatgggcttggccctatgcctcatctcagccattggaatatgggtgggagtaagatggggcagctccaagccaaggccttaagagccaccactttcttccttctagccccactgtgcctctgtatctgccatgagaagggcatgcctgggagctgctggtccaagaacaaggagtcagagaacagccctgaaatcaacccacagcctgatgcagagtggccccaacccacagacctgtgagcaagaaaaataaatgtttgttgctgtagga

SEQ ID NO: 223854 - DNA, 892 bp, Homo sapiens
ctctatgaggatccccggcatacctggaccttctagaagcctcccaggtgattagccatcatatgtctccaagaaaggaagtgttcggcacataatctgccaatgattgctgatgacaacacaagtgtcagacactgtgttagcaatgacaaggacatggtctctgccttctagtacgtgaggagtctggccttgagcctcaccctgaggctgcagtgtactcaaagttgtaacagaccaggacagagggctgagggtacaggagaaagggtgcccagccttgaagagtcaggagagacatcagtacagttaatacaggctccatggagtggggaggaacaggagggacagacagcagcaggaaactcatctggaaaggtgtgcaagggtcagagcacaggctagtggagagagccaggaaaaggcatgtgggccttgaaagcagacggacccagctcatctaatgactggctgtaaaaccttaggcaaattacatcatttctgaagcttcagagcttcttatatgtggattgggagaaactagttactcacaattcttccttcccaccccacctttcccaaggcccactgtaggcagagaatgctccctatgctgttgctgatgggcttggccctatgcctcatctcagccattggaatatgggtgggagtaagatggggcagctccaagccaaggccttaagagccaccactttcttccttctagccccactgtgcctctgtatctgccatgagaagggcatgcctgggagctgctggtccaagaacaaggagtcagagaacagccctgaaatcaacccacagcctgatgcagagtggccccaacccacagacctgtgagcaagaaaaataaatgtttgttgctgtagga

SEQ ID NO: 223855 - DNA, 334 bp, Homo sapiens
aaattaagcagagttcttatgctacaagctggcctgatccttcagttaagcagatgtgtatttcctgcaaccccatgtttggggttgcttggagaagtagcagacgttggctgtgatttgaggagtctccatttgcgtgaccgtaggccctttaaacttaacatggcaaaaacagaatgtttgagttttcttcttaaatatgcttcttacttgtctttcctatctcaggaaatagtatggccatttttttctaattgctgaggcaaaaaacccaggagtcatcctaaactgttctctttgccttaagctttatattctccgttggctcttgtct

SEQ ID NO: 223856 - DNA, 562 bp, Homo sapiens
aatctagagcatcccccttatcacccaatcaacagtggtcaaatctctcttacacttgaatctctctgaccactccttctgccacatctctgacttactctgatgctaagagctcacatgattacactcggcccacgaagataatctatcctaattagtaacatttaacagctaattagtaacaattaacagctaattagtaacatttattccatgcacaaagtcccttcatatcggtactgaaattagtttgattaactagctagggacaggaatcttaagggcatagctttacaatcctgctgatcacagaatgtttagaccattaacatttaatgtgataattgatatttttgaatctagtcccatctttttattatttgttttctgtttgctcctctgtttttcctttccagttttcttttgtttttgaatagtttcagtattttttcggcaatatctttttatattttttttagtgattgctcgaggaattacaatatacatcactaatttttcgtagtctacattgtaccccttgaaataaaaagtacgaattgcc

SEQ ID NO: 223857 - DNA, 796 bp, Homo sapiens
tagactcaagcgatcctcccacctcagcctcccaatgtgctggggattacaagcgtgacccatcacacctggccggtttttcattcttgaaatgtcaaattacaaggcttttcctttatgatgtttagatttcatgtgatacttagatttccccacttcaaaattataaaaatattgtaccatgtattcttctgatatttcatttttaatatattaatcatttatcaatttgaaatttcctttgatgtgaggagcatgatagggatccagccttttcttttttccaaatggctaactagttgtctgcaacatcattgattaattttaaaatgtcatctttatcatatatttaattcatatttatctttggtctatttctggattttctttatggtgtcatgatcattctgtttctgagccattaccaaattgttttaattaccatatctttgtagtctgttttaatatctaatagcccattcctattagaggaaatacaccatactttcctctttcagaatgttcccagatatttattcttccaggttaattttataatttttttcatttccagtgttctattgtgatttcattggagttgcattgaatttataaaataatttataggttaaggacatatttgtaacacaaaggccctgtccatttactcgtcatattcacattcctcaaacagtttaacattttctgcatttggattcttcacatgtcttacttagtacaatcatgaatgttttatgttttcagtactgttaaaaatgagatctcttcattcgtg

SEQ ID NO: 223858 - DNA, 558 bp, Homo sapiens
ggaggttgcagtgagccgagattgcaccattgcactccagcctgggagacagagccagactccatctcaaaagaaaaaagaaaaaaaaaatgaaccaagaatttatatccagccaagatgttctgcaagtaaaaatactgcctttcagatttcatggagtataaataaagcaataattagaggaaatttcatagccttaaacagttctaccaataaaagtgaaggaatgaaaataattggcactataactgtacccacgagcgagacatacagacactatgggagctgccctccccctttctcccagtggttagtaactaatttccaattaattacaaagttgtgttatacttctttcccccactgctgttgctttcatataaatgtttttcttatttttctaatgtgccatttgccacctctatattaaaattttctcctataccactcatttacccctataactccagtgcttacttgacacatctcttcagtggctcctggtttctatattttcatctacacagtgaataggccgcatccaaagcggagatatat

SEQ ID NO: 223859 - DNA, 396 bp, Homo sapiens
ttgatggagctactactgagcagtcacatgccctgaagttggtcactttctacccagagcatcgtgttaatgcacatagattctgcaacacaggctacaaagattcaaagacagctttgctgtttgctagctttgtgacctcaagcaagttactgaaattcctgtccctccgttactgcatccataaaagggcagttgcaaaactagtacctgcctcatcagggtgttgtggggttgaaagtgaattaatatgtgttcggtctcgaggtcagtgcctgttgcataagcactttgtatctgttattattgccttcaaaactctcttcactgtctgtgtacgactttccagcgtcttgcatagattaagtgtttaataaatatctcttcatgacattt

SEQ ID NO: 223860 - DNA, 356 bp, Homo sapiens
  misc_feature (353)..(353): n is a, c, g, or t
gtagcagcatgttttaaccagctgaattactctgggaaaataatgcataaatatagtaacatatgaagaaaatgtttcctcgtgagaaaaatgaactaactatgttaaaagtatttcagcaggaataacattgcttttttttctttcttttttttgagacagcctgggtgacagagcaagactctgtatcaaaaaaaaaaaaaaaaaagatcccctgcacgtgctctctcttgcttgccaccatgcaagatgtgactttgctcctcctttgccttccgccatgattgtgaggcctccccagccatgtggaactgtgaatcaattaaacctctttcctttataaattaaaaaanaaa

SEQ ID NO: 223861 - DNA, 474 bp, Homo sapiens
aaaaattatctgcttgacaattggttgagtttatctaaagatcttggatcaatagaaaaaaaaggcctggatttcttttctggagactggaaaggattgcagagaccaaagttcttatttgtagaggaagccttcagagagaatacgttgtaaaatgtttcttatcagacttcatgtctgtgttgatgtcagtgccagcaaggtataatgaggcatgtctgaacaccacttcccttcatggctgaaccatctgggcaacatagagagacccctgtctttataaaaaaaaattttaaaaattagctgggtgtggtggtgcatatctgtagccccagccactctaggggctgaggtgggaggatcatttgagccccaaacattgaggctgcagtgagccataatcatgcctttgcacttcagcctggatgacagggcaagaccctgtctcaaaataaataaataaataaataaaac

SEQ ID NO: 223862 - DNA, 183 bp, Homo sapiens
gactcaaggatttagattttgacgcgttctcctgggtagtgtagtgctgaataaataggagtagggtggtgacagagatctgaattaccccgttaacagtggtgtattcatacaagaccacagcaacttcagcctgtgccttctcagaagaaagaattcaactgaggggaagcagaaaaagag

SEQ ID NO: 223863 - DNA, 303 bp, Homo sapiens
atttagagaaaaaggcagaaatcatgtctgtcctcagaatagtgtcatatttgtgaagggagaaaaactatgctgaaagacgaaatagacctaccccatggaggcaatgcaagaacctgcaaagcaaaaaagtaccagggacacagagtggggtacagtgcagtgtcttctgggagggtgatctttgagcacttcggtgagtagggtaagggtgggagaatgtcccaagtgatagggttgcctgatttgacacttgagtcagatatgtgtctgttgcaataaacactattactccctgagttt

SEQ ID NO: 223864 - DNA, 535 bp, Homo sapiens
attggcccaaatgtctaacagtaaagatttatgaagagaatttcagagtgctgtgaaaacatgtaatgtagaaatctaggatagattggtgagtcagggaatggtttcccaagaaggggccatttaagctgagatacaagatttagataggcaaagatataaaagataattattctagacaagtgtgataggcctcgaggaaggaagaacttggcattgtcaatgctgcagtgcttcccgctttgccttttgaatcccaggttccacgcaggaaaaggcaaggccaggctcctcccctctgcaaaggtgcaaacttgctcaggctccaccccagtgcacaggccggcaggagctctgccagggatcccctcccacttagctgtctcaatgggagggaccattttacaagatgtttaccatactggtttgcagaattagagagagtaaccttaggtgaggagaagactgggatttggagacagaaggaaagaaaatagattcagggtcattcttgaatgttagccttctttgagtt

SEQ ID NO: 223865 - DNA, 428 bp, Homo sapiens
atttgattaatactaataggttttccagaactgaaaaactaatgttaaaaccaaagctgatttctagaaaatttgaaaatgtaaatcagccttatccagaatatagtttctctaaaactttcttagtcattttacaatagtataactattaaaaaatgtaactgctattttaatgttttgaaataaattaaaacattttaaaatatgaatactgtagcttaaaagaaagaaactaggggaaggaaaagtaaagaaagaaatgccaattccagtccaaaactttatttgccaagttttcttataatgacttaccaatttaggaattcttgtaaacagaatctataatggaaatactgaaagacttttgcctaaagtggcattattgaatactgctgtgatgctactgtatgtaataaattattgttgca

SEQ ID NO: 223866 - DNA, 650 bp, Homo sapiens
gctttagaaaaaaaatgccatgaaaattgagccacatgcattgaatggtaaagggggactgtggcaaggagaaatgaatgcctttccaacccggccttattctctgcttagaaattgccttcacagttccgtgatttggtctaacatccttcaagactaatcttattttaagtgaaatagtggaagggataacagagttggaacctcaaaaaatttcacatttctcaagacaaatagcccaagggaccttgaggaagaatggccctcagctttctgcatattcacctgtttctgttcctctccttggaggatcttgatagactgcagtgggcggagtatgcattatttcagtgaccgctgtgaagcccatcactgggaaaggatgctaacaggctgatgaggactttaaaggaaaggcctggggacaggctgcgggcccagaagccagttaggcaagcttctcttgttccatcagacagttatggttcaaggcgctttgccactcctgccccaagttcctttccacgaaagatgacagagaattgtgtattacctcaatgacttctcatctaggttagacaaagtcttaaagcacactcagctctgtggaaggatccccctccagaaagttctacatgttcatatcagga

SEQ ID NO: 223867 - DNA, 597 bp, Homo sapiens
ctttgcctccagggttcaggcgattctcctgcctcagcctcccaagtagctgggattacaggcgcccgccaccacgcccagctaatttttgtatttttagtagagacagggtttcaccatgttggtcagggtggtcttgaactcctgacctcaggtgatacaccccccttggcctcccaagtgctgggattacaggcgtaagccactgtgcctggcctatgcagctctcttgagagtcccacaacaccttatgagtgaggtaattaaaaaaaaatttttttcttttaaataaatagagatgagggggagtctcactgtgttgcgcaggttggtcttgaactcctggcctcaagcaatcctcacacctcggcttcccaaagtgctgggattacaggtgtgagccaccacacccggcccagtgagataatattatctccattttatagctgaggaaaccaaagggggaagtgacttgtccaaggccacgcagtccaagagtaacccacatcttcctgttggctatgatgcccatacacgttctttttccagatggaaccaaaagagaaagtggcaggctttcagggataaagaggccca

SEQ ID NO: 223868 - DNA, 367 bp, Homo sapiens
tgggtgggagagaagagtggaatactgtcacttaagagttgtgtaatgagggtcacttagagaggctgtgcctgtgtgtgggaagaaggtatctgggggctgcttgtctctaggggcatactgcagtgtctgcatcagtccccagcagcccttgttctgggagctggaggaggtgcctccccacctgggaccaaggcctccagccagctctggagaccccgggggctcagctttcccaccaggctccttgtctctgtgtttccagctctccccctcctgcaggggggctataccctgttggtgctgggaatccctttggtggtctggtgaggcccaacaactcttctcagaacaaggtgcttgatta

SEQ ID NO: 223869 - DNA, 454 bp, Homo sapiens
agccacatccactatccactggtcccccctttcttaaaccggcatctacgaatctgtcttctgtttgcgtaattctcgtcctttcaagaatgttatgtaaatggaaatatacatcatgtaattttttgagatatgctttttttcactcagcataattctttgggcattcatccagattttgtgtattaattgttcatatctttttattgctgagtaatagtccatgatgtgaatgtaccacactttttttaactattcactgattgaaggatacttgggttgtttccagtttggggctattatgaataaagctgctataaacatttatctataggttttgtatgaacataagttttcatttctctgggtgaaatcccaggttttatattatgctattacgttgtattaaatatataacatatatttctaatatggattaaaacaaatttataac

SEQ ID NO: 223870 - DNA, 537 bp, Homo sapiens
tccttcttgtttcaccaaaatgcaagtaatggacagaggaaatggttttacgttagtcactttttgctaatatcttgtcaggttaagagtcttacatgaacaagaaataaactaaaccaaaacaaaaaggacaggcctcggttgctgatttatgtggaagcatgtgacaaagcaatttacataggcaaacaatgataaatgacctaacaagttcagttacaaactgaacgatcactgcagactgatgcacatttatattctatgtttgcatttctgcatgtcttataaaacaaattgcaaaatccattaattttgcattttggtgtttttgtgtttgcaactcattacaaagttaaactaggtcggatcatttcagcaagcacaaactatgtaaccaccttagcattcacccataaatattgtaaaattatcagaacctgacctaagccacccatttatcatcttttactttctttccaactcatttatttgtctctgcctgcccaccaacacacacatacacacacacacacacac

SEQ ID NO: 223871 - DNA, 523 bp, Homo sapiens
tgaatgttctgattctagtcttggtagtcaataagagttgaccagatgaatttcatagctttgtagaggatgaaatatttcaaggctgatttgcacaaatgtttacatagatcatgtatctttcataagtaatatgtttgtattattacaaggctgtaaaaatttaagcaggttgttaatagcacagggggtaacagattaataaaattaatgaataaaattactaaaagagtccagaagtaaacccaaatacgtggaggaattaagcatatgtatgatacacatgacattttaaaaatcagtgggaaaaggtaaattattttacaaatggtgttagaagcactgattgataattttgttaaaagaaacttagattccctattttactcctaatccaaaataaattctgagtggatctaagattaagcaaaaattaagccggaagctgagcatggtagcatgtgtctgtaatctccgcaatttaggagactgagtttggctggggaggtggtgatatgcgcct

SEQ ID NO: 223872 - DNA, 602 bp, Homo sapiens
tggacgttaactcttcatttgctatcatatcacttaattaactaagtatattaactcttcacttgctatcatattgagcctgatatatatgatgttcacggtttaaattttctggcctggaattcagcaagctctgacacaaattagccttatccttcttattcgtcatcacctccctattttacccagtcctgtagtgtttatttttgcacttatgtctcatctgaattaggactagctacattgtacgtgctcagtggccacatatggctaaatggatgctatactaggcagcacagtcctagaatattttcatcagatttctctatccttttcctcgccctgtacctcctcagttatatctcaactccctcttccttaatacagttctaaaactaatgttttttattattggggaattgctggctcttcctatgcaaatggaacacctctggctttaatagtcacttcttataccttatactcaggacaattcaggacaagttgtttgtttgtttgctttttaattgtggtaaaatatgataatacaaaatttaccattttaatcatttttaagtatatgtttcattgccgttaagtac

SEQ ID NO: 223873 - DNA, 471 bp, Homo sapiens
ataattctagtatgttgttctggtcaatttctttccaatatttacaatggctatttcaaacctattccattttcattaatcttctggctctccccatctgcccctgtcaattctcagcagatgatcttattcttcacaggagaaattgaagctgtcatatgggagctcttgtatcttttcatctttctagctacacccattcttttatctctataacttgtttaaaaaggcgagttatacatcttattttaataccaattcctttctagatatttaggaacgatatatttctgctcaccaatcccttcgttggtacttccacaagactcttttataggatcatcccaattagcagttaacaaactctagtctctcataaataaaattatactctcaactccacccctattcccactccccagtattgccctatatttctgcttacttgaaaattaaaattttaaaaagttt

SEQ ID NO: 223874 - DNA, 316 bp, Homo sapiens
aaatgaatttttttctctaggtatgtttaccttgctgcctcctccagcaacttggtaagtcattttgctaagataccatgatttttttaagctgaagcattgactaaatggaattttctaaattaaacttgattttaatatttcttctagctccattccccagtaggcttagctcttcaatttgactgctgtttttgcataatgatcaaaagttagacatattatttctcttcttccaagattgttttaatgctcattaaaatgtctttttacaacacatatagacaatgtttaagaattaaaaatttaaccatta

SEQ ID NO: 223875 - DNA, 438 bp, Homo sapiens
caaagaaattccacatgtaaaccaataaaactaattagaaagtccagaaggatcattgattacaacgctggcattaaaaaaaaaaaaaggtgctcctatacatgagcaacaccaaaacaaatgtacgtaaatagcaaaaagatactcttctctgcacaaaatcataaaatgttactgaaggacagagaaaataaaatcaacagagagatacaacacattcatatatgagacaaattgatgttgtaataatgttggtatgttctaaattaatgtatacatttaatgcaattccagaaaaatccaaatagcattttctcatcaaatcagactaattctaaaattaatatgaaaaagtaagttataaaaatgtattatatggtaaaaggaatttgagtaagaaaaaaagacaaaaaagagaataaaaagaagtaatatata

SEQ ID NO: 223876 - DNA, 654 bp, Homo sapiens
tgagacggagtctcattctgtcccccaggttggagtgcagtgacgcgatctcggctcactgcaacctccacctcccaggttcaagtgattcttctgcctcagcctcctgagtagctgggattacagacatacctcaccatgcccagttaatttttgtgtttttagtagagacagggtttcaccatgttggccaggctggtgtcaaactcctgacctcaggtgatccacgtgcctcggcctcccaaagtgctgggattacaggcgtgagccaccatgcatggcctgtttttttttgttttgtgtttttttttttaataaacttttaaaaaagtgtttattttcaaaataaaatatgtatagattaataggaagttgcaaagaaatgtgggaggttctgtgcaaccttcacccatctctgccaatattggtatcctatataactacagaacaagatcaaaatcagtaaatagttcagcatctcacagttatgacaaactgaggtcattgattaacagaattttagtgtaacatgactttttaataaaaaatagtattctttatactataaagcctttattttgataacttattaccaggaaatatatcgaaaaagagcatggtttagataattggtttttaaccttttaggacata

SEQ ID NO: 223877 - DNA, 1931 bp, Homo sapiens
gtggtttctaacgctgaacttaaaaagtgttgagatgaataatgaagaggaccttctgcaggaggactcaacaagagatgaaggcaatgagactgaagccaacagcatgaacacattaagaaggacaaggaagaaagtcactaaaccatatgtttgttcaactgaagtgggagaaacggatatgtccaattcaaatgattgcatgagggacagcagtcaaattttgaccccacctcaactctcttctagaatgaaacacattagacaagccatggccaaaaatcgcctccagtttgtacgatttgaagcaacagacctccacggcgtgtccaggtctaagactatccctgcacacttttttcaagagaaagtgagccatggtgtttgcatgccccgaggttatcttgaagtgataccaaatccaaaggacaatgaaatgaataacataagagccacatgttttaatagcgacatagtcctaatgccagagttatcaacctttagagttttgccatgggctgacagaactgcaagagtgatatgtgataccttcactgtgactggtgagcctcttttgacttccccaaggtacattgcaaagaggcagctgagccatctgcaggcctctggcttttccctgctttctgctttcatctatgatttttgcatttttggtgtgcccgaaattttaaattcaaagattatatcttttcctgctttaacatttttaaataaccatgatcagcccttcatgcaggaacttgttgatggcttgtatcacactggagccaatgtcgagagtttttcctcctctaccaggcctggtcagatggaaatctctttcctgcctgaatttggcattagctcagctgataatgcatttaccctcagaacaggtgtcaaagaagtggcaaggaaatataattacattgccagcttcttcattgagactggattttgtgattcagggattttgtctcatagtctctgggatgtcgataggaagaaaaacatgttctgcagcacttctggaactgagcagctcacgatcactgggaaaaaatggttggcaggactcttgaagcactctgctgcgctcagctgcctgatggcgccttctgttagctgccgaaagcgttattccaaggacaggaaagacctgaagaagagtgtgcctacaacatggggatacaatgacaacagctgtatatttaatatcaaatgtcatggagagaaaggcacccggatagaaaataaactaggctcagcaacagcaaacccttacttggtgctggctgcaactgttgctgccggcttagatggacttcatagcagtaatgaggtcttggctggtccagatgagagcacagacttttaccaagtggaaccttctgagatccctttaaaactagaagatgcccttgtggcactggaagaagatcaatgcctgagacaggctctaggagaaacctttattcgatattttgttgccatgaagaaatatgagttggagaatgaagaaatagctgcagagagaaataaattcttagagtattttatttagaatagagctcacaactactcctttagacatgtaattgttacttaaagctaatctaccaaaacaaaaagactgaacttttgtaattaacaacagcaacaataacaagattacgaatgcttttgacttttttttttgtccatggaatatttgacagatgaagtaggactgctgagaagattctgataacagaaacaaacaacaaagttgtggtgaagctataatatgcaaacttaccagatcttgtcagtcatttcctatgtgtatgttgacctggataagaatatccaattttgggtggcaataaatatattcgcacattaagaaaaaaaagacttaagcattagaaagcaaaatttaaatgactaaa

SEQ ID NO: 223878 - DNA, 294 bp, Homo sapiens
ttggcagtaaagtgaggaatagtcattggatgtattggaaatcttggggttcatggacatttgtcaggcttcccttgggtggtggtgcatcattcacagttaaaacgacgagatgcaccccaggacgaacggtgccagcctgagagtgtaactccgagtgtgtttacatgagtggccacaatctgaaaactttccttttgacataaactcaggttatatcataccaagagtgaggagtctcttttatgctgttttccaggaaaagggagaaaaaacaaatgagggtgaataagt

SEQ ID NO: 223879 - DNA, 570 bp, Homo sapiens
ttataaaagtattttctttcttattaaattgttaaagatattggaaatataagccaaaaatactttaaataagagtttaatttctcttgattgcatatgacaaacagtatttgtgaaactgtgtgtatacacacatatatataaatgagtatatatgcttatacacatataagctcctttatctgtttattaaatatacgcatatatataagcacatatactcagttatatatatgtacatttagttatatacataacagaaaagtatgatttttaatccattgtatcttccaaagctaaagcattattaggtaaaaagaatttttgaaaatttgttgaaatttgcagtaaaattggatatttaaaagttgtaatattttagtcagtcaattctaataatgagcaactatgaaatactataattataaaattctgtattgtagttgattaggaaggtataacattttactatagctatttttaaagtttctctactattttttctataaggatgtatacaaataaaagatgatttgaaaatttctattttattcataagataaaggaaaa

SEQ ID NO: 223880 - DNA, 365 bp, Homo sapiens
ccaggctaaatgtcctgctctaccaagtttaaagcctgagcctcagttttatcttgtgtaaaattggggataaaaagacaacctacctgacataacacataaggatcacgtttgcctggaaactggcaggtgttcgataaacataacaatgccatcttacatgcaaaatactggaagttaaaaagcactttctggacaggtgtggtggctcacgcctataatcccagcactttggaaggctaaggtgggaggatcacttgaggccacgagttcaagactagcctgggcaacatagcaagacccccatctcttaaaaaaaaaattacttgggcatggtagtgcatgcctgtagtctcagatcttgg

SEQ ID NO: 223881 - DNA, 518 bp, Homo sapiens
gactgcattgtaccatcactagaatctagtgcttaatggcaactcgccctttccaaagggtctcaacaagaagcaagacgatagacaacaattagctaaatctacattattggacatgatggctaagtaaaaaacatcacaccagaatcaaggattttggtatctgcatgagtcctggaatcaatcccccagagatactgatgggatcttaacaatgacagtaattgatggtgtgtgaagaaaaaagggaagatcaggagactttaacctgtggtattcccatgtttagaagcaaaatggggaacaaaaaggaagcgaataacaatcagaaaaataggaggataacaatagtgtaatatcatggatgccaaaggagagtttcaaaaagaagaaggcaaccaatagtgtcaaatgtttcagacaattgtaaaaattcaaaaataaaaatatttaaaactttcaaaataaaatatcaaaatatcaaaataaaatatcaaaaactttcttgatgccaggca

SEQ ID NO: 223882 - DNA, 292 bp, Homo sapiens
gagacacagcaaaagctgacgcctgtcacctgtgaatcaggctccagttctctcaccgaggcctgtcaccaaacgccctgagtccccgttacagcggccttctgctcttacagcagcaaacccagcactgagcttttctcttctgctctgttggttctccaacatctaccatcagtagccacccccgctcctgatgtcaccctcccatgttaaggatagatcccagttccactctccagaatcctgggtcctctggctctgaaaatgccctgaatctctcccaccctcatct

SEQ ID NO: 223883 - DNA, 780 bp, Homo sapiens
cctggggccctctgacaagaaaccctaggagacaccgcggagaactctgcctctgagctggtgggcgggccggatgtagccgagcgcggacagggctagtccggacagagtcccagagccatgggagcgaaaagagactgctgcggattaaggaggcctttcggttggcgcagcagccacaccacaaccaggcgaagcaggtagtggcgctgaatcgctcctgccgcggggtaagcgctcccggcccgcgcccgccccagccccgacctggcggggccaggacgctggttcatacactccaagagatagagttttgctcttgttgcccaggctggagtgcaatggcgcaatcttggctcaccgcaacctccacctcccgagttcaagcgattctcctcccacaacctcccgagtagctgggattacaggcacccgccaccacgcctggctaattttgtatttttattagagacggggtttctccatgttggtcaggctagtctcgaactcctgacctcaggtgatccgcccacattggcatcccaaagtgctgggattacaggcgtgataaattgaccatcttataccaggaagtcaaatgagaagacatcagtaaaaatattctggccaactcatgttttatttatcatatcttcatcattaattgcttctcataatgccacagtttgtcatggtatttgtggcagcaggcaaagtccttgttcagactttgattaaattgctgtggcatttttctattaaaaagatctcctgtttcaa

SEQ ID NO: 223884 - DNA, 707 bp, Homo sapiens
cctggggccctctgacaagaaaccctaggagacaccgcggagaactctgcctctgagctggtgggcgggccggatgtagccgagcgcggacagggctagtccggacagagtcccagagccatgggagcgaaaagagactgctgcggattaaggaggcctttcggttggcgcagcagccacaccacaaccaggcgaagcaggtagtggcgctgaatcgctcctgccgcgggagatagagttttgctcttgttgcccaggctggagtgcaatggcgcaatcttggctcaccgcaacctccacctcccgagttcaagcgattctcctcccacaacctcccgagtagctgggattacaggcacccgccaccacgcctggctaattttgtatttttattagagacggggtttctccatgttggtcaggctagtctcgaactcctgacctcaggtgatccgcccacattggcatcccaaagtgctgggattacaggcgtgataaattgaccatcttataccaggaagtcaaatgagaagacatcagtaaaaatattctggccaactcatgttttatttatcatatcttcatcattaattgcttctcataatgccacagtttgtcatggtatttgtggcagcaggcaaagtccttgttcagactttgattaaattgctgtggcatttttctattaaaaagatctcctgtttcaa

SEQ ID NO: 223885 - DNA, 455 bp, Homo sapiens
cctggggccctctgacaagaaaccctaggagacaccgcggagaactctgcctctgagctggtgggcgggccggatgtagccgagcgcggacagggctagtccggacagagtcccagagccatgggagcgaaaagagactgctgcggattaaggaggcctttcggttggcgcagcagccacaccacaaccaggcgaagcaggtagtggcgctgaatcgctcctgccgcggggtaagcgctcccggcccgcgcccgccccagccccgacctggcggggccaggacgctggttcatacactccaagaatgtgacttgtacgatgttggctgttggtttgaaataaacaaagaacaatacaaaaaccaagtacaaagaacaatacaaaaaccaagtacaaaaaaaaataaaagaatgtgatttgaataaagtcaaaatctgctgtttaaaaactcaaca

SEQ ID NO: 223886 - DNA, 438 bp, Homo sapiens
agcgattaccttgtgttttctcccgccatgcagacagtcactggagcctgcggatccttttgtctgcaactgaaaccgcctttgcaaaattatgactgagacagtgaaagaggtccaacttaaacgactccatcttgcctctaacctccaagctgtccttgttcatttctgggcgcaggctgaaaaaactttgggaggaacttagtttatagttttaaaaaatgacaataacagccctttcccagaacaaactcccttcttgcctggagactagactactaaagttagccacagtattagaaattacggtttaggagtcaagtagttggaggccacaagattctgaccttccctaaactgctcccaagatcagtgcctgagatgttttgcagactctactcttgatggatcaactggcaccacccatatcgagaaacc

SEQ ID NO: 223887 - DNA, 376 bp, Homo sapiens
ggttcacgccaccactcctggctaattttttgtatttttgacagaaatggggtttcaccatgttgcccaggctggtctcaaactcctgacctcaagtgatctgcccgccccggcctccgaaagtgttaggattacaggcatgagccaccacgcccagcctaaattctgatttttaatgtttaagtaaatttgttttccttgcaaccatcaataaaatgttttctattatttatatgtaggataatctttttgggtttcttccaagatttttcctttacctttgatttttcagtagtatgaccttaatgtacctggttgtggttcattttatcctgtttgtggttcactgagcttcttggatctggaagtctgtttt

SEQ ID NO: 223888 - DNA, 351 bp, Homo sapiens
gaatgttgatttctactatttagaaaactcacacattatgaatagatatttaaacattgcgtctattatacttcttgccttccaaatttaatattgtattttatctgcaagaatgatgtttatctgcttattagtcagtatgtatgacaaatcagtagacttaaagttcagtaaagcacacaattttgctataagtcaggatgtgtcaccttgcaagttggtcattacacattttatttgactttgccgctgagtttatagtgagaaattgggctgggtgtggtggttcacacttagagtcccaacactttgggaggccgaggcgggaggatccctttaaaccaggagttt

SEQ ID NO: 223889 - DNA, 1581 bp, Homo sapiens
agaactttcaccttacaacttatacttctacagcctcgacagcagtgggaatcaaaacctttatgccacgtaccagctttcacacttccagagcatatctgttttaggcaacctggaggccaggatggtggatactgttttgtatgacaacactcagctacagctaaaggcagagtcaccatgggaggctttggactggggacagaagctttgggaagtagtgcatgctgctgtgcccggttacatggggcggcagaatgagctgacaatctcaccagggcttggccatcatgatgactatacacagaatcatagtttccagaagaaaaccagtgggctgctgccaccgtcccctgtcctggacagctccaaacagtaccaaaacatcctcaaatcagggactctctacaggctgactgtccaaaacaactggaaggcatttacatttgtgctgagcagggcttaccttatggcttttcagcctggcaagctagacgaggatccactgttgagctacaacgtggacgtgtgtctggctgtccagatggacaacctggatggctgcgactcttgctttcaagtcattttcccccaggatgtccttcgcctccgagctgagacccgacagagggctcaggaatggatggaggctctgaagatagctgccaatgtggcgaggagttcagagcaaaacctgcaagtcacactgaggaacaaacccaaggatcaaatgggtgggcatgaactcaggaagaacaaacgccaatctgtgactaccagcttcctgagcattttgacgactttgtctttggaacgaggactcactgctcagagtttcaaatgtgcaggtatgaagcagattttcagcctatagctcattaaagaacaatcctgaaccccacaattggaattcactttaaaaatccccttaataggctagtcacagctatctcctgtttataaaaagtatctctcctcgagaagcttactgtattaaaacatcctatattaaattactatattaaaacataaggacaaccatctttatcccatgctgttgaagtaaatagaagcagctatgatatatcctgttgaatcaaaatgatttggctaaagcttaaccagactagaatttaggtttcctgagtcggctgtgattccattccctctgctttcttgaataaaggtcactgtgaatatggatgtcacaaattgtctcataagaaacattcaagtccaaagctgactactaaaactccttaggcaaggaaaatggccacagtcagtaactgtcattgatcttgaccttgtcaaatcgtcttaaggtgaaatctagaaaatcagtcttgacagaaaatgtgggggtggctaaaagcggagtaaatgatgattcagcagatgaccactgagtcactatgggcttatgcccatcatggggaagccaggccttctggaactgctatgtaaggatgagatgcaaagtggagtttgaggtcaacaatcttattttgtaaaagcttgttacttcatctttcctctactccccattctttccacctttcctgaaacagtaaaattacc

SEQ ID NO: 223890 - DNA, 500 bp, Homo sapiens
tcaatgtgtctctgcccatgttcttgccaacatagtgttaccaaatgttttgctctttgataatctgctagtgaagatattactttagtgtctttctgatttcttttttattttgaataagatcgagcatctttttgtatatttaagtcatttcttcttagcggacttttattttgggcacttccattttttattgtgctgtaatttacataaggcaaagtatacacttgtagatgtataactcagtaaactttcttttagttgaggtatgatttactttcaataaaatgaacagatgttaagtgtactgttttgatgagttttaacagctcatgtaaaactgaccatgtaacccaccccagtcaagatttagaacatttccatcactcagaaaatttcctcaggccccattttgtttttccttctctccatcttagacaatcagttttctaatttctgttaccataaattagttgtgcctatgattttttaaaattaaa

SEQ ID NO: 223891 - DNA, 154 bp, Homo sapiens
agctgcttaattctcccgaaactaaacttggtctgttactctgtctaaatatgttcttcttctttaatttcactgtcttatttaattactattactctaaggtacatatgcttttttgggctgctccaataaaatttctttcaatattccacta

SEQ ID NO: 223892 - DNA, 314 bp, Homo sapiens
gaacacccagaaccttcattattggtccaacacgtcctaaaaccaaaccttggccgcgcatggtggctcacgcctgtaatctcagtactttgagaggccaaggtgggcggatcacgaggtcaggagatcgagaccatcctgactaacatggtgaaaccccgtctctactaaaaatacaaaaaaaaattagctgggtgtggtggcggacacctgtagtcctagctactcgggaggctgaggcaggagaatggcgtgaacccgggaggcggagcttgcagtgagccgagatcgtgccactgcactacagcctgggg

SEQ ID NO: 223893 - DNA, 656 bp, Homo sapiens
gatgtccactactaaaaatgttttatgtgtggatcaaataatttattttaatattagtcttgaatagaaaaatatactaatatagtttttttcacatttgctgtttgtctcttcttccacctcaaaactcatttttaacatagttcagaaagttatcttataattgctaaataagaacatgatgatgtatttaacagtttggatttttctccaggtaaagatcaggtttccactgatgtttaacagggcttgtactgtgttaaatacttagctattctgaattatgattcaaggctaaaaggtataaatagccttcaaataatgtactttgaacttgaattatattgttgattatttcgactttataaaaatggccattttagtaagtcattctgtattgttattcaatggaaataatgtatttgtaaatgttctgccatagagtctttgaaaagatttctaatgctgtgtgtaactgaagctggacctgaagtcagtctttgcagtgtcatgaaaccataaaaatgtggaactgagagaaatgactttttactattatgaaattcttctggagaactttgaaacagcaaatggcatgtagaaggtatacagaaataagtgcacaaaaacatgcaacatagtatttgatacggtca

SEQ ID NO: 223894 - DNA, 528 bp, Homo sapiens
gagctcgtttcttacatcacccacttgaagtcctgtatcacaggcatgtcctcttagacctgctctatggtttttctcttactcagactccttgggtgagggttggagtatttgtggggagagacaactcggcagtgagatgtacgcgctgcttgggctgtggtaaatcctagtaacatggtcttaacactgttggtcaggcattgaatttaatgtcctaataggtctggctgctcctctgccatctggcaggatgtatcatctgtggttttgagcttatcacctcctcaaaggagaatccccacttgtactcctgtttctatttgcgtatttaccagcgattccccagtgctttcatttaccttaaaatcacagtggacacattgtctcagccctggaggggttttgttttgttttgttttgttttgtttttgaggagtctcgctctgtcacccaggctggagttgcagtgagctgagatggcgccattgcactccagccctggagacagtgcgagactgtgtctca

SEQ ID NO: 223895 - DNA, 750 bp, Homo sapiens
attatatatgggaaaaatattttaaaaatatttttattgtgggaaaaatatattaaaaacataggatttccctcacctgccattttaaatgtccaattcagtgacatacaatacgttcctggtgctgtgtgaccctcaccactgtccacctctgaaactccgtcatccctgtagaaactctgtgtcattaaacagcagccctcgctaacccacccccagcccctggcagcctctgttcattctttctgtgtctataaatctgaccattctagatgtttctcaaaagcggagttatacaatatttataatgttgatctggcttatttcagttagcatgatgttttcaagattcatttatgtggtggcctgtgtcagaactgcattcctttatatgtctgaacagtaatccattgtgtggacacccccccaccgccgccatgttttgtcgatccattcatctattgatgggcatttgggccatttctgcctttggctgttgtgaatagtcaacagtggacactggggcatgagtatgcgtgcaggtcccagtcttcccctccgttgctcatctccctcgggaatgacctacaagtggaattgcagggtcatatggtgattctggttttcattgtttctgtggggatgagagatggaagcggctcattcagacatctttctggaatagtgttttgcaggcattccagtgattgtaatgccattagttattggaaattaaactagacctccaaa

SEQ ID NO: 223896 - DNA, 412 bp, Homo sapiens
tagtttttgtttgaacataatttttcaaagcagctgtctaaacatacacaatttaggggtgcatttgttggattgtaaggtaagacttgtttatctttgggaaaaactgtcaaactatttcccaaagtggctgtacccattcatgcattctgccagtaatgaatggccgtacctattgttcttcaacctccaattgttactgttgagcttttttaagagtcccacagttgtactaggtgtgcagtgatatctcagcattattttaatttgcagtctcctaatgagatatattgagcatccttttgtgtgattatgtgctatcagtatattttctttttttttttattttattgagatagagtctcgttctgtcactcaggctggagtgcagtggcgtgatcttgggtcactg

SEQ ID NO: 223897 - DNA, 297 bp, Homo sapiens
tcaaagaaatatcatattaagagacctgttcagaaaatggtgaagactggcagtccaaaatcaaggttggtgtatggtgaagcctcttctcctggctttcagatctccagcttctgtgcccttgcatggctttctttggtgtgaatgccacgaaaagagcgagtctggtatctctttctcttcttataaaaacaccagtcttatcagattagggctccctaattactggaacttataaatgttaccttctaaggaaaaagagtctttgcagatataattaaattaaagatctttata

SEQ ID NO: 223898 - DNA, 576 bp, Homo sapiens
gtttcaccatgttagcccatgttggtctcaaatttctgacctcaagtgatcagcccgccttcgtcttccaaagtgctgggattacaggcgtgagccactgtgccctgcctgcctacatactttattgacattttggctaagtgtaaatttggaactttcccagatgttttaaggaattgatccattgttttccagcttccagtgtgggtattaagaaggcctgcaccaggtgaatgccttatcctttataatgacctgtcttctttgtatcttctttgagatcttctctttgtctccacatccagaaagtgatgtgctttggtgtggatctttgttcatttattgtgcagaacacttaatggaccatatctatattgacattgatgactttttttttgttggaaattgaattgaattattcttcagataatttccttctcttcattttctgtttttctgtctccatgtctttctggattgctattatgtattggatcttctggtttttaaaatcttcttctatatattatctctgttttttggttatatgctctggggtagagttgctcattttaa

SEQ ID NO: 223899 - DNA, 334 bp, Homo sapiens
cagtaaggtgttgaagacagcacttagtatgttaagtgatagttattagcttttgtgtgtcattttgtgtagtctacagatttagggctcgtggcacacgttctcactgataagtgagagccgaacaatgtgaacacatggacgtagggagggaacaacacacactgggccctgtcgcggggtgggaaccggggacaggagagtatcaggaaaaatagctaatgcacacagagtgtaatacctaggtaatgggttgatagatgcagcaaaccaccatgacacacatttatctatgtaataaagctgcacatcctgcatgtataccctggaactt

SEQ ID NO: 223900 - DNA, 383 bp, Homo sapiens
aataataggaatttgttatatgtttgacatttatcaggttactagttaaactcttttgagatgatagtacatgacactttaaaggcagaaaagcttaataaaaattacaaagtaggacatcaaacgccagtatccttggatagaaagccatcccagatcatgaggaatgaaaacctagaaacacctgtaggaaaataaagctcatatgtaagaagagaggaaggagagacatgcagcaaatgttgcctacgggcaacttcatgttaaggatccatgttctgatttgttctaagcccccaaagtatgagtatttattgtgtgcactgttagtgctattattatttactgtgaatgttataataatagttctctcaatgactcat

SEQ ID NO: 223901 - DNA, 327 bp, Homo sapiens
ggataaacatattcttttatttaccatttgtcaggttttgtatgctaaattgcaactgcttatatacactcatcaagtatctcaaggataaattaaaattcttagtaaaaatccaactgaccggtacagaccacaaaaagtactattttaagcctttgggggcttaaaaattgtgtgtgtgtgtgtgtgtgtgtgtgtattcacatggtgggagaaaaagaactttccagataattgtgaatggcatactattatataagagtttaaaacgcaatatttctgtacgatcaaagttcttaactcatgctttttttttttttttttttt

SEQ ID NO: 223902 - DNA, 454 bp, Homo sapiens
gcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttataaatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctct

SEQ ID NO: 223903 - DNA, 724 bp, Homo sapiens
tcttgaatgagttttaagtgcttagttatttcctggagatagattcctagaattgaaatttgctgattgtatgtagtattttacagccctctcccccagccctaagcaatgttgagtgttttaaaaacaaaactaaccttaaattgtttttatgataggcggtttaaagtatgctattttcttttatcagtggccactttcttttaggagcgtagactttaaaagttggatgaaaatagaatgtttacattttgtttatattttgaagatgtaaataaaccaaggcagtctctggatgataccctttgtacctaaaagctattgagaaaatgttttatttggatttgttaaatgactcatttgtggggtcctttagtttgcagtggtttcagatcaactttctaggagatgtggcacccatgagcaccctgaaatacctcgggataattctctggttttgagggtggcccgcctcctacagataagattctttgtatggtcggttgtgaggccatttaaaacttttgccttaagacttcataaatcagagttgatacattgattgtcccttttggaggctgcagttcttaaaacatgtggctgtttttcctaggaatatttaagtaccacttgataataaagtactaccttttgctgggattatctacctggaaaaaaaaagggaacaaaaaattaaaaataaaatgtaatatctgtggtgttt

SEQ ID NO: 223904 - DNA, 445 bp, Homo sapiens
attatgaaagatacagtactggaattagccagctaggggccctgcccttgtgatgtatactttgtggtaagttgtaaacgtgagggtgggtccacaggccaagacttcagaggaagtctatgctttgacctaccttcataacaattatgtgtatacacataataactgtatataaactataaaggacaaaaccgaaaagacatagcgaatcccagaaacaagacaagtaatagagcagctacctaaggtggtgagcagagctaaatgaaacccaggcctggttagccccaggttgaggagcaaatagtgttggctgagaattaggctccaaccgggactaaaaacacttactgggaggaagggaggttggatctaggcttactgcttgaaaccaaaggcaaggctgtgggtctctctactccaacacctagttgtaaaagaagaa

SEQ ID NO: 223905 - DNA, 496 bp, Homo sapiens
tgctttatggcctacaatatcatctgtcttggtaaatattccaggagatcttgagaaggataggtattctgctcttgttacatggagtaatctataaatgataattagattaactagaatgacagtgttgttcaggtcaactatatcctaactgattttctgctagcttgatctacaaattactgaaagacgttgaaatttttaactataatagttgatttatctatttctgccttcatttctatcaatctttgccttatacattttgagactctgttgatagatggacacacaggaaaaatatgccttcttgagggattgatccttttatcattatataatgaccctctttatctctgataattttacttgctctgaaatcattgtatgaagttaataaagctatttcagctttcttttgattagtcttcacacagtataccttttcctatccctttacttgtgtcttggtggttgttttgttgtgtgtgtgtgt

SEQ ID NO: 223906 - DNA, 437 bp, Homo sapiens
ataatttattcccatgctcccttatcgatgggcatgtaaattgtgttaattttatatgatataatgagtatccttatatgtatatcttggcacagtttttcgagtgtatccataaagtttcttgcaatgaaattatagggcaacaagggtgtggtggctcttgtctgtaatttcaacactttgagaggctacggcaggaggattacttgaggccaggagtttgagaccagcgtggacaacatagtgagccctcacctctactaaaaattaaaaaaaaaaaaaagaaaaagtttggtatggtgatatgtacctgtagtcccagatacccaggaggctgaggtgggaggatcatttgaacctgggatgtcaaggctacagtgagctatgactgtgccactgcactgcagcctggatgacacagtgagaccctgtctcaa

SEQ ID NO: 223907 - DNA, 337 bp, Homo sapiens
ttggtctgcaagactcacctctggttcagcaaaatggaaggggccagattctgtcagaagcaaatatgaatacctagaggacacccagaccgacgaggccccctggaacctgctcctttggtcagccttgggtatctcatgcatgagtgaccatgaggtggcccctcacttctgcctcccgggtctccgggaggtgggggccttggtccgaggggtttcctcagctcagcagagggagccacacctggtcagcacagggtggaatccagggtcttccaggagtgacggggaggaagtttggtgaggactgaaggtaagaaggtacctccacgctctc

SEQ ID NO: 223908 - DNA, 105 bp, Homo sapiens
tttgggggttgtgtatattgactgaggccacttgtgcaaccgcttggtctaataataaagttcaacactttctggtctgagaagacgggaagccagttcccagta

SEQ ID NO: 223909 - DNA, 325 bp, Homo sapiens
gtggagcccttatgacctaaatgcctcctgaaggttccacctctcaataccaccacaagaggaaccaagttttcatgcttgaactttggggggacacattcattatatcaggcctcctggttatacaggcacattcatggtcttatatttgtgacttctgcttgttactgggaagaactgaggtttcttgaaaagactacaaaatttgaggccctacccaaactgtttaaggatcagagcactactgtctgtggctgcataaacttggcacgttgctacactactctgaaccttagtttgccatcaataaaatgaggagaaagca

SEQ ID NO: 223910 - DNA, 647 bp, Homo sapiens
gcacactatgggagctcagtaagggttaccgttgttatgcatctcttcaagaatatttcttgaggacctgctatgtgtcaggaactcttctaggctctggggagtttgcagtattggcatctgctcatagccttactttctagtgcaagagctagagaaaggataatttcagctgctggtaagtgttatgaaagaactaagacggttgtgaaagtgtcgcgcgaggacctgcagaggaggtgagatagggtgttaaggaaggcctctctgaggaggtgcattgagctgagacctcagtgattgagaaggagctggctctgaggtgactagggggagattattccactggagagaaataccagtgcacataaatgccctgcggcaggctgcaaatagtttgagcagcagaaaggaggcctttgtggctgaacatcaagagtagtgtaagagatggattgtgcagggtcttgtaggcgcttggatttcattctaaatgtagtgggaagccatcttatctgggaggatgtttaggaagggaagggctgtgatttctctgtagagagtggcctttccaggcataagagatgaagcaggcaggtcgcttaggaggccattgtcaggtaagagatgatggtgacttggagtag

SEQ ID NO: 223911 - DNA, 510 bp, Homo sapiens
ttcaaatacaacatgcaggtttgcagtgagagagtagggtgagggaagatttttttaaatcctgtaccacactaacaccaccaggcatactgttttaattggcatgattacattttaattggcatgaaaaaaattaaagacaaggattttaacttctaacaatagtaaaatagaggtatatggtttttaatattactttcatctaaggtgaacagtgtggaatggaaatacattagaatgaaatgtcagtggtgcgtacagtttaatctgtgaaattgtgtcccctgtgctgcatattactctgtctcaattgcatattaaacaaccctatcaaggcaggcattggcatctgctgtgctgacacaaattgtgaattaaatgaaattgatgtcctctgtcgtatatttatgaagacggaccattctctgaagtattctgtttatgaagaatttatgattgcaaactgttccagaacaaaaaagtggcaataaattcttttttgtgacccta

SEQ ID NO: 223912 - DNA, 446 bp, Homo sapiens
tgactgatgcaggggcacttcactaaacaaatacagaatattttgaagtaaatgccactaaaatggtatataaggagttacatatttgaagaggtactaatctataacttggtcctccaaagtgtactcaaagtcaggtttccaatatataatgactttttttttctggaaggaaaagagtaaatttttataattgataaacacatttttaaaatttttgaggtttgcttaagagcctaggatcacagtatcaagactagaggtagcaaaatagaaatagaatagatagaaatatgccacaaaccctcttcactgtagatggtcaattctacagcatggttcttacaactggtaaaataaaacaaaaccagaaagctcttttttccttcaactctttgctattaagagaactgcccatgcttcccaatttgaggattttttaaaat

SEQ ID NO: 223913 - DNA, 405 bp, Homo sapiens
cgagctcggtacccatggcatgtagtgggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaccaagtaaatttcttattgatggcaactaaatggtgtcttgtagcatttttatcatacagtagattccatccattcactatacttttctaactgagttgtcctacatgcaagtacatgtttttaatgttgtctgtcttctgtgctgttcctgtaagtttgctattaaaatacattaaactattaa

SEQ ID NO: 223914 - DNA, 419 bp, Homo sapiens
ctcttgaggacagaattttttgttaagggtcaaaaatgacagtttgagtccataaaagattgaaatctttgaagtgtgttttctagaacaggagtaagcaaacttacctatttttacatggctaaaaacatcaaaaaagaataattctttcaggtgatgggtgcaccaaaatctcagaaatcaccgctaaagaacttattcatgtaaccaatcactacctgttcccccaaaacctgttgaaataaaaaataaataattctttgtgacatgtgaaatttgaatttcattttctatttataaataaagtcttattggaacacagctgcttttgctttataatggcagagctgaggagttttgacagaaactgtatatggcattctcattacttcaagctactgtttggtgtaccacaaatt

SEQ ID NO: 223915 - DNA, 420 bp, Homo sapiens
actgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaa

SEQ ID NO: 223916 - DNA, 314 bp, Homo sapiens
ctgttccaggatcccatccagaatacattacctttagtcatcatgtctcctgtggctcttcttggctgtgacagtttctcagctttcccagttttaatgaacttgccattttcatcagattgtaccaagacctactatcaatatgacttatgactagtggtgctgaccttgatcacctggctgaggtagttcttgtcaggcttctccactgtcgagttgctctccccatcccccttttccatattgtactctttgaaagaaagtcactatatgcagcccttccttaaaaatattaaaatgaactagcttaatta

SEQ ID NO: 223917 - DNA, 182 bp, Homo sapiens
gggagcaacacaaaaaaaatgtggcttccttgaaagttcttcatgtatttaaagatcactctcaagcctgcagtcaacctggagtaggcagatgaagcagctggggaaaagacctcttgacctaccaacaaacagtcacaggtctgtaattttgaaatacagcatgtgcacaaaagagagta

SEQ ID NO: 223918 - DNA, 807 bp, Homo sapiens
atgggtactgtctaatgttcaaagaccccatcagctctggtcactgatgagacattctaagagtagtgcattaagaaccttggtagagaaagtcactgtgggaaatctgataggataaattgaatatttgaggggaaaaccctctttatcccttttgtcccaagcctgattcaggaaaaaagaaatgattaatgatctcacattaaaacccagtctcctacacctcctgtatctctttccatagtcctgaccccactccccccaaaaaatatttgaataagacccctgagtcctaatacttagtacataccgtatgctgtgtttactgagacaagaaaacaaaagactttctggttcacagggaaaaaatccaggtctgttgaatagcagaaaaatagatcagatcagtgctaaagttgtgaatgctgtgtggtgtcttcatatattttccaacttttttaaacgaaagagtttttggtgttgtaaggaaaaaaggagttgggagtgaaatgaaagacagagagaggcaggaaaaaaagagtgagagtgaaaggaagaaaagaaaagaaaaagaaaggctgaaagatttcaggcatctgtaatattatatgctaagtgctggcctgaagcaaaatgtcacaagcaacctacaaatggaagtttaaaatggaaagagggagaaacttatccacagccacatgagaaacactgttggacataaacaactggggggtcagagctggaaggggctcacattgacacatttttcacatttttatattgtagaattcacaaatctctacttgg

SEQ ID NO: 223919 - DNA, 487 bp, Homo sapiens
cttatgcaactcctaaaaagttgatcactgatggatgctaaagtgagtagatgtcaagaaaaatttatagtggatatatcaactgacaagattgaaatccagggatcatccagtcatgcttgcctcttggtatgataaaataggaagtattcagccttacctatcaaatattgcacacaaaataattgaatctgaatctaatcaagaatctagttctattgagattacaggaaattgtcagactagagaacgtgtggaatgatattctgagtatgtaatcagccaaatccatactgtgggaaattctacagaattaaaacctcatttctttagtaaatcaattttctaaaagaaggaagggaaatgtaactattgtaaccattatagatggaaagagtcttaagagacatatcaatcatatggactttggatattaattcaaacaaacctaaggtaagagaaaaaaccccacacattttaggacaaa

SEQ ID NO: 223920 - DNA, 579 bp, Homo sapiens
gctccagctgtggcaatttagaaactgcactacgcatttcttttttctgttttcagtgcagttagagtgcaaatgtaacaaaattaaaacctaacaatgcaaaatcttggttctgattccagtatgaccactaattagttgagtgatttagggcaaataatagaacttctctggcctttagttgcccattcacccaccagcgaatcttcattgcagttggggaagaactaggtttctggttctacttagaagaatagttacttggctttcggctctgctctgataattctgtggctctcttaagagttaaatcctgaaaagtgcagactcaagagccatgtgatacaagcaaactcgttgctaggtgtattctatatatatatgcgtttttttctctcagaaataacggaatcaatttcttttaatcactttctcaatgcaattcattttttcctgtgttttcttgtccgggcaatattgacactctcctctttctcttatatttttcttgtagtcaaccatcagctgttactctctttttgttgtccataatggaaataaaatatgtttttaaatatg

SEQ ID NO: 223921 - DNA, 455 bp, Homo sapiens
tagagttgtaaaggccctgccaatgtccagagttagaatggtcataggtgatctgagagccttctggaaaacctacacagattcccagttaaagtcatgcatcctcattcccagccccaatttgtaggcctgagcagaaaataggagtcctgcaggtttgatcatgctgctgggaccagtagtggtacccctggcattcttaagacagtacctagggacccagctggtgctggctagctgcagggatgtttgtttctataacacccagacagtcagtcttcagcttctgcccctcttttccctgccaagagcccttttcgggctttatcagctgtgccatcatgttgatactctgggttgttcagggctgccctgtatggctttccccagcctccagtctttattcaaggggtagtgatgctcggataccttcctcctggtggcctgtaggcttt

SEQ ID NO: 223922 - DNA, 371 bp, Homo sapiens
cgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaa

SEQ ID NO: 223923 - DNA, 342 bp, Homo sapiens
accgtggtagcatgctaccattgtggataaactaatacattcaaaataaacactccccttaaggttcatctgactcagttaaaagtgaatacattttgaagcaaataatttgtatataaccaattctcaaaggtgtgtggtcaacagtgccacttctggtaaaacaagaaatactcatcaataaatactaaattaggctgggcacagtggctcatgcttgtaatcccaggactttgggaagctgaggcaggaggatcgcttgagcctaggagttctggaccaatctggataacacagggagacactgtctctacaaaaaaaaaaataataataaaatgaaat

SEQ ID NO: 223924 - DNA, 346 bp, Homo sapiens
gaattgttctgttgcaaatatgttacccataaagaccctcattgctatttacatttttaaaaatctagaaatcgttttttaagcagttcctaagaacaaccagctgaaggaatacagaaatttaatgcaaagcctaatttcaacaaaatctttgccaaactatgtatatatatatattgaaaactctttgtcttgattattattgaagccaatggtgcactttttttctattttatttagatgttttctgggtactttatttagctgaaatggtaatgtcaactcttaaaaccaagtattaaaatgcattctatttggaaagaaactttggatgctgtaacaaaaa

SEQ ID NO: 223925 - DNA, 339 bp, Homo sapiens
atggctctagagaaatgttatatgttttgctttatgtggtgcataagtgactgttttctccatatacactgaattaagttttttcttactaatttgagaggtagataaacatacctcattggtgcaaaattttgaatttattccattttaaatgatgaacctttgaccttcagatgactttcaaacattttagtcctcatttttaatttgtagtggacaatagctataatgcagacatttaaggaatgaagaggatgaatctctggcacttggaagtgtaatgaccaggcaggtggagttaataagcaaagcaattcagataacttgattgtctaaaat

SEQ ID NO: 223926 - DNA, 456 bp, Homo sapiens
atgaatagtttaaacagattattgcatttacatagcattttcctgttttcaaaaaccatttccatatttagtactcaggaaacatggtaaacagatattaccgttcccatactatgggttaaaaaactgagatttagagatttaatttgccaaattgcattatgagaggaaatttaagtggagggatgattcctctacttctacatggaaataaagcaattagttggatgttccagagcaaaagaaaagcctcagacttctttatgggctgaaaggagacagaacatccataaactcatgctgtcttcaaaagcagtatttgagcttttgaagtggtggctcatgcatgcaatcctagcacttttgggaggcggaggtcagaggacagcttgagcccaggagttggagatcagcctaggcaacatggccaaactcagtctctacaaaagagataca

SEQ ID NO: 223927 - DNA, 481 bp, Homo sapiens
ttagtcaacccgaaatttacgagtaagtcggatcattaatcttaaccatgacgctcaccaatgtggatgcactttgaggaaatcctagcattttgtgcttggagttggactctggagaaaatagccattccctcgtgctgcgacagttccattcctaatgcagacttacaaaaactaggtgtaaggctggcattagggtgaggccaggatgagagcagggctttttgaaattgcaaggagaagcaggtcaaacctggccaaggtttccccagtcaaagcactttccttttccaggaatccctttaaggaagaaaataagaagaagcctgaagcttgcaagctgcttagctgccagttttcccccaactctccaacctccccaaagtccttgtcccctgcaacccagaagccatatctacaaagcaaatgaaatctcagccatgctacaaagtcaaagcctctgagaaaactgctcaggcgt

SEQ ID NO: 223928 - DNA, 263 bp, Homo sapiens
gaggagaggagaacctcattgtatgggtaaattttcctacataaagtgaacccagagcaatcagacagctaatatttattgaaaggaacaatgtctgttatgtgtcatgtaaattagccatacctagtattatttaaccttcacaaaactccagcaaactatcgcaaggacaaaaaaccaaacatcgcatgttctcactcataggtgggaattgagcaatgagaacacctggacacaggaagggggacatcacacaccggggc

SEQ ID NO: 223929 - DNA, 501 bp, Homo sapiens
caaagacaataagctgctccttcttcatttagcccatctcactgttgacttctccagagaagacgctgtaacagagtttgaagaacaagatctttcttggaaatcaacacctgtgaaagcaagagggtataagcagaattgtgcagaggaagaaggtaaaccccaatgtaggcccaactgtgcatctactgatgtggcaaagagcaaagtgaatgttgcttatcagactttctacattggacctgcatggtcaggaaattacatccctgcctgggtgagtcactgtatgtagtatccccaggaagggcatgacctcatcaaagtagatttctgcagttgagacagaccctgaagatgtcagatggaggctgtttactgacaatactccttgtaatagaacagctaccccttccttgtttcctttgactctcaaacaaaaaagacccatgcagctctttggatagaaataaatatatagatatttgggtgctgcctaaaaat

SEQ ID NO: 223930 - DNA, 545 bp, Homo sapiens
aagactgaattcatagtctgcgctcttaaccccacaatgaatagccactgaaggatgacttcctcttcgacagaggaatggatctgggaccaggttattaaataagagatctgagtttgaaaggtccttgggccctcacccacccatctaaacttgaacactatccaatgttaattcaacattaaagggtagaacaacttagtggttttaggagcgtggactgatgagtcacacaaaccaagtcttaaggcctgctgtgagccaaatactagctgggtgaccttaccctttctcatcatatgcaaaatggcgataagaacagcacctgcttaatcgagcagttttgagtattaatgtaaatgatccacgtaaaccacgcagcacagcgctcattaatgtaactgcaaatgagagccatggaaaagggcaggtaggagctataaaagaaagtggagcctgtccccgagtaacccagccgatgagagcaacgactctccccagcagcaggggcagtcgcccccgcccactgccgcaggcccgtcctt

SEQ ID NO: 223931 - DNA, 379 bp, Homo sapiens
attgaaagaattttaagtggatcaaaagactatgagggactttctattgaaaactaagtgttgtttggagcttactcttccacctatctactttgtgttatttgtgcctttcatcatctttgagctattttacaatcctgccgagacagacattaatttgtagaaaactggtgaaagacaaatatttcttgtttataaatatacacataaattatattcaattgaggttcaattgactttctttccccacagtaaaaagaagctaactttacattgattaaataaattcatttcagcaatcatcttttttttttcatttttcactctgttgcccaggctggagtgcagtgctgtgatctcggctcactgctacctccac

SEQ ID NO: 223932 - DNA, 381 bp, Homo sapiens
acactggaagaattttcccataacagtcaatattttgtcctgttattaagggagactgggggaaactgtctatgatctgccaagctaaagttcatcatttagcaagttacaatgtctcctacttgaaaaaactgaatgctcacggccctaatcaggaggctatctctttcccactggataccttcattgaaactgagatctaatgtgtctcaagctaagtgatagtatcttgataggacctcatgatctaagtatccagaatctacacgggcttgattaactgagaagagagatagaacgcatttaaactcagaatagttatgctaactattaactagttttactaagcactttaaactatacaatacatataattattta

SEQ ID NO: 223933 - DNA, 349 bp, Homo sapiens
ggtgcggcaccgctggcccaggcccgggcgcggctggacatggccacctactgcgacgacctgggcccctcctcggccccgcccggccaggcccaggccaccgcgcaccccccgggctatgagccaggggatctgggcgcggtgggcgggggccccctcctgtgggtgaacgcgccagcgctcagccccaagtcctacgcttcgggtcccgggcctgcgccgccctacgcggccccgagctacggggctcccggcccgctcctcggcgccccgggcggcctggcgggcgccgacctcgcctggctgagcctctccggccagcaggagctgctgaggctggtgcggccgc

SEQ ID NO: 223934 - DNA, 629 bp, Homo sapiens
tcaggccagtcaaattagtcatgtatgaaataacctagcataatcaaacatacacggacacatacacacacacaaatgagtgtacttaaaagtggagaaataggagtagggttgtggattgtatcaatgtcaattttctcattggaatatgctattccagtggtgcaagatgctaccatagggagaaactggccaaggagtgtacagaatttctcagtattatttgttacagcttcatgtgaatctattatctcaaaataaaaagctgaagaaaaaaggcaaggaagaaaacaatatagtatactgccacttagttttttaaaaaaaaatacgtatgtatatgtatctatatagatatatacacagaaagacgcacatgcatttacaagtataagagctatatgtatactatttctgtaaggataactaagaaatcattaatactgattggttctgaggagaactaaagaaactaatggaatgcgtatttacttttcatagtatacctgtctgtggctgttgaattttgagctactggcattattcattcaaaaaataattttgggggattgagaacaaaatagccatttcaaacctaaaacaaaaacaaaacaaaaaaacagctcggc

SEQ ID NO: 223935 - DNA, 256 bp, Homo sapiens
cgtaggatatcagttttagcaccagtcttggggacacagtggcaaaaacgtagcagtttcgaaaatgtcagatatatttaacattcgatattcctttctgcatatgaacagttgtaagcttttttaagtataataggtcgcaggcagctttggtagcctatatctagaactattttttttctttaagagacagagtctacaacatttcccaggctagacttgagctcctgggctaaagtactcttcccacctcagc

SEQ ID NO: 223936 - DNA, 613 bp, Homo sapiens
gaatgagtgctaggattacaggcgtgagacagacacacatacacacacatacacacacacagagtctttattgcagaagacagtgtgttgccttataggcgtgagacacacacacacacacacacacacacacacacacacacagtctttattgcagaagacagtgtgttgccttaccagaatgagtgcttggattacaggcgtgagccactgtgcccagccctaacttttaatgtacatcacacacacactcacactcacatacacacacacacacacactctgactgtctttattgcagaagacagtgtgttgccttacccagaatgagattgaattgttttgcttcgttttgttttgttattcagtgttgcggtagcagatgcattatcaaaggaaaaatatttggctcctttaattcctctgaaaacatgagtattttgagttctgcagcacaatgactgtaggactaagctaagtctgctttgcagatatctgatcagatagtcccttcattctgtagacgtgtattggttggtccaagacacagtgagtaggagctctgtggaccaagacaaagctggactagagagtacagttcaaacttggcagt

SEQ ID NO: 223937 - DNA, 638 bp, Homo sapiens
tgtaaccttttctcgctctctgtgtgactgagatatggaaaggcttctgtggggcatttttgcccttgcattgttgccttttgggtcaacaaccttgacacttaaacaaacagcagactgggaatcctctttgtaccagtgtgttgctgggtgctgctgataaaagggactagagagtaaaggccttctggtcagcaggtcacttagtcaacagctcttgtgtgtatgtgggggtgtgggttctgccttgctgtcagcactagggtgtgttccctcttaagcctggaattaggagttccagattcctagtacttaactaaaatttggccaggcgcggtggctcacacctgtaatcccagcagtttgggaggccaaggtgggtgaatcgcctgaggtcaggagttcgagaccagcctgaccaacgtggtgaaaccccatctctactaaaaaataaaaataaaaaaactagctgggcatggtggtgggtgcctgtaattccagctactcgggaggctgaggcaggagaattgcttgaacccaggagatggaggttgtagtgagctgacatggtgccactgcactctagcctcagtgacagagtgacagagtgggactccgtctcaaaaaaaaaaaaaaaa

SEQ ID NO: 223938 - DNA, 363 bp, Homo sapiens
gagtttcctggaggtggtttgtggccaaccgtcaattacttgggctgctgtgcagtggggatagaaggatgattagaatccacagacaacccattggcctttgtttaccattaacttctgttttctccaccagccaagctcctccagacccaggagatggctcttccctctgtgtagcacactctttccagtcaaggggtcttgcactgctatttccccttctgctttgcttggttcattcttactgaccctccaaatactgaaggaatgaatggagaaataagtaaatgagagatgtggccaagagtctccaagagaggaaattaaaaaatcctatacctgtgaggaactggcccacttgca

SEQ ID NO: 223939 - DNA, 499 bp, Homo sapiens
ttattagtagctgtgaaagaaaataaagaaatacataaagtgcagaaaagcataaggaaaaaatgaaaatagtcgtcccccacgtagagatgtcatcttaacactttgataattacctttccagatgtttttctggaaatcgaaaggtgtttaagggtcggtgaatatcacttatgggctgttaggtaacctactttttacttaatatatgaagctctttctatgttgataaatagataattttttacagctacagagtattacattttgaattttctataatttcttgaaactaattaatgagtgtttgtattatcagtagcactttgaaatcattatgtatatatacttatgccttgtctaattgttttctgtcactctgataggtaaaatgtagtgaactgcatgttttttgttttgttttgttttttgtgttttattttggtttttgagacagggtcttgctctgtcaccctggctggagtgtagtgatgagaac

SEQ ID NO: 223940 - DNA, 1272 bp, Homo sapiens
ccaaccaaaaccaaactcctggtaagctttattagccttttctacaatgtgtctcagtttctctttcacaccttggagtggaagacaatctctactcacactgttgtggtatgtgtctgtctgtctcagatgtgtgtataagactgctgtcttaaggcttaaaagtaatttaaggttttgttttttgttattttaagagttgcagtttctttggagacaacaaagtactttttttccaaagatgaaaaaggcatattcagactttctatgttatgttccataattgttttgcttatcactgtataacattctcattatcatgggctactttaagctaatcagttgcattttggggtcctcatttagaagtcaatctggaaaaaagatggctgtaaaacttagataaaccagtatgctatttctccttccttgtctgcctttacagatgtttcctctttctctctctcttccctgactatctctctcaatgatcattgacagctcccgcatcccctctttcactcagcttcactccaccatgaccagagcacctctcctgctactatgtgttgccctggtgctgcttgggcatgtgaatggagccacagtaagaaatgaggacaaatggaagccactcaacaaccccagaaacagagatctgtttttcagaaggcttcaggcatattttaagggcagaggtcttgatcttggaacatttccaaatcctttccccacgaatgaaaatcctagacctctctctttccagtcagaacttactgcttctgcatctgcagattatgaagagcagaaaaactcctttcacaattatctcaaaggctgaaagtttcttctgagctcaggtgtctggctattttaaaactacagatgaagcttctcattagaaaaattcaaccattgtcatagctaaactttcatggagtttctttccccctcacttttatttttcagtttgtaatgattttattccacatttccatatttacatataaatcgctggaactatgatttctatgcatatttatggagtttttttcctatgaaaccataaatattgatgtagagcaccgcatgtatttgtaggagttacaaaaacatcacaaactgaaaaaagattataatctaaattagatgtttctttaagcttgtttttaaaacttgtcttttatgtttattatcttttatcgaccaatatatttttttaaagggacatgctcacttttagtatagtaaaattcattatatgtgatagag

SEQ ID NO: 223941 - DNA, 1219 bp, Homo sapiens
ccaaccaaaaccaaactcctggtaagctttattagccttttctacaatgtgtctcagtttctctttcacaccttggagtggaagacaatctctactcacactgttgtggtatgtgtctgtctgtctcagatgtgtgtataagactgctgtcttaaggcttaaaagtaatttaaggttttgttttttgttattttaagagttgcagtttctttggagacaacaaagtactttttttccaaagatgaaaaaggcatattcagactttctatgttatgttccataattgttttgcttatcactgtataacattctcattatcatgggctactttaagctaatcagttgcattttggggtcctcatttagaagtcaatctggaaaaaagatggctgtaaaacttagataaaccagtatgctatttctccttccttgtctgcctttacagatgtttcctctttctctctctcttccctgactatctctctcaatgatcattgacagctcccgcatcccctctttcactcagcttcactccaccatgaccagagcacctctcctgctactatgtgttgccctggtgctgcttgggcatgtgaatggagccacagtaagaaatgaggacaaatggaagccactcaacaaccccagaaacagagatctgtttttcagaaggcttcaggcatattttaagggcagaggtcttgatcttggaacatttccaaatcctttccccacgaatgaaaatcctagacctctctctttccagtcagaacttactgcttctgcatctgcagattatgaagagcagaaaaactcctttcacaattatctcaaaggctgaaagtttcttctgagctcaggtgtctggctattttaaaactacagatgaagcttctcattagattttatttttcagtttgtaatgattttattccacatttccatatttacatataaatcgctggaactatgatttctatgcatatttatggagtttttttcctatgaaaccataaatattgatgtagagcaccgcatgtatttgtaggagttacaaaaacatcacaaactgaaaaaagattataatctaaattagatgtttctttaagcttgtttttaaaacttgtcttttatgtttattatcttttatcgaccaatatatttttttaaagggacatgctcacttttagtatagtaaaattcattatatgtgatagag

SEQ ID NO: 223942 - DNA, 427 bp, Homo sapiens
ggcagaggttgcagtgagccgagatgccgccactgcattccagcctgggcgacaagagcgaggagactccgtcttaaaaaaaaaaaaaaaaaaaaagtgacaccctgtctcaaacaacaacaacaacaacaacaaacaacaacaaaggcatagagctagtaaaggccgatccaatgccatgtcactccagaacctagcgcttagctacaaatttcattcattccttcagatacttattgaacgtttacagtgtaccagcattgtgctgggtgttgtggatacaatgatgatcaaaacagataaagcccctgtctttaaattgcttataaatctagcaagggagatagtaaatatataaataaaactaaatattaattacgattgtgatgcatgctgtggaggacagtagagggtgctgtgaggatac

SEQ ID NO: 223943 - DNA, 288 bp, Homo sapiens
tatatagagaaaagtgactgggcacggtggcttgtacctgcaatcccagcaccttgagggtgctgaggtgggaggatcacttgaggctaggagttccagacaaaactgggcaacatagcgaggccctgtctctacaaaaagtaaaaatactagctaggtgcagtggcctgtagtcccagctactcgggacgctgaggtgggcggatcgtttaagctcagaaagtctaggctactgtgagccatgattgcgccatgtactctagcttggacgacatagcaagaaaagag

SEQ ID NO: 223944 - DNA, 698 bp, Homo sapiens
aagctttggaatggatgcaaatgttctaaaatataagagtcttcaagctgaagaaactaaccagcaaagctctaagcatacagccctccatctaactaaaaataaggatgagcaggccaataagaatgatggacaacccaccttatatctgaagttccaaagggagagttaatctagctttatactgctctgagaactgtgaatgaaggataacatatgcttatgtagtaaaaagaaaaaaaggaaagccctccccttcccctttccctatctctccccttacacatgcatatgcataaactaaaaattttagatatcccatcttctgtagtgggaacatctttcagagatttaaaaagaaatccagagaaaatatggaaaaatattaaagcagatatttatatttagtttttatcagcatggaaaaaaatctctgaagttttgatttcttccaaaactacttacacattcgacaccaaaaaaacttaagaactcaaagtaggaatgacatataatatgtcactgattttaacctccctactagacactttaatcaattagtcaacaaacatcatttcctgattttctgttatatcattagtgtgctaggaaccatttctctctactaggagattaccacataattgtacagataaaacatacctgaataaaatgattacagaataagaaaaaattaa

SEQ ID NO: 223945 - DNA, 539 bp, Homo sapiens
gagaggtggtggtagttttgggagcaggcagcaggcagctcatggggcagtggcaagagcctggtttcgggaaccacacagacctcagctcaaatccaggctccatcactgtgtgactttagaaaaatgaccaccctctctgggactcagttttcccacatggaagatgaggataccaatttcacataatttattggtaagctgtaaagtgcagtgcacttaaggaggccctaccctatccccccagctgcctcccagagtcagtgcctggagttgtatgggtttcctgaacctctgggctggctctgacccaagaagtctgtctttctccttatgggctgtgacgggtatggaaccacctagaccaggaccatcctgaggtccatcccacctctgactgatgaggaagcatcctggctgggagttaggacaggctctgcatgtggacacacaggctgtgcacacttaagtggaaaagactgtcgactaaagaagaaatatcaagcttttaaagaattaaagttcactttacttagaag

SEQ ID NO: 223946 - DNA, 477 bp, Homo sapiens
taagaaatgaagcaggaagatgccgcttgaaggacaatacaagatgagtaacagggaccagaacacgctaccctagaatatgacatgctggcatttaaggagacagcagaagcaggaaggtctctctgaccttcttccaccattctcccctgaagcaggccatgaaagaattctctggcctttctctaaaataagtcataagactctcattacagaagactgttccttatattggggggaaaggaatgaagacaaaaaaacaccaagacgaatctgaacaaaggccttgctaagttcccctcattttataaccattaggtcacacccacttgtccaatcatatttctgcatgactgtccaagtcttcatcaaacctaaacatccatagatttccctgtttccttgggtcttcatttctgaaggctcccatgttacataaaacttacattgaatacatgtatgtgctttcttcttgtg

SEQ ID NO: 223947 - DNA, 418 bp, Homo sapiens
tttcatataaatggagtcaatcaatatgtgtggccttttgtgactagcctctctgaggtagcagacataatgttttcaaggttcatcgatgtaatagcatgtatgagtaccctgttccttttttatggctgaataatatctcattgaatggatagaccacattttgcctatccattcatccatagatgaacatttgggttatgtgaatagtgctgctatgcacattcatgaataggtagttgtgagtacatggtgtggctttggatttctctaaactttatatcacactgcagcttgctttgttttttcagtgttaggttatttccatgttgatatgcacagctctagttaattcattttcactgctccaaagcatcccatttttaaaattattttattttattattttttttgagac

SEQ ID NO: 223948 - DNA, 554 bp, Homo sapiens
acgtggattttacacttttatcacacacacacccatattcagaggaaatagttaaataagagacagagcaaggtaccaacagtagtaacatgtcagtggtaacattatagatggttttcattttctttttcatagttgttggtatgtttcaaaaatgatcaggtctttgaaaatcagaaggaaaatcagaagcaagagcaccaattgctaccaggtgaaaaccacaatattctctagcaatttctgcaaactataggatccttcataaaatatacaggtcctttaataattgatatgttcaatttttcaataaaaattctgatgtaaaataaggaaagaaacattcaaagtattcattttgatcttgtactcatgtttgagaaagatacagagcagtcaaattactttggaaagtgtaaaaattggtggtttcattttaaattgctacctctaacaccttcatgtgacttcagtaacctatctgctccctgacaaccttaaagtgcttaattaccacaaatttctgaaataaatctatcatttgaataacctta

SEQ ID NO: 223949 - DNA, 450 bp, Homo sapiens
cttttaaatattgtttgaattacaaaaatgaagtcatcaggtctaaatgtctcttgtgttttataagataatgctattttaatatcttttgccttccacatttttaattcttgacacctagcatttgagatctggatgaaaccctggaaagctctgattcaacccttttatttaacagataaattagccaaaggctgggaggctacatagcttacagagggtcacagagttaagtagaactgagattagaatccaaaattggagtctaatatttttttgcagtgccggagttaatctgttcatggttttccgtattttagtagcacaataacttttaaagtgttttcaggagaatcacttgaacccaggaggtggaggttgcagtgagctgagatggcgccattgcactccagcctgggcaacaaagtgagactccataaaaaaaaaaaa

SEQ ID NO: 223950 - DNA, 510 bp, Homo sapiens
taagcagctttctcttctcacttcagtatcctttccaggcccccggctgtgtaaacagaaattcaagttgttctggttaacttgggaaaaacccctaagctgcatagtctttaggtgtgctccgctccagccccacgttcttaatttaaagagctctgctgcacggaagttaggctgctgcactgctatttccagagagatccaacagtatctgcctttctcttattttggtccaggaggccaaacctgattttgtaccctctagtggtcaaggatatgggggaagaccccatcacaagagggcccacctgataagaaccctctggagactgctggcagagtcttcttaacaggacttggactgtgaccagataaaacatcttctataggtgcagaaactggccaatctggaaggtccaatggcttctacgttaaggttttcttaacaagatggtataccccgacttttacatggattgcttcttttaagtcctaaaagaagttgtattt

SEQ ID NO: 223951 - DNA, 415 bp, Homo sapiens
aattctatgggcaggtgcgcccctgtgaagcactcagacagcagagtagggctgacctggcaaggatatggcctgtctgccaactgtggttcctacctgagagagccctgtggaccagaacactcaacaccaggaacatccagattcataaaatgagttcttatagatctacaaagagacttagataaccacacaataatactgggagacttcaacgccccacttgacagtattagatcattgagacaaaactatcagtgacgttcgggacctgaactcaacacttgatcagatagggccaacagacatctatggaactctccacccagaaataacagaatatacatttttctcgtctgcaggtggtacatactctaaaattgaccacataggcataaaacaatcctcagcaaat

SEQ ID NO: 223952 - DNA, 309 bp, Homo sapiens
aagaataattttaatgtcgcccaaatggattatgctgacctcaacccagatccccctgggagatataaacttcttatatgttcctggctgggtcattgtaaataatatctacatgtatcccaaagctctgaattatcctcatctgtaacagacacaacgactaaatggtatctggaacgtagttaattttctggaaaatattcaaaggaacaaaatgagcactgcaatacaaaattgctgtcgacttaacttttgccagtttccctggatgtgtaagtagaattatattttcacagaacttgcaaaaat

SEQ ID NO: 223953 - DNA, 438 bp, Homo sapiens
atgtactcattgactcctttgtctgaaggcaaaatggttatttattgattcttttattcatccatattgctgataaaattaagcagtgattaatctgcttggtcaagtaggtatcatgctaagtaataaacatactaatgtaagtgaaaaaactctagatactaccttctaataggaaagataggcaaatattgatagtatatttttagaatgaaaagggttagacttgcaatataaatatacaaagtgtgatgggaacaccagtttgaatgcctgatcctattatttgtttatttttgatagagcgtagtgcctcaggaacatgggctcagatctatttgtttcttcaaatccatttgattttctacctgtgaggcccagactgtaaggagagtattagtacaaccgtatgaaaagtgaggagaggaatgcaatgta

SEQ ID NO: 223954 - DNA, 323 bp, Homo sapiens
taccccaccatcaaacaccagatcttttagtagtctaaggtagtatctatcaccactgagccatgtgaacttataaaatccatttcctaaactcggtgtcctcataatctaaaacatttccaaaacctacccattgtttcaattgtatttattaagtgcctacatatggcaggcatttcattggccaaccaccaacaataaggtaaccactgttctagggatacaacagagaacaaaactgattaaaaatgtatttgaaggctacattctcacaggatgttgtctggtatacagtgactgttcaatatatgggaagtgatcta

SEQ ID NO: 223955 - DNA, 556 bp, Homo sapiens
aattaaccaaatcaacattttgtgtgtatttataagctacaaaggttaacttttcattgatgacagtcagtacatttgcatatggggcagttttgagacccaaatgaccaaccccagaatacagacacatctgctgaattttaattctggagccattcaccatagtactcttctcacagtatgccattcccatggtttttttcacagtaaataaactggtgatataagctcatgataaatcataaagatcctaatactatgaatcttaagtaatggtatttaagagaaaacctctaggtcttttcaaacacttctgtatagtacaaggcagtctgcttggtacagaacgagagaatctttgtaggctttagagacccagttcatataatcagatcttagggttgcatttttaaaaaatttactacaaagcaaatctaattttagagacaaaaattaaaaattattccatagcaactaaaatgcccaatgatgatgaaacaaaagacatcgaagttctatgtaattaattcagtaaaaaaacagttgtggagctttg

SEQ ID NO: 223956 - DNA, 399 bp, Homo sapiens
aaacccccttccctcaatgtctgattaccctctcacctccaccatcccccaggtgatatctgttcaccctggtttgctttcaccaacagtactgttagggtggtttggccagaatccccctcatccctgatgtttcctcttaataattttccatctactgacctccatcctgcttcttgtctataaattcccactttttcttgctatatttgaagttggctcaatctctcttctctactgcgaaacccatcagagtagttcatatgcctatcttgatacttctgaatagtctatttgatacagtttggcttcatcttcacccaaatctcatcttgaattgtaatcccaataatccctatgtccccctgagaggtaattgaatcatggaggttgttttcc

SEQ ID NO: 223957 - DNA, 525 bp, Homo sapiens
agacctggattcgtgatagcttagtcgacatgtgaatagcgcaataatgattttcgagatcattggtgttactagtgaaaggtttaggacttttaaaataatttgactaaaaggctctttagtggaaaaaacgactcgccagtgttatggttatttttatgaggaaattatcgatcagcaaatattccctaagtagtgtttgtatacattgccctgggtaaggcataattagaattagtaagcaagtttggcgattcctgttccccgagaacttagttttagtgggtttttaacctgaggtctgtggatctggtggtaggtgattgggcttcagagttcataactcgcctgacattgtatacataattctatgtgcatttttctgggaagttagttttcctacaactttataatcagaatctcatacttgctcctaattccctatattgttaaagagccactggctcatttgactatctccagtattcatgcaacaactcttaagtacttgacattgagaaaaaa

SEQ ID NO: 223958 - DNA, 332 bp, Homo sapiens
cacacacaaccacgtctggctaatttttgtatttttaatagagacggggtttcaccatgatggccaggctggtctcgaactcctcacctcagatgattcacccacctcggcctctcagagtgctaggattataggtatgagccactgtacccggccaataatttttttaatttttaatttattttttgggcctggggtggtttcagcctcttatttgggaggctgaggcaggacaattgcttgaaaccaagaggcggaggttgcagtgagccgagattgcaccactgcactccagcctgggtgacagagtgagactccatcccccgcaacca

SEQ ID NO: 223959 - DNA, 479 bp, Homo sapiens
atgggagttatttaagctaaaataaaagtctgctaattaataacaaaaaacaaatgaaaacgagaaaaaaaggctcaatggtataagtgatgcatatccatactcagaattctctaacactctaagggtggtgtgtaaagcagttttagagagttagaagaaaaagctattaaaaacaactgctgaagtaaattgttaagagatacaaattaggggcagggccaagatggccaactagaagcagcagctatcagaggcttccattgaaaagaaccataacagtgtgcaaatcctgcactggcaattaaggtatccaggttctgtcattagaactgagtaggcagctggtgtgacccacagagaggaaggaagagcagtatggtgcagtgggccacctgagagccacatagggcagggcagcccccaccccccagccaagggaggcagtaagtgagcgtgctaccctgcataggaaacca

SEQ ID NO: 223960 - DNA, 449 bp, Homo sapiens
agtgtggagccaggcagggcccctcttcccccttcctctctctcccagcagagcccagatggggccctggggccagctcttgggagcttccagacttagcaggaggatggaatggggtggagtctgggggctgttgttcagggccagggactcagagcaggcacttggtgaacggatgccatgtaaatgtcaacaggaccacagattaggagatttctgtgtgtggttttgttagtgttatttcagaaaagggtgtgtgcatgtgtgtgtatgggggggctattgaaaatagggttgccagataaaatatcagatgcccaatttgggagacgtactaaaacattattcattgtttacctggattcacatgtagcagggtatcctattattgatgtattttgattttgctaaacctggaagctctaatgagaagagcattggctcaggag

SEQ ID NO: 223961 - DNA, 370 bp, Homo sapiens
attgttattgctggcattcaggaagttccaggagaaggtagttccaaatagcaaaacattgtacttaacagaggttcttctaaggagttaaaaactttatgtggcttttgaagaaatagaataccttctaagacgacaacaacagtagaacaaattttacaaagccatgaaaattagaattagaaatatattaggtggccagtggtggtagagtcaggatagaaaatagaagaaaccaaaaataaagtcagatagaacaagggtggatgcagttaatgaaaatttttggtggttatgtagattactttttaatccttttgcaaagctaagtaagcatatgagttggcaagcctaggctgccattccaaga

SEQ ID NO: 223962 - DNA, 329 bp, Homo sapiens
cattctgcctcagggcctttgcacttcttgttctttctgcttctaatgctcttatttcagattacttcagggctcactttttttaccttttccaagtcttccctcaaatgttacctgatcagagcttccttctctggctaacatatattactcaatttttttcataataatgttatatcatatatttattacttttgtttattgtctcttcttctaattagaatgtaagctctagtaaggcaaagcctttatctgtttatgtataactgtttccctagggcctgccatgaaatatgttttcaataaacatttgttaagtgaataaacac

SEQ ID NO: 223963 - DNA, 471 bp, Homo sapiens
agccaccagaaagatgaataaaataaaagattgaagaagtagcaagtagcagtatggaagacttgtggctaagaagacacttcgcactgttatgcaccaggaggattgactgtctctgtggcttggaggcagttatacgtagcagcagcagcagcagcagcagcaaaagttaacaggagccggagtctgtcttcaaagagcagtcagtagagatgaagagtagattactgattccatagtacatgtcagatactgcctagggacttcctaagtagaggtcaaggtcccactgttatacaggtaggggttaatgagctagcaaattaggatattaatattaatggagcatctttagtacccacaggctaatgaagtctggggtcatttgggttatattaacatgaaacaaagtggaattttaggccaaacgcatttaccagaataaagagagcaattttcctgattaaagga

SEQ ID NO: 223964 - DNA, 179 bp, Homo sapiens
tttgttgatagctttgtgagagtacctgtaatgttgacatactataaagggtacatcttaaaatatgtaatttgataagttttctcatgaatgtaaccaggtaatgagcatattcatcaccctagaacatttcctcatgcccctttataatccttttctccccttttccttgctccttc

SEQ ID NO: 223965 - DNA, 870 bp, Homo sapiens
gcatctttttaaaatcagagataaattcttgccaccaaagttgtaattgttcattacttcattcctctattcgtgtgcgtgtgcatgtttgtgtttgtgtgtgtgtagagtatgtatatctgataaactgtcagcttttgatttctgaagctgtgtgggaattgatttttctagtcaatttgactacatctctagaacacggtagggatgatagggaatgccttgtttgtctgtgagattaaaccattacacctttttattcataattgagtagattttgagttacattggagagtcctggctttacagttggatagtctgtttcacagtccacctcctagctgcaaagtccttggctggtgatgtagcttttctagggatcagtcttctcatctataacacagtgctaattctcaccttgttgggttgctgagaattgagtgagcccatgcatttgaaggccaacctcagtgcctgaaacagataaacccaatgaacagtagttctttcaatcttgaatgagaatcatattctgaaggctaaatgatttttgaaaaactttactgttaatttacatttttttttcttttttttgagacagggtcttgctatgttgcccaggctggtcttgaacccttgggctcaagtgatcctccagccttggccttccgaagtgttaggatcacaagtgtgagcttcctcaccctgtcctttgttctttttaagggggaaaaatgcacctctgcatacttacatactctgaattatttggagctgtgcctctcagactatctatggtgaaggcctaattttgttccgaattcgtcatgaactgatgcttttataaagtacaatacaatgaattaatat

SEQ ID NO: 223966 - DNA, 717 bp, Homo sapiens
gcatctttttaaaatcagagataaattcttgccaccaaagttgtaattgttcattacttcattcctctattcgtgtgcgtgtgcatgtttgtgtttgtgtgtgtgtagagtatgtatatctgataaactgtcagcttttgatttctgaagctgtgtgggaattgatttttctagtcaatttgactacatctctagaacacggtagggatgatagggaatgccttgtttgtctgtgagattaaaccattacacctttttattcataattgagtagattttgagttacattggagagtcctggctttacagttggatagtctgtttcacagtccacctcctagctgcaaagtccttggctggtgatgtagcttttctagggatcagtcttctcatctataacacagtgctaattctcaccttgttgggttgctgagaattgagtgagcccatgcatttgaaggccaacctcagtgcctaggtaagtctttgccccagaaagtgacaagaagaaaacttgctttttgttcgtttgaggaatcccatatggtagattgacacatctcatagcaaatgttcttgttgttatgaccaaacgccttccataatgtggaatcagtgggagccccgagcttgttttcctggaactggacagtctgtcgtagcggggaaaataagaagtcgtgcgataaggtttttcattgacaggaaaaattatgg

SEQ ID NO: 223967 - DNA, 452 bp, Homo sapiens
agtaggcaccctgctttgttctccattatattccaagtgcccgggacgttgcctggcccatggcaggagtctgctgagtactggatgaatgtgtgaacgaatggatgccattaggaatgaatgccaggcacccaagtgcacacgtacacaggaggtttccaaatcgcagggtattcatggcagaatgcccgttatatagttggtaactgaggcacagaggaatcaagagactggcccagatgcccagctggggtaggaaccagggcttctggttccctgttccatgctccctccagtaccctacatctactacagcaatgctgtgtttactctagggaccaaactggaaggttaaaaaaaaaatgcattctctaccccttgaaaaaaattgggtgtattctactactcaagaaaaataagattaaagattaaaggaacaagtacacttaatt

SEQ ID NO: 223968 - DNA, 461 bp, Homo sapiens
atgtataaatattttatctgagactcctgctactattgccacccgatgcatcttccaaaaggtaaagcttccatctttgcatcaccttctcagaaatctgaattggtcccattgctttcagaatgaagttaagttcatatgctaacactcagggcctctgtctgtcaatcagcaaaaatatattgaacgtgtactatgtggctaagcatgtttctgcagatacaaggtaacatggagacctcatggagcttgttcaccttttctttaacgtgaacactctgctccaagcattctggccttccctctgccctcttgtgttgtcttcactgtttctggaacaattccccatttgacatacccttttctattcctttagcctagttaaaacttaccccacgacacgacacttctattgcaaagctaggtggtatttggttacccttcctttcctttcctggctg

SEQ ID NO: 223969 - DNA, 459 bp, Homo sapiens
aattacacatgtgtgtctcgcctgtgtttggttcctgtgttggtgcctctggatatttgtcaaactagagttcctacattccttatcaggttatttctgtcgaatctctagcacttttaagtgacgtataatcttgtaggcaagtgaatgaagtcagtgagtatatgtcacattgacttactcctgactcacatgcagcttgtctttagatgggcagataagatgctggccctactggagcgactgtggttgtgccgtcctgagcacccttcctccagtggccccggttttcaaggctttgacacaatggacctaaagtctcctttttcaagcttggctgcatatccacagtgcttttgtgcatgatgttacgttgttctggaggtttcattttgtaattccagttacctttgatgaaagaaattagtaaaaactttttggatgtgagtaattgcagaa

SEQ ID NO: 223970 - DNA, 723 bp, Homo sapiens
ttcaggattcctgctgacctgtgtctctggatgagggagtcccatgccatcttcattccagaatcttattttcttaataagggtgattcagagcttaaggacaatgacacctagcaatatgtagcatggcatggcttagaaaatattctcatatccattttcacacactttgagaagtaggcagagaagatatgactgtcaatgaaaagggacttacctaaaaccacgtagcaagtttgcagcagagccaagactaaaaccagcccctatctttaggttaggtctcttgcacccaagcatacccccttcctctttcatccacctgcacctcctgtgcatgacagccccagacaatgaaggcctaggcaccataagttggcacgtgccctctgtaatagcaagctaaggtcatcctggggcaggggcagaggcaagagaggatggcagggagaattatgcatagcattgtcattttctgagtccccagtgtagctaaagaggcagcctaatgaagcagcttcttctggaaactccaaggactatgtcctgggagggaaagccaagccctcaggcagcactcaggggaagaacagatccacatatgcatagtgctccagctaggatctggccactcaggggttgtcacagaagatatgacagtcatatcttctctgcctatttctgagacacccccatggtcacccttatgggatactgcagccc

SEQ ID NO: 223971 - DNA, 969 bp, Homo sapiens
gtagatcatcatcataacagctcccagtgaatcaatgcctccctgcatccacacccctttgtaacatgatattgttgctcttcccatcaagaaatggtctcttttggccgggcacagtagctcacgtcatcccagcactttgggaggctgaggcaggcagatggcttgagtgtaacaatatgttgaatttgccatgggcctttaaagcttcaatgttgtgaagagctctgcatgaaattttaaagagactggacctttcatctgcacaacagcagggcacctcgctatagggacaagaaaggaagagagagagagaacatttctgaagtaatagtgaaaaataacagcagaagcaattatttcatcaaagattgcagggagaggctcctccgtgctcctgagaggccgaacacagggtcgccagcacagcttactgctcggtgtctcctgagccacagaggaagacgtggcaggagcacctggtgctaatatatattcatgtctatggcaatgccgaccatctggctggtctgaaccaggataaaagtgaagacttcctctgtgaagacccagctctttctttggctccttttttgaagccatctttgctctgctctcctctgctgcccagaaagttccagagtgaagctcagctctagatgaacaaaaactggttgagtccagagatgcctgagttggagatgaaccttgcaaactttcctcattaccatactaaaaaccccacccaggaaggagcttatctgccatttcctacacatgtgacatatggagaagcatgatcagctacttcacagtctctgcctttactctgcctccgcatacaatggctcagccaactagcctaacgaaagctgttttcaccattgtttgggaggtactgctttgggaaactgccccagctgtcctccttacttgttgtaggtaataaaatccctttgttaaatctta

SEQ ID NO: 223972 - DNA, 525 bp, Homo sapiens
gtccggcctgggcgacagaacgagactccgtctcaaaaaaaaaaaaaaaaagaaaatattatgcttagtaaaataagtcagtcacagaaggacaaatattgtacggttccactaatatgggtgaggtacccagagtaggcaagttcatagagatagaaagtataatagagagaaggaatggagaaactgtttcttcatttctagagagaggagggaatgggaaattattatttaatgggtacagagcttctatttgggatgatgaaaaagttctgcaaatggatagtggagatggttgtgcaacattacaaatgtgcttaatgccactgaattgtatactttaaaatgcttaaaatgataagttttacaagtttttttaattaaaatttttaaaggatatattcatgtatgcagaatatttcttccaatgagggcagagggaaggattaatatagagattttgattgcataaataaataatagcatattgtataaataatatataaataaatataaataaatgac

SEQ ID NO: 223973 - DNA, 393 bp, Homo sapiens
cttaattcattcaagaaatgctgactgagttcctgctgtgtgttggacactttcttagaagtgggacacactgcagtgtgtgggacaaaggctgggccgctcattgcttatgttctagttgaagagagagtcaatcaacaacattctactttcagacattgataaatgctgtcatgaaaagacaaggaacatgaaaaggtaagaaaagggatggagagagatgggatgaggggtgcctgggcagacaatgcaatgatctggcaaaagagtaggacaatcatgagactgcatgtgttccagtttctgctgctgtaaaacagcatccacaggttacatctttactattctgttacatacatactattatttaaataaaaaatagtactagttaac

SEQ ID NO: 223974 - DNA, 420 bp, Homo sapiens
  misc_feature (29)..(29): n is a, c, g, or t
acaagtaatttcagtctatgcacaaaagnacgtgagtagtaactggttaccatttgatgttagcggggtttcaccatgttggccaggatggtcttgatctcttgacctcgtgatccacccgactcagcctcccaaagtgctggaattacaggtgcgagccacctcacctagctcccatacttgaaaaatttgagaggaatgctgggtgtggaggcacttgcctattgtcccagctactcaggaagttgaggtaaggagattgtttgagaccagaaatgtgagaccagaccgggcaacttagtgagaccccatgggggagaaaataaaaaaagaaacaatttgggggaaagaatctatcttttaaatatcaactttgggctgggcctaatggctttccttgagcccaggaagttgaggctg

SEQ ID NO: 223975 - DNA, 312 bp, Homo sapiens
tgggtcatagaaaatgtgtaaatttaccttcagtagatcttgctaaactgtttcctaaaatgatggtaccagttaacactcataccatcattgtatgaaggctccatttatttcagatatttgccaacacttggtatcagtcatttgttaccattctagtgggtgtgaagcagtatctcattgtggtttagatttgcatttccctaatggctactgatgttgagcatattttcatgtgctttgttgaagatgtgtatactttccttggagaaatgtctcttcaactatctgattttaaaatggtcaacagta

SEQ ID NO: 223976 - DNA, 782 bp, Homo sapiens
ggaaatgagacttaaattcacatccagcagaacagtatcagaaaagtgggtgtgtgagctccatgagggtgacttgtggaaggggaaaggttgaacatttcattctcaagtactaaaaggatctgtaactctaatgtaccgattaatggatgatagcacagctttttattgttatggaagtgacgtttccactcttgtcattcccatttttggagtttattgttactagatttcatagaacctatttgaaactagaaaatatttctatttcattactttatatgtttttgtatgcatatgtatatatgttttatctaaaaaacaaaattgaagactttaaaagtgaatttgagttttggacactaagctttatttatttacttatttttttttgagacggagtctcactctgttgcccaggctggagtgcagtggcacgatcttggctcactgcaacctctgcctcagcctcccaagtagctggtattacaggtgcctgccaccacacctggctaatttttgtattttttagtagagacagggtttcgccatgttggccaggctagtcttgaactcctgaccttaggtgatcagcctgcctcagcctctcagagtactgggattacaggtgtgagccaccatgcccggccaggacactaagctttaaatgttgaatgtaaacaattaatcaaaaaagactccaagttgacatacatattctattttcttttctttctttcttttttttttttttttttgagacggagtctcgctctgtcacc

SEQ ID NO: 223977 - DNA, 708 bp, Homo sapiens
ggaaatgagacttaaattcacatccagcagaacagtatcagaaaagtgggtgtgtgagctccatgagggtgacttgtggaaggggaaaggttgaacatttcattctcaagtactaaaaggatctgtaactctaatgtaccgattaatggatgatagcacagctttttattgttatggaagtgacgtttccactcttgtcattcccatttttggagtttattgttactagatttcatagaacctatttgaaactagaaaatatttctatttcattactttatatgtttttgtatgcatatgtatatatgttttatctaaaaaacaaaattgaagactttaaaagtgaatttgagttttggacactaagctttatttatttacttatttttttttgagacggagtctcactctgttgcccaggctggagtgcagtggcacgatcttggctcactgcaacctctgcctcagcctcacacctgtaatctcagtgttctgggaagctgaggcaggaggattgcttgagcccagcagttctgaccagcctgggcaatgtagcgagattagccaggcatgatggcatctacctgtggtcccacctactcaggaagctgaagcaggaggatcacctgagcccagaagttgaaggctgcagggagctatgatcacaccactgcattcagcctgggtgacagagccagactctttaaa

SEQ ID NO: 223978 - DNA, 660 bp, Homo sapiens
ataatctggtattttctgttgagctatctgctatgaattccgactaaaaattctttcatatgaataatatgtgcttgtaatatgtttcatatatggcgtatgtacacatgtttataaagaaatatagtcacatggactacatataaaatgtgcatttcatattcataaatttacttgaaatatttattttatcaagtgacctatgtaaaaatagtaatttttcacttagtggagtcttttgataggatcaggatatgaactccttgccactgtagctcatagtttatggcaaaatcttgagctaattatagccctcattcatgtaaaaaaaaatggtaacttattcagggttagtctcataaacgtagaagtcaacccaataggctagactttcaagtctagcttttaatgtttagaataggaatatacgtttttatatgaaccatgactgcagatagttatatgatattgaacaatattatgaaacgtcttttcacactctggaactttttgttattcactgatagggagagtgccaacaatttcacagaatcagtttttcctgcttttgtgtcttctgtatcttcacaaagattttttttccatgcaacagcaagttgatgtagaatgtacagaagaaagtttaataaatttcagggc

SEQ ID NO: 223979 - DNA, 355 bp, Homo sapiens
tgagtcagggtcttactctgctgcccaggctggagtgccgtagtattatcacagtttactgtagccgcaaactcctgggctcaagtgatcctcctgactcagccttctgagtaactgggacaacaggtacacaccagcacgcctagataattttttattttttgtagaaatggggtctccctatgttgcccaggctagtctcaaactcctggcctcacatgatcctcccacctcagcctcccaaagcgctcggattataggtgtgagccaccacctacagcctcacaggggtctttaagtaacaagatacaagctcctcctagtctcaagacctcacacatgcccttccctcctc

SEQ ID NO: 223980 - DNA, 704 bp, Homo sapiens
  misc_feature (45)..(45): n is a, c, g, or t
tttaactgagtaggtgatagcaaagaatatttatgctaaggcacntcattgcaaaagtcaacactgaaaaaagcaaataatgtccttagtattatcatgacaataattttggcctcctggacttcctaaagggtctcaaggatctctgggggtctgttgacctcactttgagaagttcttttctaaagtatagtatgtatattatatctgatcacttattcaagaaatttcagtgctgtatggcagcacaggtctgggtttcagggatatacccctgaacaaaatagatgagacaagcagaccagaaaaaattgacttaatttatttttgttttatagctctgtgtttcctattgttaatgtaaaaaataagtgaatagaatgttttataacctcttaagttcaactaactttaagttgctttttacttactgactcctgtttgattagtgacctctattaaatgtttcttggagttactggagtgaaaacaactggacaagtctttgtgttatgttgattgttattgacctatagatctctaagaaataggtgactagtctctgaactcttgtagacatttctagaaaggaaggagtatagaaggtagcagtccttaccctcccatcccttgtcattcttgccttagtcctgccaacacagcaaatgtattagagtgtatgtgtctgtgtatgtatatgtgta

SEQ ID NO: 223981 - DNA, 771 bp, Homo sapiens
  misc_feature (45)..(45): n is a, c, g, or t
tttaactgagtaggtgatagcaaagaatatttatgctaaggcacntcattgcaaaagtcaacactgaaaaaagcaaataatgtccttagtattatcatgacaataattttggcctcctggacttcctaaagggtctcaaggatctctgggggtctgttgacctcactttgagaagttcttttctaaagtatagtatgtatattatatctgatcacttattcaagaaatttcagtgctgtatggcagcacaggtctgggtttcagggatatacccctgaacaaaatagatgaaaatatctgccctcatggagcttacattgtgtctttgatttttcccttctatcttagatcatgatgcctcactggatatgtagagtataccctcccccacctttttcttctggtctgcttgtttcctattgttaatgtaaaaaataagtgaatagaatgttttataacctcttaagttcaactaactttaagttgctttttacttactgactcctgtttgattagtgacctctattaaatgtttcttggagttactggagtgaaaacaactggacaagtctttgtgttatgttgattgttattgacctatagatctctaagaaataggtgactagtctctgaactcttgtagacatttctagaaaggaaggagtatagaaggtagcagtccttaccctcccatcccttgtcattcttgccttagtcctgccaacacagcaaatgtattagagtgtatgtgtctgtgtatgtatatgtgta

SEQ ID NO: 223982 - DNA, 386 bp, Homo sapiens
  misc_feature (261)..(261): n is a, c, g, or t
tattttatttttctatttccatctttggacagagagctactattcttttaatggacgtgaaatggtgaaggcacacaagcatattgctgtcattgttttcttgctttcctaaattacttttaccagtggtatatctttttttaaaagctatctacttggagatggtgtgtcttgattgacatctcatggagaagtggatggggaaaatactggttctgtggaaagactctctccgttagtggcttgctcatccagctctgntctttctgttccaggactctccctgtttcaacaacagcaacaacatgataataacaaacctcacatatgttgttccactggataattgtaattttttaaaataaatcgttgtaaaaccaaggaca

SEQ ID NO: 223983 - DNA, 434 bp, Homo sapiens
tcactgagtatagacacacaaacacatgcacacacacgcatatgtattcatggtttatgtgtgtgtgtgtgtgtgtgtgtgtgtgtgtgtgtgtgtgtgtgtagatagatagattctagacctggaattcctgggttcaaattcccatgctgctgttaactgtataatactaagtataataccaagtgtgtaaattacactgtttgatgttttgggttcctaatctgtaaaacaaagatgataataacattttatttgtgaaattgttatgaagattaaatgaattaatacacgtaaagaagttagaacagtaactggtagaggccgagtgttgaaaagattttgctatttttacaattatgcacaaatttaatgtaatagtagttgaaattgtgtttatttttggtaaaaattaaacatatcttgcattctcc

SEQ ID NO: 223984 - DNA, 371 bp, Homo sapiens
aaccgccataaatccgtagaagttgtatgtctccattcaggagctctgtttgcttctttaggcatacccttcccctctcttgagtgaagagggcaaagacacagaaaacttagtagggaaccaggcgcagtggctcacgcctgtagttccagctacttgggaagctgaagcaggaggatcacgtgagcctaggagttaaaggctactgtgagctatgagcaagcacaccactgcactccagcctgggtgacagaatgagaccctgtctcaaaaaaacaacaaattgttttatattaaatgccttattcatattgaatatcagctgtgtgttttcagttttatgaatggaaaattaagtaaataaaattttg

SEQ ID NO: 223985 - DNA, 412 bp, Homo sapiens
cgggcagggcagggaaaatctgcctgactagatgggcccaggacatctgaacaggatgattcccggaccaagacgtggaggacgatcaaggatacattgaaacaaggctgaggccagagaaagggacattttccagtgacgaaaacaactttctaccaacttccccaaactgaactgtagaataagaaaccaagggattgttgtttaggtctgtgagaagcagcggggaggggaagctggaggacaggcccagggacactgaccaggtgggggtaggactagctccctgggaaggctcagtcccacagcggctacctgcctagcagcaggcaaaagggtaaagaatgtccccaggtgagaggccggggcttggccagggcactggggacactgtccactgggttgccctgcc

SEQ ID NO: 223986 - DNA, 254 bp, Homo sapiens
agcatattggctatgagttaaggagaggtgattccttagaaatctttgtacagtttctgtttaaaagggtgaatgcttggcagccatgtttactataactgcctgctcttggcctctagatgcttcacatataccttaattcagaattgcctggctacctcagttggtagagcatgggactcttaatcccagagtcagtgggttcaagcctcacattgagtggttctactttttttttttaacacctgtgaaaa

SEQ ID NO: 223987 - DNA, 714 bp, Homo sapiens
tgagagatttaggatggatgcaacgtgtcattaaacctgaaaggaactgttatttatcagtaatgatgttttccacaggcctttttcctcacctgcgcgggcacaggtaccacctgggtggtggatgcggggcgggggtgccaggaggcctgggtgggggtaaactgtgtgcgggcctagccggaggcggccggggcaccgctggaggccacctctccagactccgggaacccgagggcctctccttcacttggaggcacggtgctgcacccccgttggggggttccccttgcagagctgcctagaacagcaatgtgttaggagacgcctccgaagagcctcctcctcctcagctggcaagaaacgcagactctcggcagtgccattcttgcagcagaaaggccctgtgtgactccagcactcggagcagccgccttatctggggtgatttcccatctgcctccctgggcccaggatttccttcctgcacagaacttatcttgtcgggaagcagagctgtgcgctagaggcaggcccagcaaatggaatgctcgttcggtcttgtgttcttaatgacccataacagagtcctcagaggtgaaaaacaaaaccctccacccccttaaccatttctgtgcccatcctggtctgggagatttcttaatcctgctgcgccgtcacacggactcctctctggattttatcctgcggccg

SEQ ID NO: 223988 - DNA, 548 bp, Homo sapiens
ccctaccttcttctcttgcactcttgaacccacctgttgactttaggactgaattaggaagagaaaggagaaggatactacttcactttgaaagtttaaaaagaatctgtctaaatcaatgaggcatttcagaggtagggaagaaataaaacatgtatgtctcactgagcttaaggaataaagtaatacggatacaattgaggcacatctttccatgtattcttccccaattccattccctttctctcaaaggtggttactatcttcatttatttgtttttattcctatgcatgtttttataccataatatattgttttgcatattttaaaacttgatataaatgatatactatatgtagtgatatacgacttgcatttgtttctgctgaatgttttttagattttgctaaattgatacctatatctctggtttgctgattttgcttgctgtatcatattctgctatatgaatatgatacataaatatgttatttcccactttaattattacaaacagtgttgcaataaatattcttgtacatgtctc

SEQ ID NO: 223989 - DNA, 493 bp, Homo sapiens
gagcaggttctagctacacccagacacagtgaaagggcaattgctagaattatgtgaagcacctggaacaagttctgctccataaaactgcagccagccccactcagatgaactcccaccaataaagtcatccacaactgcaaagatggagaggtggcctccagccaccaagcatctccaagggatgcatccatttacgtacttgctcatatcctttgaaagcagtgagattagaaggaaggcagagaagcctggcagaaccatcaaggggcagcagaggacgtggtaggcactaggaagctaggcttaactgcagggggtaagaaatggcacaaactggggacatagaagcgggagagctgaagacaccactaaggtttttcctggaagttttaaatattctggaaaaatagtttagatacaattctaattgtcacattttaatttttaatacatgtataattttaagttattagaacgtttcacaagcaaa

SEQ ID NO: 223990 - DNA, 502 bp, Homo sapiens
atactatttatctaactcacgtttaaaactcttcaattttaattgattcatagagactctgaccagaaaccatatttcaaactcttaatattatcttcctaatagtcataatagtagcctccccaaaatactatattttctcaaatgtttacatacagacatctataaactgtcaactggtccctcttcaacccaaacaacaaaaactccaaaaagtgatcaacaagtcactgtaacatataagacacactgagaccgaaaactgaaaataataatagctaaaagtaccacgaagccaacagtaaagtttgggtcaccctctcacctatccaataaatgaataaataaataaataaacaaacaaacaaataaataaataaaacataaaattataagaggctattgcttttgactaaactcatgtactaggctccaaccgaccagaccaaaccaaactaaagtcactcatactaaatatcacataaacaaactaaaacttaaa

SEQ ID NO: 223991 - DNA, 566 bp, Homo sapiens
tgagattttaaaattataccaccaaacccacccaaaaaagatagctagtgaatttttttagttatggcaaacaaagtccagagttcagaacattagtgtaagaaaataacaattgattcattttatttattagtgaaattgaaaaattggggattggcaaagcagttaaggtgttggtaatctatcatcatgggtatttattgaactaccacatagttttagatcctatagaggagtcgtaattgtatgatattttaaacttgctgttttaaaacttaaaatattaggtagacatggaggcacccacctgtagtcccagctacttgggaagctaaggtaggattcccttgagcccaggagtttgaggctatagtgtgctgtgattgcacctgtggatagccactgcacttgcttgggcaaaatagcaagaccttgtctcccaaaataaacaaacaaaatccttaaaatgttattggtcatataaagatgtgataagtgaaatagagagcagtagatgctagtatgcaaaatagtgcattctgaaatatatgagtgtgaaactgcat

SEQ ID NO: 223992 - DNA, 596 bp, Homo sapiens
ttgtttgagatagagtcttgctctgtcacccaggctggagtacagtggcacgatctcagctcactgcaacctccgcctcctgggttcaagcaattctcctgcctcagcctcccaagtagcagggattacaggcatgcgccaccatgcccagctaatgtttttgtattctcagtagagacggggtttcaccatgttggccagggtggccttgaactcctgacctcaaatgatccgcccacctcagccacccaaagtgctgggattacaggtgtgagccaccgcacctggccgattcatcttcatttgtttcccgccagccccagaacagcctggggcagacattcttgtttcttttgttcacttgtccattagcagtgctctaagcgcagagcccagcacacaggaagtgctcaagaaaaggattgttgaatgaatgaatgagcctcatccagaacacaaaattcacccaactgcactgctgaatcctttggtctctgactagcttccacctcgtaaatcaggagtggacaagctttcctgccaaaggctggagtctctgctcccactactcaactctgcccttctggtgtgagagc

SEQ ID NO: 223993 - DNA, 234 bp, Homo sapiens
tgagatggagtctcgctctctctcccaggctggagtgcagtggcgtgatctcagcttagcgcaacttccactccccgggatcaagcgattcccatgtctcagcctcccaagtagctggggaagaaatcttggctcagtatttacaacagcagcagcctggagtcatgaggtcagtgtaacggttgctcctgcccttcttgccaaccgcaaccctcccttgacttcttacgcact

SEQ ID NO: 223994 - DNA, 2304 bp, Homo sapiens
cggcgcggctgaggcgcggcggccccgtgtgagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatgggacaagaggctgaggagttgagggaagagatgtaagtcttggatcgtgtttacttgtggcagggaagcaggtcggctggaggcttttggccaaggggaaagtgtcctaaaggaacccaagtaccaggaagagctggaggacaggctgcatttctacgtggaggaatgtgactacttgcaggtagtggcgtggcaatgtgcactccagggtggaagctcttctcatcctgctaactatctttcgtcactcacccccgcccagggcttccagatcctgtgtgacctgcacgatggcttctctggggtaggcgcgaaggcggcagagctgctacaagatgaatattcagggcggggaataataacttggggcctgctacctggtccctaccatcgtggggtgagtggaacttggaggagtaaacattcgaatcccattgggagagtggcttaatgcaaactggtttttttctttacgaggaggcccagagaaacatctatcgtctattaaacacagcttttggtctcgtgcacctgactgctcacagctctcgtctgccccttgtccttgggtgggagcctgggcctgcgacctgagccacctgtcaacttcccttacctgcattatgatgtaagtctcggtgctcttgttctgactgcggcaggctacagggcctcctcatgctcccagtcagtcgctgtctgtactggctctgttcctgaggcccgagcttgaactcagctgtgatgtggcctctcagatcacactgtcctatgcttgtccagcctggggtcaaacatacccctgattcatcccctgggtctctctggtgttaacattctgcctccacacattcttttccaggcccgaggccaagtgcccctcttggtgtcttcttacaggccattctgcccttccactgcagtgccatcctggctacagccctggacacagtcactgttccttatcgcctgtgttcctctccagtttccatggttcatctggctgacatgctgagcttctgtgggaaaaagtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgagggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctcctataaacccagctcttctcaagctgcagtccaccgggtatggttctggatggttccccaagggagcagcagtggagagcatcccagtgttggggcactgtgttcctcttcgtccctgcaccagaacctggaagcttggcagagacctcacaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggaaaaaaa

SEQ ID NO: 223995 - DNA, 2306 bp, Homo sapiens
cggcgcggctgaggcgcggcggccccgtgtgagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagaggtgagggcctctgtcctgaactttttaacccggtgccacaacctgagggtctccataggggcagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcaggtagtggcgtggcaatgtgcactccagggtggaagctcttctcatcctgctaactatctttcgtcactcacccccgcccagggcttccagatcctgtgtgacctgcacgatggcttctctggggtaggcgcgaaggcggcagagctgctacaagatgaatattcagggcggggaataataacttggggcctgctacctggtccctaccatcgtggggtgagtggaacttggaggagtaaacattcgaatcccattgggagagtggcttaatgcaaactggtttttttctttacgaggaggcccagagaaacatctatcgtctattaaacacagcttttggtctcgtgcacctgactgctcacagctctcgtctgccccttgtccttgggtgggagcctgggcctgcgacctgagccacctgtcaacttcccttacctgcattatgatgtaagtctcggtgctcttgttctgactgcggcaggctacagggcctcctcatgctcccagtcagtcgctgtctgtactggctctgttcctgaggcccgagcttgaactcagctgtgatgtggcctctcagatcacactgtcctatgcttgtccagcctggggtcaaacatacccctgattcatcccctgggtctctctggtgttaacattctgcctccacacattcttttccaggcccgaggccaagtgcccctcttggtgtcttcttacaggccattctgcccttccactgcagtgccatcctggctacagccctggacacagtcactgttccttatcgcctgtgttcctctccagtttccatggttcatctggctgacatgctgagcttctgtgggaaaaagtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgagggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctcctataaacccagctcttctcaagctgcagtccaccgggtatggttctggatggttccccaagggagcagcagtggagagcatcccagtgttggggcactgtgttcctcttcgtccctgcaccagaacctggaagcttggcagagacctcacaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggaaaaaaa

SEQ ID NO: 223996 - DNA, 2324 bp, Homo sapiens
cggcgcggctgaggcgcggcggccccgtgtgagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagcactccttttcctaaggactgcgactcggtgaacagaaaggaggctatgcggtgtggccagccaactcaaggaggatgaagcaacctttgcctctaaactgcctggaactaaatgtcgatttttctgacccctcccagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatgggtatggggaccccagaggctttgagggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacttggggcctgctacctggtccctaccatcgtggggtgagtggaacttggaggagtaaacattcgaatcccattgggagagtggcttaatgcaaactggtttttttctttacgaggaggcccagagaaacatctatcgtctattaaacacagcttttggtctcgtgcacctgactgctcacagctctcgtctgccccttgtccttgggtgggagcctgggcctgcgacctgagccacctgtcaacttcccttacctgcattatgatgtaagtctcggtgctcttgttctgactgcggcaggctacagggcctcctcatgctcccagtcagtcgctgtctgtactggctctgttcctgaggcccgagcttgaactcagctgtgatgtggcctctcagatcacactgtcctatgcttgtccagcctggggtcaaacatacccctgattcatcccctgggtctctctggtgttaacattctgcctccacacattcttttccaggcccgaggccaagtgcccctcttggtgtcttcttacaggccattctgcccttccactgcagtgccatcctggctacagccctggacacagtcactgttccttatcgcctgtgttcctctccagtttccatggttcatctggctgacatgctgagcttctgtgggaaaaagtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgagggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctcctataaacccagctcttctcaagctgcagtccaccgggtatggttctggatggttccccaagggagcagcagtggagagcatcccagtgttggggcactgtgttcctcttcgtccctgcaccagaacctggaagcttggcagagacctcacaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggaaaaaaa

SEQ ID NO: 223997 - DNA, 730 bp, Homo sapiens
cggcgcggctgaggcgcggcggccccgtgtgagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagagtggaagcttggcagagacctcacaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggaaaaaaa

SEQ ID NO: 223998 - DNA, 2115 bp, Homo sapiens
cggcgcggctgaggcgcggcggccccgtgtgagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagaggccagcatcagggtctggtcagacttcctcagagtccatctccatccccggagcatctgtatgattcagaagtacaaccacgatgggacaagaggctgaggagttgagggaagagatgtaagtcttggatcgtgtttacttgtggcagggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacttggggcctgctacctggtccctaccatcgtggggtgagtggaacttggaggagtaaacattcgaatcccattgggagagtggcttaatgcaaactggtttttttctttacgaggaggcccagagaaacatctatcgtctattaaacacagcttttggtctcgtgcacctgactgctcacagctctcgtctgccccttgtccttgggtgggagcctgggcctgcgacctgagccacctgtcaacttcccttacctgcattatgatgtaagtctcggtgctcttgttctgactgcggcaggctacagggcctcctcatgctcccagtcagtcgctgtctgtactggctctgttcctgaggcccgagcttgaactcagctgtgatgtggcctctcagatcacactgtcctatgcttgtccagcctggggtcaaacatacccctgattcatcccctgggtctctctggtgttaacattctgcctccacacattcttttccaggcccgaggccaagtgcccctcttggtgtcttcttacaggccattctgcccttccactgcagtgccatcctggctacagccctggacacagtcactgttccttatcgcctgtgttcctctccagtttccatggttcatctggctgacatgctgagcttctgtgggaaaaagtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgagggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctcctataaacccagctcttctcaagctgcagtccaccgggtatggttctggatggttccccaagggagcagcagtggagagcatcccagtgttggggcactgtgttcctcttcgtccctgcaccagaacctggaagcttggcagagacctcacaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggaaaaaaa

SEQ ID NO: 223999 - DNA, 397 bp, Homo sapiens
ggagggtcaaatccattcccaatggcaaaggtgagacttctccagatactgatggatgggggcttgggtagagcagaaacatggagaaaggtacatttcctctgcttgtcttcaggttcctcaccactccccaccgctacaactccaaaaccacttatccctacagaggccagcatcagggtctggtcagacttcctcagagtccatctccatccccggagcatctgtatgattcagaagtacaaccacgatgggtatggggaccccagaggctttgaggcaagaaacatgggtccccaccaatgcaggatgaggctcttgaggccatcttccctgcccttccccaggacaagaggctgaggagttgagggaagagatgtaagtcttggatcgtgtt

SEQ ID NO: 224000 - DNA, 414 bp, Homo sapiens
agtctcatagcccaggtcctggaggtccacctggacctgcttgctgtcctgcttcagcaagggttcacctgcgtgggaagagacagcaggtgttacagaatgtctgaatttcccacatatgccctgagcctcaatggcacataccctaaccttgtggggcagggagggcagatccacagtgcgagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccactgaagctggcaagtgctttatcagcaggggttcaataaatgttgaatgtaaa

SEQ ID NO: 224001 - DNA, 5583 bp, Homo sapiens
ggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatc

SEQ ID NO: 224002 - DNA, 1605 bp, Homo sapiens
ggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacagtgagtagacagaagactgtatgttttttctgaggcctaatatgatattgtcaaagcatattatg

SEQ ID NO: 224003 - DNA, 456 bp, Homo sapiens
tagcacttcactaaatatacaccaaactgaggcacttacatacatgatttcatctagtctaaattgtctctctgagagatgggtcctatcactcctatcttatgtgttaggaaatggaggcttagaggatttggaacctgctccaggccacatagcttaataaataaatggcagactgactgatcaacttgtaactctaaagacagtaatgcaattactgggctctgaagaatacctacctcactggttgttgtgttaagagagtgagtttaaataaggctcctacacacgtggctggccatcagagaggtgttcaagaaatacaactttcagccttcctagcacagtgggttgggtgtggggcgggcagtaggggtcaggataggctggtggcaagatgagcattctcctttgtttgtgataagaagaaataagaaaagtgtgggaagaatacca

SEQ ID NO: 224004 - DNA, 270 bp, Homo sapiens
tcttgagctgttctaagataatatcttttactttggagatacgcagtttttattatatgtctagctatagatttatcatggatttaggttcattatgaatctgcagatttgtgtcttccatcaaatctggattgttttcaatattaaaaaaacttctattttaaaatctgtatatagaaaggtacataaacataaatgaacatgttaatgagtaattgtaacaactatgtaactgtccaagtcaagaaataaaacatatcaagtaatcaa

SEQ ID NO: 224005 - DNA, 574 bp, Homo sapiens
ggaaaaaagagattcagaaaggctacgtgaattgcattttagcatagaagagtcaggactggaactcagtgttggcctagttcttgggggtggttggatggcaaactagtgcaggtatgttcataacttgtaagatcaaatttgtcatataaattacggggatatgtaatctctctcccttctggctcttttcatccttgggtgagttctaaataaaactattttgtgttatttttttaaccctcattccattgctttcagactctggttctcaaccttggctgcccatttagaatcacctggagtgggatctgggcgttagcattttttaaagctcctctagtgattccaggtaggcaacctgcactaaagacctctgctttaaaatctctctacctcaggcgtaggtgttttcattgcccatagtattaagcctagcttttagcagagatttgccaaggttgattatgatcctcttgcttgtttggaagaagaaatatggaagctgtgaaatcttttccagttgtgatagatgttgtttatgcattaattagcatgtaaaaattaaacactg

SEQ ID NO: 224006 - DNA, 182 bp, Homo sapiens
ggatacagtgaggtttgaagatccttggtgagaggtaagctcatgctgaggaagaaattagaaaagtgaaaaaagccagaccctgtgtttcaacaccttgcctcccagaaggatggaatactaaactggacatccacttctgatttgagggaagtttacagaggtcagtttacatctggggc

SEQ ID NO: 224007 - DNA, 337 bp, Homo sapiens
caatgtggatgaacctcaaaaagaatatgcaggctgggcgctgtgcctcacacctgtaatcccagcactttgggaggccgaggcgggaggatcgttttagcccaagagatcgagactagcttgagcaatgtggcgaaaccccttctccacaaaaaatacaaaagaagttagctgggcgtggtggtgcgtacctgttgtcccagctaccccaggaggctgaggtgagaagatcacctgagccccagaggtcaagccatagtcaagccactgcactccagttgggtgacagagcagccctgtatcaaaaagaaacaacaacaaaaacaaaacaaacaaa

SEQ ID NO: 224008 - DNA, 529 bp, Homo sapiens
cagagaaataagattgaaaatataattttattttcattcatgtatgcgtttattcattcatacttgcctagtctttaaaagcccatgttctatacttatctgaggatagtttccattgaagataaaagtgaaaatattattggttatctgtcagatttttgcaactttgggtaattctactcatgtacacatagagggcattctagggatgacagaaattgatacaaattaactccaggtgcagactactttttcctttgttaaggggtaaaaatgaagctaagaagttaaataaggctgggcatggtggcttgtgggaggattgcctgagctcaggagttctacaacagactaggcaacatagtgagaccccatctcttaaaaaaaacattagccgggcatggtggcatatgcctgtagtcccagccacttgagaggctgaagtgggaggattgcttgagcctgggtggttgaggctgcaataagctgtgatcacaccactgcattccagcttgggtgactctgtctc

SEQ ID NO: 224009 - DNA, 606 bp, Homo sapiens
tctagaaagccagtacttaatggcaaacatactgaatggaagcctggaggtaggtgatatgagtctgaacagaactgtggaactactttccacggcttatgcttaatcagttacaattccagccatttgggttgtacagaggagggagagatttttcctgcggtaactggataagtattgtaagagacaaaagggggaaaggattaaagagaaaggcttccttacatgagaaagaactgagtaggaagaaagagggagtgcagagaggtgaacagagtgaacgtatacacattgggttgaatgaagggttcccaaaccaccatgtgattggggagcacaagattgttattttcaaccttgaactctcttggttagcatactgacattctaggtcaaactttggatttaaaagaaggatctgtgtgaccttttctcacttgagagaagatgactaatgaactatgttacatatcattttgataatctaatgaaaataattatgcacttatgaaactgtaaaaatatgtaaatgttaatatacagataaaatgttttgatataaaagtgtcttatcaattggggatttaccaatccccatcctcccca

SEQ ID NO: 224010 - DNA, 421 bp, Homo sapiens
ggataatatagggcatcttattccagagtttgtaagtatggaagttggaggttatagaaattacgtgagatatataaggtttatgcttatacttaaataggtaaactgtagcataggagatgtgctcaagtttgttggaattctacgttgttttaagaaagttgaaatttgtcagaagctactttccataaaaacaatttatagttagattgttttttgtagttagatatatctagttagatttatagttagatccataaaaatcaattgtttttatttattctttgtatttttaatgaattctgcttgacaatctttgttcaatttgccaaataagtttcctaaaacttaattttactattcaggtgcgtgtttcttagttgacttaaacagaaaatttctggtgctgtgtcactgaaaa

SEQ ID NO: 224011 - DNA, 512 bp, Homo sapiens
tcaatacattttatgtcatgatttgtatctcatttgttaatttagcataggttagactgccatgacaaatacacatggtcacgaatggccaacagcggaatggtggtttacaggttggcaggcaattttctttattcagggacccagggtccttcactcttgtggctctataatctccccaggggcttttcctgcatatgtgtccagccagccaaagggtcaagggcatgggaagtgagtacaggagggtttgcgggtcgagcctgcaaatggtgcacttgccttgcactcaccactcctggtcagtcctcagtctcgtggccacgcccaaccgtgaaggaggctgggaagtgtagtccttgtgctcaggaacaaaaggaaaaggaaagttgggagcagctgatggtgtctgccacaggctcacgtgcgggtgtagcacaaaccagtggccttcctgcaggaggtgcacactattttctattctgtttgatttcatcttttaaaaaaaaaaa

SEQ ID NO: 224012 - DNA, 858 bp, Homo sapiens
tcagcttccctatctgtaaaatgggatgggatattcatgcatcgactcacaggttcatacaagtgaattgcatagttcaatgcttggcacagagtgagagctcagcaaatggaagcttgtactgttattagccatcgcaaggctaccctcatgatggggacaggtgatggattcgagtgggaggaacacctgtggcctgggccctgtccggcaggtgtcagaaaagtccaggagagtcatgcttaggccttctccaaagatggaggtgcaagagccccacagcatagcagcctctttttgaagtgatgtcaatgtgcttcttcctctttgggcccttgaagctcaggctcagtgttgagtcccaacctgacttctctgcccatctcattggcgctttatgccagagacagggggagcatgattggcacctactcaccctgaagggactgccttggtaaggcaactcaggggaggcctggggagccagaaccgtgtgagggtgcccaaggcagcaagggaaagactcagagcacgatggccacattcagagatcacatgccctgcccccaaagccccagctgtggacaagaatgactcaggtcccttggacaggctgtcaccagtgatgacttaggaccagcctgcccggctccagcaaagcacaggaagctcgaaggtttagaaatgggtcattgttgtgctgaggccatgcgtcaaagaggacatcccacagccagctccttctatcctggccagcactcttgacaaaggcagagggagtgcagcttagtgagctggtccctttacacaggttattcactccagaatctggagaattctgtccttaagaaaaaaaaa

SEQ ID NO: 224013 - DNA, 371 bp, Homo sapiens
aaactcctggacttaagcgatcctccctccttggcttcccaaagtgctgggatgacaggcgtgagccactgcacctggactttctttagttatggtactgtcattttatatatctgattttctaggaaacactcttaccattttatgtcagtattttcagttacacccttaagttttgaagttaccgatgtacatacaacctgtggttataatggatgtatatataaagataataacaacagtttgggcatgatgtcttatgctggtagtcctacctactcaggaggctgaggaggagggatcacttgaacctaagagtttgaggctgcgccactgcactctggcctgacagagcgagtcactgtctctta

SEQ ID NO: 224014 - DNA, 251 bp, Homo sapiens
tcatcccagctcaccagctgctcacactctccctaaagccccttgcaatttcccatcccccagtcacctaatagcctgcctgagctaaggaccctcttcattcctgagtgtctgccaaattccacccagttctgcgccgtcccctcctttcctgagttgcccccagtggcatgggtcagggggaaaaggtctcttgaaagtttttctgggtcttctggggtgtgatgagtaaagagtcacatatttctaac

SEQ ID NO: 224015 - DNA, 473 bp, Homo sapiens
agtgccatcagcttcacttttcctttctgtaaaatagaaataataacagcacctgcctcacagagttataaggaggactcgaaaatgtgggtgaaaccttcagtatagtgcctgggacagaggaagcatttgataatgtcattattcactcaggacctcagagtctttctaatttttagtgtctcatccttgacaatagggaaagtgttactacctcccagagttcttttaagacttaaaaaagaaagatgacatcaacgaatgcttttcaaacttgattcatgcatatgaatcccctggggatctggttaaaattcggtagctgtgaagtggggtttgcgagtctgaatttttcttttctttttttttttttgagacaaagtttcgctctttgttgcccaggctggagtgcagtggcaggatctcggctcactgcaacctccacctcctgggttcaagggattctcctgcct

SEQ ID NO: 224016 - DNA, 440 bp, Homo sapiens
gctggcagcggcttcccacaatttttcctttatgctctttgcagcttttgagagtttatgatgggtgcttgttgatactggccatgaaagggttagaccagattgatgagatttatagcaggaaatgattcgctgccgcttagaggtttagagcaattcacaatggccttacctggaataggctttttactgcatgaaccctagtgggcccgacaaattcaagcaagggaggtcgtccacctgtgggcacagcgctgcctgtccagcactgtgcagcacttgtagcatttatcctggacagaggagtgaaggagcagagttttgtctcatttcaagaacatgctacagttctggatcaaaaacactgtgaggataataggtcaaaagaaccagaaaacaatgactgactgacctgaagtatgaatttagaaaagatggac

SEQ ID NO: 224017 - DNA, 517 bp, Homo sapiens
taaaaatgagttaacaaaactctcttgttcgtaaaacaaatagtaccttccaggaaaggaatagtggcaacttagtcagctcagcctttcctgctgcagaaaatgcatagataaagacaattaagacaaatctgacctagacaccaaaagtgaatcaggaattattagaatttttatacttatttctctggtctagagactctttggcaataaattaaggcgtgaggccagttccctcattaaccctttgggtgtgctatagtattttttattaagctaattttttgtctaccaaatggtaaccaatatttctgcttttgtgtgagttgagcatgcatgggttaaaatgctgtataattcatggtattaccactgaaagggtgacagctcttggggagctctagatttcccttgaagaacctgctaggaagtgaggactactctcaagctgtggcaatatggagccagccacggtttttcccaggattcatcagcttttggaggcagggacttatgt

SEQ ID NO: 224018 - DNA, 453 bp, Homo sapiens
aagatatccaaatggtcaaccagtacatgaacagatagatgctcaaaattgttagtcattagggaaatggaaatcaaaactatgagaataccactttacaaccattagtatggctatcatttttttttaaaaaggaaaataacaagtattggtaaggatgtgaagaaactggaatcctcatatattgctggtgtgaatgtagcatggtgccacagctgtgtaaaataatttttcagctcctcaattagatagatacagagttatatggcttagcaattccattcctagctatataccaaaagaaaacaggtgttcaaacaaaaacttgtacataatattcatagcagcattatttaccatagccaaaaggtggaaacaacccaaatgtccatcaacttttgtgcatcagtggacaatgtggcatattcatataatgggatatgattcagctat

SEQ ID NO: 224019 - DNA, 414 bp, Homo sapiens
caccaccaacatatttaaaacctactaagtaattattatatgccaggctccgttctaaattcattaatttttaaatctttagaataatacaattatgtgaatattgttgtcaaatgttgatgaaacaaagagagagtttaagttgataatttgaggtcatggtgttaggcgcaggcagacaaactcttttacccttgttcaaagccactatgaagtcctgttcgcatgaatgatctttattttcttcagtatgcctttggttttattgtcaacattttactataataaatgactattattattaacaagaataaaatgtgaagtaacagttatgaaaaatttttagctcaagacaaataattactggaagcatttatgtggacactaaaaatattaaaacatttgtcaagttca

SEQ ID NO: 224020 - DNA, 429 bp, Homo sapiens
ccattaaattattattttctaattttatcctttcaatatttaataattgtcatttgtcattaaaagaagaaagattttgtctgagctctaaatcagtcactcaaacaattttattatttttttagaatcaaataatttacttcttgattccctaacttagatatatctggttttttattcaaattctagtatattgatttcaaagtatgggcatctagggttctggtatttttctcaggtaagctacattatttttatttttttcttatctcctttgactcagaagaggtttgtttatatggaatgacatatatagtgttaaacactttaaatatattaggaactaatatgtttggcatataatacatctaaaaacattgtttctcttcttcctttcctctttaccactcccaaccatatcacgtttga

SEQ ID NO: 224021 - DNA, 568 bp, Homo sapiens
tgcaaaggagctacattaatgagatgtttaatttgaggttttaattttgcaaatgttgggaagcataattaaggttcaggcagtatcataagtgtcttcaggaatacaaaataactgtttttgcatctagagtttctgggaacattttctgcctaaacacaagccacttatagctgttttcctgtgttctaaaagcaccccaggcactgtgaagacacagaacatgtggtactcatagaggtggcaaataatcagcatggctgtcattgtgacgattagcagaaagcagtgtgctgagaggagtgaaggtataggtgaaaggcagcgggcactggcttatatttattttattctcataattgcagggcagttttcttcaattttattctatatgctatctcagatcattaaagcagtggagaaggacaggaatattgagttagttagggatatagataggatggaaaagcattctggacaaaaaaaaatgagcatagaaaggatttgaaaacttaagaaacaaattattctcaagcattttctttgtatcagcataccatataattta

SEQ ID NO: 224022 - DNA, 554 bp, Homo sapiens
  misc_feature (8)..(8): n is a, c, g, or t
  misc_feature (11)..(11): n is a, c, g, or t
  misc_feature (13)..(13): n is a, c, g, or t
  misc_feature (17)..(17): n is a, c, g, or t
tctagagnatncncggncagaatcacactcaaaatccacttaaaaccacacagaaaaaccaactttattacttcataaatatactttgtctttagacccaacaaagcattaactcagcttgatcagtttattcacaagtcttggcaccaaatgaattctgactatatacaaagccaaatggttggaatttcacatcacttgaattgttcaaaagaataagatgcagaccctaaagtcattccacaaaagaaatctaaaacttttcagaacaatggtaacatcattggggaaaaaagcacaataagctttttgtctgctctaaagaagacaatgcttacttggcttttattactaatgaaagatctgttttaagaaaaaatctttaaaaacttgttcttcaattgatccaatgaccttatagtcatagattattgtcatcatcatctttataaaagggagactgaaaaaggagacacgacatgaaatacatgagtatattaaaagatttaatatactgagattttttttttttttttttgaggtggagtcttgct

SEQ ID NO: 224023 - DNA, 559 bp, Homo sapiens
ttcttcaatatttgaaaaccttttttaaactttttttttgtaacccagttgaatgcagtagcacaaactatcatgatttgcatttctgcctcttaaattcagaggattgcaaacaatattaaaataacagtgctgccggagagaagaaataccttttacttgcgtgctgtgtatagcagtgtatcagagttgtattaatgccaccctatgagatgttatagatcactttatttcatacttaaatcattttggagaaagaagaaagacagcaatatatgcctatacttcttaaacatttttttcaccatctttaagaaagttcaactttccaaaaaatttcaaacacaaataattgggaaaagaattttgagttttttttcctggacctttatatccttagcattgaatagttatcacctttcgaaatgctctaaaacatggagggctctgtgaaaaacatctgtcttgttattgaggtgaaaaatgtgaacaaaatgatacacagctactcctcttttttttttttttaagtattaagcaagatttctttttcttccaa

SEQ ID NO: 224024 - DNA, 621 bp, Homo sapiens
ggagaggcaatagaagctggggcttggctggataacaagcctggcacactgagtttgtctctgaggtttagtttctcacctgtaagatgatgatataataatgtgcctcatgggattaaagaaaataagagatgcctagatacttatacattgctataaaaatgtctgtgttataagagtgacatggcattccacaaaatgcagtgtagatgtaaattagttggaatggtgacctcacccctgctaggtagcactggcttatgtcccacctgagagtagtagcatctgagggctagccacactgaacaagccacacacctgacctcagcatcctcttctgtgaggggaatgctctctgctcttctacctgcatgcaccgtgtttgtggaagtgctctgtgtaggacagggaaagcaccttgcagagagcaagggcccactggctgcagagagcctggtgggtgatggaccagagataagggtgagggacagtttagagtgtcacagtttctcatagagctttgggcagtgacaccagtattagtctcaggaccatcattgactcctggttagtttttctgttttcaaaacactttatcagctgtaaagcacttaaaaatgt

SEQ ID NO: 224025 - DNA, 428 bp, Homo sapiens
gtggtgttggtcttttcaatgtgaaccatgctaacgggtgtggaacggtatttcactgtggttttaatctgcagtcccctagggaccaatgctattgggctgttgccctgtatcccactgtttcactcatcttccccagtgaacgatgtctcagggcaggtgtgtatgttacttatcattttatgcccagcatctatcccaagtccagacacatgcccagttgtttacagaatgaacacttcttttagaaataaacacagaccacgtagatatagcccaaaaggttgaaaaacaggtttaaaaagctatagactaaagaaatcaaaatcggatgggcacagtggctcacgcctgtaatcccagcactttgggaggccgaggtgagtggatcctggctaacacggtgaaaccccatctctactaaaaat

SEQ ID NO: 224026 - DNA, 391 bp, Homo sapiens
caaaatagacttttggtaaagtacaaataccattttcccttttagtattcaggcaactcagaagctcttttttaaaagcctcctctaggctagatgtggtggctcacgcctgttatcccagcacttgggaggccaaggtgggaggattgcttgagtccaggagttcgagaccagcctgggcaatgtagcaagaccctgtctctacaaaaaatgtacaaaaattagccaagcgtggtggtacacatcaaatctgtagtcccagctactcaggaggctgaggtagaaggattcctttagcccaggagttcaaggatgtagtgtgcaatgattgtgcctgtgaaaagctactgcactccagcctgggcaacataatgaaaccctgtctttacca

SEQ ID NO: 224027 - DNA, 663 bp, Homo sapiens
gcaaaatttattttcataagcataaattaaaaggactttcctaaggtggtactctgaccatgtaatcacatttttgatctttcatcccaaggaaataatcagaatattgtcaaagattcctgatgtttgtttcagtatcattttttccaccagtccattggaatctgtattgtttttaatatgaattagaaaaaacccagtcctaacctttagtttctttaataaagaacacttaagcttattttataccacaattaaacaagaatagcgaaagaaaagtttatgccactctttataaacatagatgcaaaagtcataaataaaatatcagaaactagaattcagtggtttattaaaaacaaaaccacaaaaacataactaggcatggtggctcacgcctgtaatcctagcactttgggaggccgaggcaggcagatcacctgaggtcaggagtttcagactagcctggccaacatagtgaaacccggtctctactgaaaatacaaaaactagctgggtgtggtggcatgtgcctgtaatcccagctactcgggaggctgaggcaggagaattgcttgaacccaggaggcacaggttgcggtgagcccagattgagccactgcactgcagcttgggcgatgagcaaaattccgtctcaaaaaa

SEQ ID NO: 224028 - DNA, 323 bp, Homo sapiens
gcacagcagcagagtccccgctacggggtcggcattttctcatcctcttgctcaggcgggcatgattagggggctgggaaggactcacagaaggcgacgcagcaagaagtgacagagacccagaccctccggagccccagctgctcacctgaccctgcaccgccccccaggaagaatcaaacgtctctaggcagaaagggcggccgtatccagaagagagaacagccatgcagtgatgtgcttagggaaatctggcgcaacaatgtcaaggcgagcactcaccttgtgcccagccctgtaataaaaggtttatatacagtatt

SEQ ID NO: 224029 - DNA, 597 bp, Homo sapiens
aattgacacacaatcaactgtagatatttgaagtgtacaatttgataagcttgatactcctatgaaatcattaccacactcaagataatgaatatagccaacacccccccaaatttcctcttgcatctgaaggtgttcagaacacacccctccaaaatatgctacttgaacatattgactagtttagctgaacgcccttgagaaacaacagatgcaggaagggctttctgaccatcccttttctacctaaaaggttacaaaatttcccatgaaaaaggtaccctccctgtaccaggaaaagaacattcttatcaccagagattgggagagttgaaatggacctatacaaacaaacctacaaaataacccttatcttccattagtttcctccgtatattttctagtcactgttctacaattcactgttcctagtccaaacccctctgtcttgtcacatacctacaatttattgttctttttgtaaaaaggtacataaacttttgggtctaatggcttctttgggtcctcattttccttctgaagattctgcttgcatgtaaaaatattaaataaaatctgtatgctttttctcctctc

SEQ ID NO: 224030 - DNA, 457 bp, Homo sapiens
actttgactattgcaagcagttttatcgcactgtaggtaaaacatgtgctttgaaatcatatgataaatttattaaatgctaaggactttatattcactgtttaattttatcatcttaataaccttcattattacctccattaaacactatttgttggctacttacattattctgattttgcaaatctaaatttgagaggctttcccaatgtcacataagttaataagtggcatagctggggtttgaattaaagtctaccggattccaagatctgtttaccgttgttctacaatatgtactttttaggtccctgagaatgctaacaacatttcttttgaaatctggatagcagctttattaatatgtgattagggcaccatatttcaggcaacaaattctttgaaatctttcatttccatagtgagataaggatcagttctgtggcattgtcagcca

SEQ ID NO: 224031 - DNA, 584 bp, Homo sapiens
tttaactaataaaatgtaataaattaaaatatgacaacacattttgttagccagatcttaggaaaataatcactcttttcattgctgttaaggaatacaaactgctacaacccttctcaatggaaacttggcaatacctaatataactacataaggagccctataatctcacttataaaatctaccctgaagatacatatccaacaatatgaaaaacatatgtacaagtttattcattgtaagattatatataattgctaaatttaagaaacaaattaaatactcatatatagaacagtggtttttaaataaactctaacaattcacacaagagagcactatgcagctataaaataaatgaggaagagctctatggattcatattcagagatttccaaggtatattcttatgtggaaagcaaagtacagaagaatatctagagtatactactcttcatgtaagaaagaagtatatataagaaaatatacatatatccacatatatgaggaaaaacatactggaaagttaaactagaaacaaatgagattcgtcacctacagaggttaagtaggatcagcgtgga

SEQ ID NO: 224032 - DNA, 218 bp, Homo sapiens
gccgaggcgggtggatcacctgaggtcaagagttccagaccagcctggccaatatggtgaaaccttgtctctactaaaactacaaaaattagcagggtggggtggcaggcgcctgtaatccgagctactcgggagactaggactacaggtgctcaccaccgcgcttggctaatttttatatttttacaaagctttaaataaaaattgcttaaagctga

SEQ ID NO: 224033 - DNA, 476 bp, Homo sapiens
atgcccggctaattttttgtattttcagtagagacagggtttctccatgttagcagaatggtctcaatctcctgacctcgtaatccgcccacctcagactcccaaagtgctgggattacaagcatgagccactgcagtttacttttaaagagatttatatcaaattacatcttgattatcttgaattttaaagttccctagaaggaccaaatggccaataactataattcaaatggttcagagctataaagaacaaataggtaattttgaaatttcacccattgtaacttggtcattaacggagaatgtgtaaatgtgtagcacagatattatgtgaggtactggtggtaaggcgacataatcctcaaactaatggtttatagtaaggaagagagacacacacaaaatatgaagctatgccattaatattagaaagagtgaaaatgcacagtccattccacaaaacactactattg

SEQ ID NO: 224034 - DNA, 362 bp, Homo sapiens
ctcaagtttgcctgcaaaatgtagctaatctacctatctcccatcaagaagacttaaaggtgagccaggcgcggaggctcacacctctaatcccagcactttgggaggctgaggtaggcggatcacctgaggtcaggagttcaagaccagcctagccaacgtggtgaaacctcatctctactagaaatacaaaaatcagctgggtgtggtggcaggctacctgtaatcccagctcctccagaggctgaggcaggagaatagcttgaacccgggaggcagaggttgcagcgagccgagatcctgccactgcactccagcctgggtgacagagcgagactctgtctcaaaaaacaaaacaaaac

SEQ ID NO: 224035 - DNA, 647 bp, Homo sapiens
tgtttagagacaagggtcacgctgtactgcccaggctgggtgtaggttttttctgaagagcatttgggagttttgtttttgcttggttacttttcctatgcacccttctaccactagggggagatgattaatcactaattgaagggattttgttcgttttttatgttttgggtttttttgtttgtttgtttgtttgtttcaataaagaaagagtttaattgcagtaaggcaggccgcgcaggagatggcgttcttattcaaatcggtctctctgaaggctcagaggttaggggttttcaaggcggagttcttgctatcattccactccttaggtacatgaagttggtagatgtgtagtttgatgttaaattattgggtggatgcatgcaccgctggttgtagagactggtaaagcccactagcaggaccccacctggaccaaagcaatccctcaacccgctggaccatgaccgagaacaaacacaaaggacctgaaatgcgttgtgaaggccagaagccgacatccacattctccacccacggagagccccagagtccctcatgcacatcctgcttgatctattacacacattcacacattcgcaacacatttgtttggttttcaagcttacaacatattagaaaca

SEQ ID NO: 224036 - DNA, 549 bp, Homo sapiens
cttaagatgagctatgcaggaagaatcagacaaaaattagccaaaaaaaatgcagaaaagcattttaggcagagatgccaataatgaaggtacagcgaggcaaactgcatattacactggtgatagtgtgtatgcccagttgagtggcgggaaagaatcacatgggaaataaggctgaaatggcagagggcagacaaatacatacaaatactaccatgcaaggataaaatgtagccatggtgacactaggaaaaatccagaaatcgcaaagacgacaggaaagaacaactgataaaagtgacttatgcttacaaataaggcaacaggatcatctactaatcagctgtgagactgtatgagacatgccttcggtttaggccctttctcccctgcctgagtctctaagagaaggtctaggccgttgctcagtgtgctgtgagcctgacatggagtgttaatgcacatggaccatgggaatgaataccaaaaagaccaagcacattttatttttatttggagctatatattaatacgattggtaaaaatgcc

SEQ ID NO: 224037 - DNA, 159 bp, Homo sapiens
catcctgttacatagacctaattttaattagcacatttctaaagaagactcagactaagaaacacatcttttagtaactgacatgttactaaaaggctaacatgaaggtcatattaagctttttccatgttaccagtacacacacacacacacacacac

SEQ ID NO: 224038 - DNA, 571 bp, Homo sapiens
tgtgggcggaggacgattagagggcagttggctgtgtcagacctgtgggtggagggccattggctgtgtcaggcctgtgtgcgcagggcgattggctgtgtcagcctgtgggccaagggtgattggctgtgtcaggcctgtgggcggagggcgattggctgtgtcaggcctgtgagcgaggagcgttggctgtgtcaggcctgtgggaggagtgcgattggctgtgtcaggcttgtgggccaagggcgattggctgtttcaggcctgtgggaggagcgcgaatggctgtttcaggcccgtgggccgagggcgattggctgtgtcaggcctgtgggcggagggcgattggagcgtgaaaggcaggtcaagtcctgggggaagcacagaggttggctgtggcctggaaaagagcgtggcccaaaacacttactggctgcgtggtccgaccatggtgcaggtgattgcatagtcagtatgtcagctcctgaagtcaaatgaattagtccttaggaacatcccaggcatatatgttgtgtgacttgattttgtgttagctcaggcatacgcatta

SEQ ID NO: 224039 - DNA, 143 bp, Homo sapiens
gattgtaaggatgtttgtatgtggggggtgcttgtggctccttaactggctctggaaagagctacttcccatagtgaaccctgtgaggtccaattctgttcctccccttggagctccaagagaaggtcattgtccttgtagca

SEQ ID NO: 224040 - DNA, 440 bp, Homo sapiens
acaaaacaatggaaatgaaccattggaaggtttctagtggttacatgaggtacagaagagtagcaaatgtggccacagttacaagtgccagcctggagccagccctagattttagtcctgactgtatcaactactggctatgcgatcccaggcaagccacttaccttcttgccttctccataataaaatggaaacagcatggcaccaacctcccaggttggtaagttagctgatttacacagcaacacggggaagccctcaggctttgatggtgcccagacctggattcaaattccttttctttcacaaataagcaaagtactttgtaaacgtcaattttctcatttgtcaataaggataattattaaatcagttaatatttgtaagacacttgagttagaactgtacttgtgatatagtgaacacccctgccccgtgcc

SEQ ID NO: 224041 - DNA, 415 bp, Homo sapiens
ctttgggaggctgaggtgggtggatcacttgaggtcaagagttcaagcccaggagttcaagaccaccctggccaacagtgtaaaaccttgtctccactggatcatgccactgcatccagactgggcaacagcgtgagaccccgtctcaaaaaaaaaaagaaaagaaaaagaaaaatatggaacccttcgtgaatctgtgtcatccttgtactgaggccttgctaatctctgtatctttccaattgtagggtatctactaccaaaggaggcacttgaatattttaatccaaattatatgaggaaaaaaagctggaatttctaatatttaaacctagttggctctagtttaaagatataaatacgtacctcacttaaacaccatgtaaataaaatctaatttaagcacaaatcccta

SEQ ID NO: 224042 - DNA, 582 bp, Homo sapiens
  misc_feature (8)..(8): n is a, c, g, or t
  misc_feature (10)..(10): n is a, c, g, or t
  misc_feature (12)..(12): n is a, c, g, or t
ccaaattngncntttggccggggtagtttggttctaggaggcgctagtgtgaaatcaaagggcaaagtaagatcatgtatagctccctaaaaaaaaaaagtagctccctactttaaaatataataaatgaagggaaggaaaaactagtttaaaagcgtagaaactgacaacaatagttgtctttcataaaggtaacgtaggctggacacggtggctcacgtctgtaatccaagcactttgggaggccgaggcggatggatcaccagaggtcaggagtttgagaccagcctggccaacatggcaaaaccccttctctactaaaaatgaaaaaaattagccaagcgtagtggcaggtgcctgtagtcccagctgctagggaggctgaggtgggagaatcgcttgaaccggggaggcagaggttgcagtgagccgagatcgcgccactgcactccagcctgggcgacagagtgagactccgtctcaaaaaaaccaaaaccaaaaacaaaaaacgtaatgcatataatctatttagtaatcatggttttagttttcttaggttagatattaagagctgaagacctt

SEQ ID NO: 224043 - DNA, 320 bp, Homo sapiens
tatgggagaccagggcattgacagaaagccaggaaaaggagagtttaatggtttgcggttttgatatttttgtccattgtagaaaatttggaaagtttagaaatgtttaaagaagcagccagaagtccactcctagagttcgggtctgtcatcagacccatctccttgcctcagcttcctccttcaaaaacatccagccaggctgggtgcggtggctcatacctgtaatctcagcactttgggaggctgaggtgggcagatcacatgaggtaaggagttcgagaccaacctggccaacatggtaaaaccccgtctctact

SEQ ID NO: 224044 - DNA, 408 bp, Homo sapiens
gaagtctcccagccccccttggtcccaggtggtcctgaaatgctgatgcattctgcttaggtttcaagcagtagataactctggctttcagcacaaataaatcccgagactaaaattttggggggaggaggactggaatttctgcctcttctcttccctctgcaaaagagaaatcccaactattgtcattgttccagggtaataatttgaaagaagtttcacaacctttccatatacttatattttcagctgctaacatgatctcattttgatgaaaaagcaagtgccacctttggatgtctgggtgagttgaaggttaatataggcaaaccttttgtcctaagaactaattgttatttagtattcttggaactgtgggaatgattgataaagccatttgaaaaccca

SEQ ID NO: 224045 - DNA, 342 bp, Homo sapiens
caaaaagtgggaaaaacattttcagaacaaatatcatggctccttaattttaaaaagatgccttgggtgcgttggctcacgcctgtaatcccagcactttgggaggccgaggcgggaggatcatgaggtcaggagatcgagaccatcctggctaacatggtgaaaccccatctctactaaaaatacaaaaaaattagccgggcatggtggtgggcgcctggagtcccagctacttgggaggctgaggcaggagaatggtgtgaacccgggaggcagagcttgcagtgagctgagatcgcaccactgcactccagcctgggcgacagagcgagactccgtctc

SEQ ID NO: 224046 - DNA, 246 bp, Homo sapiens
gggcaagccgaggagtaatggagaggctgcgggctgggttaaatgggagcgagtgggtgggttggagctacgtgttctaccctgtgactccaggcacgtctggccactgccggggagggaaggagcgacctgcccgccctcccccggcttcatcacatgagtctcacgtgttggacaacgctccggcggctgctagggagcccccacccccagccccggcccccaggtgtctgcggctgcggccgc

SEQ ID NO: 224047 - DNA, 314 bp, Homo sapiens
tcagtgattttcaagagctgggggttgggggaggggttgactacctagggcacaagggaatttgagggagttgtggaactgttccgtatcttgattgagtttggggtttacttttatcaaaacttatagaactgtacgatataaagggtaaaattcactgtatgtaagttatatctcttttttttaagttttaagattaaaaactaaaaaggaggcaaaactaacctatggatgtcagcagagtggtagctttgggaaggagggaaagtgccttctggggttccgggactgttctgtttcttggccttatcgag

SEQ ID NO: 224048 - DNA, 498 bp, Homo sapiens
cggtccattagctgtgtattacaggcgtgagccactacgcctggcccacaaaatctttttagtacctcatacttaagtaaatatgagcagtcagatagttgaggaatgagagcctgggaccaagatatgtcgaggaaatagcataggaagcataagaaagctggaaaataacctataaataatggcaaaaaaaaaaagcaaacaataggaagaggaactatataaaaggaacatttggagcatagaagagagttcatggaaatgtaaaaaatgatggtaccctgggttttgatatagtaagtaaaaaactaagggtaagagggtcatgaaagcatctagaagtaggagggaaagccagtcaaattcacaggatgaagtcaggaagataatagagcagtgcccgcaagatcctgagggaaagcaagttcccaatctataagtctgtaaccctcacacctgatggccccttgaacatattcagggcttcaaaagatcgat

SEQ ID NO: 224049 - DNA, 545 bp, Homo sapiens
aacagggaccccagtgtggaaggaactgaatcacaccccaagcaggtgtgattggaagaggatcctgagctccagatgacaagggaccccagccaggaccttgcttttggccttgggaagccctgtatatagaacccggtcatgtcatgcccagccttctgtttacccagataaagtttgaacagagctgtgagctgataaatgggtcgtgttttaagttgctaagtttgtggtgatttgttgtgaagcattagaaaacccatacagggcaacattaaccagtctggaatatcccagtgccagtggcaggatcccatacatcaatgtctcttcagaacatttgatgttgtactaaggtcatagtaggttccaataaatagtaagttgaattttcaaaatcactatacttgtagtgtaggtcatctgaattttagagttttgtagcatatcaaggtacattgagtgatgaggaaaaacatcttgagattttccttaaaaaaaaaaattttttttaacctagtaaagaaattgagaaacatcatttt

SEQ ID NO: 224050 - DNA, 435 bp, Homo sapiens
cgtgggcccagacttgaataaggaggagacaaaggggtgacaggaggaaagtatgccaggctgaggggacagccctgcacgcagcttctgaggactccagcctagacatggagggagagatgtgactcagccaaacagggacccaaagacagtggctgaagcaggtgctgctcctgggtcagaaagacctgagttccgggcggggcacagtggctcacgcctgtaatcccagcactttgggaggccggggcgggcagatcacttgaggtcaggagttcaagaccagcctggccaacatggtgaaaccccgtctctactaaagatacaaaaattggccggatgttgtggcacatgcctgtaatctcagctactcaagagtttgaggtcgggagttccagaccagcccggccaacatgatgagacctcatctctact

SEQ ID NO: 224051 - DNA, 556 bp, Homo sapiens
aagagttcattggtttagcagtcagcactgatggcaggaatgcaaactggtatatcttttaaaaatgttatccccttttatatcatataagattagattggtcatgttaaaataccaaaactacagttacccaagcaagatatgagtttaatttgctctcaagtggtcctgggttggtgtggaggctctatagtcatcaggaacccaactttcttccatcttgctgctgtgccgttcttaatacatgattcccagctagtggtgcagtgctggctttcatgtttatatttctagccggcagaaaggattgaggaaagagttatccacctcctgcaagtagatttgcaggaattctcactcctgttagccagatattacccacctagccacatgggggagtctgggaaatggggtccttattctagatagtcatggacccaaccaaaattccaggcttctgttactaagcaagagcagggaaaagaataagaggaccgccaaccattctgccttagtgtagttgatcctgtaattctacttttaggagtttatccta

SEQ ID NO: 224052 - DNA, 460 bp, Homo sapiens
tcattctagtcatgcccatgcagcagaggggagtttcatctttaatgccacatctggctttacactagaggcctgaacctgccggatgcacaattttgttcttttccctgctggctaggatttgcaggcacccagaagctgaagaccctcggggtctccagaggaggtcacatgtgcctctggccacagccacccctggactttcagctggccagtgctcccagctcccagcccttggctggcagaggtgagcaggagtcccacccactcctccccagcttagccgagtcatgttgatattctggcggcatagtcaggcttgttattgagcacatgctttgcagattagcctgtttgtatagccaatcgaacatgtgctccattaaaaattaaagcatcctgttttaaggatggagcaggagacatcagctgccactgtgtagcagacatgcaaagcccc

SEQ ID NO: 224053 - DNA, 911 bp, Homo sapiens
tctaaagacatgcagcttctgatcgaagtgtaacaatctagtaatgagtttaaaataggtaattcttctataaactagattcaggatgatctttaccaaatccgtaagttctatgtttgtcatagaaatttgattcttcaaaagccaatgttaaaaatacaaattataatattgatttctatctaatttgacattttaatttggggaattaacactatttactattttcagaaaagtgcttgaaaatagaagcctgaaatcttaatctttatctcataatttaaaaacaaaaagagtcctttgcaggaacatgaatggagctggaggctattattcttcaaactagtgcaggaacaaaaaaccagataccgtatgttctcattgtaagtgggagctaaatgatgagaacacatggatacttagaggggaacagaagacacaggggcctgcctgaggggaggaggtggaagaagggagaggatcaggacaaataactaatgggtactcggcttaatactagggtgacagttataatctcttcacaatctcccatgatacaagtttacctatataacatacctgcacgtatacccctgaacttaaaagttttaaaaaaatgggaaaattaaaaaaagagagaaagctgtaacagtagcagttgaattttatattcaaaaagcaaacatttcaaaacaaatcatgaaattgtttttatttgttattgattttataacatgggtttaatttcaaatctatgttttagagtatcttttggtgtgaagacgttattagccaatggtgcctttttctttcataattaattcactatggatttaatttatgtaaatgaaatagtggcattatttattgcacaggaaaattaaaattttatgttacaaagttcaaactta

SEQ ID NO: 224054 - DNA, 205 bp, Homo sapiens
taccctgtgatccttttcaacacaaaaactgactgctctttcaactgtaaggtgattggcttccaaaattaatgtttccagtcaagcagtctgacttaggggtttatacagcctagctcaattacgcaaccactagtgatccatttaaccttgcaatatataggtgtccctcagcaaaaatgggataaaatttaaaaatgagttt

SEQ ID NO: 224055 - DNA, 437 bp, Homo sapiens
gtagagatggggtctcactatgttgcctgggctggtctggaactcctaggctcaagagattctccaaccttggcctccctaagtgctgggatttcaggcataagccaccacacccagcctacaggtggaatttttaagggtgattaggaattaactggacaaagaagagggaaagtctttgcaagtagaggaaagaatctgcttggagctcagataactattatttgaaaacataatgacatctagttcaaacttgtgactgagttccacagtagaattcacagaaaaaaaattattaaatataatatttccatcagtctgtgtctaaaagattaaaaaagagcaaataacaatcttaataaactgatgatagattatagcctcatctcttccaacatccgattctgtggaaatttgcatggacatctggtcgacgc

SEQ ID NO: 224056 - DNA, 426 bp, Homo sapiens
caagtgcgtggaacagcacctggcacagaatagggctcaaaaagtgtctgatgttccatccgtcagaagatcagcacctatgccaaagtgagcgcagggactgctgcccaaggagaggaggctgggtgcggcagctcacgcctgtaatgccagcactttgggaggccaaggccaggagatagcttgaggccagggatcgagaccagcctgggcaacgtagcgagaccccacctctacaaaaacatttaattagcggggtgtggtggcatgcacctgtggtctcagctactttggaggctgaggcgggaggatcgcttgagccccaagaggtcgaggctgtagtgacccttgatcagctccactgcataccagcccaggcaacagggcaagaccctgtctctcatagagagctagagaaagagaaag

SEQ ID NO: 224057 - DNA, 558 bp, Homo sapiens
cagaaaatgcctaactaattcaggagtagacatggaggtggggttagtagtcatggtgggagccatgagattgtatgggctttcattagcaggctgtaggcaacaggtgaagacctcagccaggcaagaaatgggaacagtcagagagatagaaaggagaacatgaaaggttttattttggttttttacagcactgtcaggacacttgagtagaagactctatttagccaagagggaatctttgctggcccgttatttcactagtgtgttgggaaatggaatatgactagaggagaatgtgaggtggaaagaaagccagtgcatgcagcttgagaggaagtagaagagagcgatgtgtttgagggggcggaagagtccagtcagagggcttgtgcacatctgaaggggaaatgcctcttgcttggctgagaggtgtctctctaatggcggggaaggaagaagccagagacatggagatgagcatagggaaggctgtgtgcagagagctgatgaggggggtctgcctgctctgtggcccctgggctctctgatggggac

SEQ ID NO: 224058 - DNA, 443 bp, Homo sapiens
caaagtgttgggattacaggcgtgagccaccatacccagcctctatttttaaattaataacaaagaagatatgacaacaaaagcacaagcaacaaaagaaaaatagacaaattgggcatcattaaaattaaaaacttttctgcttcaaaggatgtcatcaagaaagtggaaagacaagccacacaatgagagaaaatatttacaaatcagataactgataagggacttgtatgcagaatatataaagaactaatcacccataataaaaggacaaatgacacaattaaaaagtgggcaaagggtctgagaagatatttctccaaagaagatatagaaatgggcaataagcccatgaaaagatgctcaacatcattagtcattaagaaaatgcaaattaaaaccacagtgagataccgcatggcactggcaaggatgcttataat

SEQ ID NO: 224059 - DNA, 424 bp, Homo sapiens
aaaatctgctataagacattatgttggatggaggatgaccaaccatgaagtttaccaagccatttagttcagctgccatattcactggccgctactgtgtggcgtacgttaaaatagagcattatttaggggggtggggtgtgagaagacataaaatcaacagccttcatctagtctgataggtactatagttgaggtatatccctaagttaataaggatgagaatgtggtgtaaaattcattctaaagtgatggggaatcattgaagaattttaaatagagaatgacatatcctctagtagggtgactctatgttccagtgtgttgggacagtcctactttatctctgttatcctagtgtcagtattaataatgtcctttcattccttgaagtgtctgagtttggacaataaattatgtggtc

SEQ ID NO: 224060 - DNA, 540 bp, Homo sapiens
agacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaact

SEQ ID NO: 224061 - DNA, 422 bp, Homo sapiens
caggacgttagaatgggtgacagccactcagggatgtgggccttggcagggagggacttgagcttgagcccaccttcccactcctgctgccatacaactgtaatgcccgtcttcttatgatacgcacatcttcaaaacaagcctcaaggtgcagttcatgaatggggcaggaagtagggaatctctggtctcttcttaaaagaatcccacggcataactctccttttctacttagggaggcacctaagaattacaaaatttaaaatcctaggtctatccactaagaaatatgcactggtgttcctccctggctcctggccagagctgctaaaacccttctaatttcctcggtgacagaagtgttttctgttctaatgaggcaacacttggtgggctcctggatggggactggtcactagaaa

SEQ ID NO: 224062 - DNA, 469 bp, Homo sapiens
tgaactaacttcttcccaccatttttgtcagaaaatgacaaaacctgaacatactcagtatgaaaaagttcagcaaacttattctgtaattccaaaaaatattttctggtacctgatatatgccaggttctatgcaagatgctaggcaatacagtagcagccaaagagataaacttctgcctttaatgtgcctatttataaactactcagtgagaagcacattataaaacataataaattagtaagctcatactctgacaagagctttgaagcaaaattgtaggatgctatgagagagaacagttctcatagcatagtcatagtgatgacttttttcaaatagagtaaaatatgatttggaatgcatagattcccactatcatgatcaagttagagaagaagaaaatcaacagtaattcaatgctacattactagtcaaaataaatttggcaaaatcattggaaacaaa

SEQ ID NO: 224063 - DNA, 700 bp, Homo sapiens
ggagccgatcccaggggatgattggatggagatgtagacactttatttggaaggtgctaggagtcactgccaggctcaaagaacggggaaggggtggacaagacacaggagcagcacgaggaggagacacaaagaggggagggaagctgatgggcaggggggagagatgagcggacccaggtgcaagggtggagagcagtgggctggggcatgactgccgcttaaccagcctcatggtgtcactcgccgagcctcagtttccccttctgaattgaggggcaagagatgacctctaaggaccaccaaccctgctgtctatgaggccatggtgatactaaggcccagagggagcccggacctccagtgtcctccgtccatccattctctctgctcggctttgcactggcgtgggctgcatcgagtcccaggctgtacaccttggcagtcacgcggcgggggctctcgtgtgaggacgggagcagagccaaatgcaccagctgtcagccagactgaaggtgaagggagccaacaggctcatgtctgaatacaaggtcttcagcccacccctggaggcagtatgtcaggattcttccgaacagagaatctggggtctgttctaaaggggcctagagcatggccatggtcactgtatcttcagaaatgtttaaagttttgtctttcttggtcattggaagaggca

SEQ ID NO: 224064 - DNA, 869 bp, Homo sapiens
cgagctgaagggggctgaaattattccctctgaagaagaagaagaagaagaaaacatactgcagctcccgatttgaaacatcatatttgaaaacaaggtggggccttcatcatatgcaaccttcatattttagggcctgcctctttctattccttgacataaaccggactcttcatgctaatcaggctggaagtgtatcataaggatgctgaagctaaaaacaatgtccaaggccaaataactgacaagaagaaggccaaggcatctagaaaccatgtcttctgattcacagttgatcatatttttctatcacctttgataaggcataaaatattattttgatgagtaaataaaaagactttggacacctgctgtttgtctaatttatggtttccttctcttttctctagttgatatgactatattaagccaagaaaaaagttagatttgacaaacggattttaacaattttatgcacagaatattttttaaagttatttttacgagtctacagttttacaagtttaatgacatgttcagagggactagaaaatttacaaataacatgatttataaaatccatgatttcccaggaatatttttgccaccacatgggggtgtagtgttcttaatatgtactttgcaggaattctgagcatctcagctgagcaagcctggggagcagcagggagaactggattttatgtgcaagtttgtcttatctgcaccaagcatgaggccaggaataggagtcgatcttaattcatcctccaagtgtctcaaatataaaattggctttgtgatattaatttgtttaaattgttcaatctcaggaaaaacttcacagtatgtatgagttacccacatac

SEQ ID NO: 224065 - DNA, 844 bp, Homo sapiens
catacagagcctctgaaatttttaattagctggttgtacagtttaacattttctagctggaaattgcatggtataattaagaggatttaaagcataatttaacaaaatattactctatacttgacattttttaaaatgacaaattaaaatagaaatcatgcccttgttttgcagataaggatgctgaagctaaaaacaatgtccaaggccaaataactgacaagaagaaggccaaggcatctagaaaccatgtcttctgattcacagttgatcatatttttctatcacctttgataaggcataaaatattattttgatgagtaaataaaaagactttggacacctgctgtttgtctaatttatggtttccttctcttttctctagttgatatgactatattaagccaagaaaaaagttagatttgacaaacggattttaacaattttatgcacagaatattttttaaagttatttttacgagtctacagttttacaagtttaatgacatgttcagagggactagaaaatttacaaataacatgatttataaaatccatgatttcccaggaatatttttgccaccacatgggggtgtagtgttcttaatatgtactttgcaggaattctgagcatctcagctgagcaagcctggggagcagcagggagaactggattttatgtgcaagtttgtcttatctgcaccaagcatgaggccaggaataggagtcgatcttaattcatcctccaagtgtctcaaatataaaattggctttgtgatattaatttgtttaaattgttcaatctcaggaaaaacttcacagtatgtatgagttacccacatac

SEQ ID NO: 224066 - DNA, 462 bp, Homo sapiens
ccgagcccttgtccctcctctccgttagggtgcctggaggggggtacacttggggcttgcctggccccaggttcccagtccttaatgctccttaacccactgtgatgacttcctaggccttgaggaaagggaaggagaggggaggctgccggtggcttaccaagatgccggaaaccccggaatcctcagggtgagcctcttggggtcatgtccccaagctcctgtccttggggtcaggagatgccacccccccccccgggggacatgaaacagctctccctcctcacccctcacctcagggccacctgatgaccctggggcgatggtggaccccctgactcataagccccccagtcccctgggaagggggttcattgaccctttgggggtccttggactcactgatgcccccttggggcccagcgggttcaacaatgacactgcaaaaaggtttctttttac

SEQ ID NO: 224067 - DNA, 468 bp, Homo sapiens
cctgaagcagattattgataagatatatataatgcaagcttagagcaatcactaaagaaaataaaacattgtcatgaagtatattaaaaggcctatataccaaaacctagtaggatttatcccaggatttcaggagtggttcaacaaatgaaaatcagtcaacatattacacaagattaatagaatgagaggggaaaaaaaacatgattatcttaattgttgctgaaaaaaaaaaacatttaacaaactccagtaacctttcatgattgaaaaacaaaaacactcaataaactaggaatagaagggaactttctcaatatgataaaggccatatatgaaaaacctgcaactaacatcatactcaatggtgaaagcttcttccgtaaaataagaaacacaacaagtatgctcagttttaccacctctatttatcatagtactggaagttccagctaaagtcattaagca

SEQ ID NO: 224068 - DNA, 385 bp, Homo sapiens
aatcttcccactttgacctcccaaagtgctgcaattacaggcatgagccaccatgcccagtcccgtgtatcttgagtggagtcctgggtggatggtggggaggcccctggggtggggaacacagcatggagagccagtttgagggacaggatagtggactcagacacagccaagtggggcccagcagacacttagatcctggtgtccagggctcaggaagagatttagctggaagcactagcccagggctgtcaccactcagagtaatggggaccctaagcataagtgagattaccagggagagtgtgtagagaaaaaatgggagagggctcaggtcagaatcatgagtcatagtgacatttgaggagccaggtgtgggcaggca

SEQ ID NO: 224069 - DNA, 1486 bp, Homo sapiens
tgatttactatcagggaaattatgtaagagagactccctatgaatatagtgagtgtggaaaaatcttcaatcaacatattcttcttactgatcatattcatactgcagagaaacccagtgagtgtgggaaggccttcagccacacctcatctcttagccagcctcagatgttgcttacaggagagaagccctataagtgtgatgaatgtggaaaaagattcagccagaggatacatctcattcaacatcagagaattcacacaggagaaaagccttttatatgcaatggatgtgggaaagccttccgtcagcattcatcctttactcaacatctgaggattcatactggagaaaagccctataaatgtaatcaatgtggtaaagcttttagccgcatcacatcccttactgaacatcatagacttcataccggagagaaaccttacgaatgtggtttctgtggcaaagccttcagtcagaggacacatctgaatcaacatgaaagaactcatacaggagagaaaccctataaatgtaatgaatgcgggaaagcctttagccagagtgcacaccttaatcaacacaggaaaatccatactcgggagaaattatgtgaatataaatgtgagcaaactgttcgccacagtccttcatttagcagcacataacttatggtgggggaaatcagataaatatataaatgtaggagattttttggtcagacctttttatcccattcaatatcaaattattcatagtggagagaaagcttatacataaatttttgttttgttttgtttttgagaactgtctcaaaaaaaaaaaaaagtaaaatttaaaaataaaggcgatgctgtagtgcagccagtcacattaacttgaaataaacataaaagaggaatatttcacgaacgtcagttatttgtatgctttctttacagtttttaccatatctagtatttacttaatattctttataaagggatgcaagatttttagccttctcctaggaaatactatttagcatataaaataagttatatgctagttttatatgctaattaaatttattctactcttcatcaaaatagatacataaccttgaaattaaaaatattcgttgatgtccccccaaaaatcttgtgtgccgttgtttgagaaacagtgtgatagtttgtggcaatatcctgtgatgattctttttgcaatcttgacattattttcatcaaatgaatcctaggatcactttgagaagagccttgaagaagacttgagggtcctattgatgaactttgaaatattgattcagagaagtctgcttttctattttgttttagctttaaatttccctgtggcaagtctagattttttttcagttaaaattatttctgctgtatttgtagaacagaagttttgggattttgtaaaataatgaccagagactaagaattcccatgccaccccgtatcactgtggaagatggaga

SEQ ID NO: 224070 - DNA, 960 bp, Homo sapiens
tgatttactatcagggaaattatgtaagagagactccctatgaatatagtgagtgtggaaaaatcttcaatcaacatattcttcttactgatcatattcatactgcagagaaacccagtgagtgtgggaaggccttcagccacacctcatctcttagccagcctcagatgttgcttacaggagagaagccctataagtgtgatgaatgtggaaaaagattcagccagaggatacatctcattcaacatcagagaattcacacaggagaaaagccttttatatgcaatggatgtgggaaagccttccgtcagcattcatcctttactcaacatctgaggattcatactggagaaaagccctataaatgtaatcaatgtggtaaagcttttagccgcatcacatcccttactgaacatcatagacttcataccggagagaaaccttacgaatgtggtttctgtggcaaagccttcagtcagaggacacatctgaatcaacatgaaagaactcatacaggagagaaaccctataaatgtaatgaatgcgggaaagcctttagccagagtgcacaccttaatcaacacaggaaaatccatactcgggagaaattataggaagcttgggttcattgtaagtaacctgggacctgataagctagaattccaacttggattatttggaaaatttttgttcttccccccattttgcatggcctgccaggcagctgctgatgagttatataccatagtcctctttcgtgtttcttatgaacaatcttcgtctgggaattcatgttccttggtcttctgtctgttaacccgttgttggttcttcactaacatttctagagttgaggggctggcagtgttatacctcgcatccaccaccacatcttcagcttctttgtcacttctcagtctgccttttcagaattgaaaggtgcatcgataacaccgtacc

SEQ ID NO: 224071 - DNA, 1057 bp, Homo sapiens
tgatttactatcagggaaattatgtaagagagactccctatgaatatagtgagtgtggaaaaatcttcaatcaacatattcttcttactgatcatattcatactgcagagaaacccagtgagtgtgggaaggccttcagccacacctcatctcttagccagcctcagatgttgcttacaggagagaagccctataagtgtgatgaatgtggaaaaagattcagccagaggatacatctcattcaacatcagagaattcacacaggagaaaagccttttatatgcaatggatgtgggaaagccttccgtcagcattcatcctttactcaacatctgaggattcatactggagaaaagccctataaatgtaatcaatgtggtaaagcttttagccgcatcacatcccttactgaacatcatagacttcataccggagagaaaccttacgaatgtggtttctgtggcaaagccttcagtcagaggacacatctgaatcaacatgaaagaactcatacaggagagaaaccctataaatgtaatgaatgcgggaaagcctttagccagagtgcacaccttaatcaacacaggaaaatccatactcgggagaaattatatgctagttttatatgctaattaaatttattctactcttcatcaaaatagatacataaccttgaaattaaaaatattcgttgatgtccccccaaaaatcttgtgtgccgttgtttgagaaacagtgtgatagtttgtggcaatatcctgtgatgattctttttgcaatcttgacattattttcatcaaatgaatcctaggatcactttgagaagagccttgaagaagacttgagggtcctattgatgaactttgaaatattgattcagagaagtctgcttttctattttgttttagctttaaatttccctgtggcaagtctagattttttttcagttaaaattatttctgctgtatttgtagaacagaagttttgggattttgtaaaataatgaccagagactaagaattcccatgccaccccgtatcactgtggaagatggaga

SEQ ID NO: 224072 - DNA, 1569 bp, Homo sapiens
tgatttactatcagggaaattatgtaagagagactccctatgaatatagtgagtgtggaaaaatcttcaatcaacatattcttcttactgatcatattcatactgcagagaaacccagtgagtgtgggaaggccttcagccacacctcatctcttagccagcctcagatgttgcttacaggagagaagccctataagtgtgatgaatgtggaaaaagattcagccagaggatacatctcattcaacatcagagaattcacacaggagaaaagccttttatatgcaatggatgtgggaaagccttccgtcagcattcatcctttactcaacatctgaggattcatactggagaaaagccctataaatgtaatcaatgtggtaaagcttttagccgcatcacatcccttactgaacatcatagacttcataccggagagaaaccttacgaatgtggtttctgtggcaaagccttcagtcagaggacacatctgaatcaacatgaaagaactcatacaggagagaaaccctataaatgtaatgaatgcgggaaagcctttagccagagtgcacaccttaatcaacacaggaaaatccatactcgggagaaattatgtgaatataaatgtgagcaaactgttcgccacagtccttcatttagcagcacataacttatggtgggggaaatcagataaatatataaatgtaggagattttttggtcagacctttttatcccattcaatatcaaattattcatagtggagagaaagcttatacataaatttttgttttgttttgtttttgagactgagtctcactctgtcacccaggctgaagttgcagtgagccaagatcacgccactgtactccagcctgggcaacagagtgagactgtctcaaaaaaaaaaaaaagtaaaatttaaaaataaaggcgatgctgtagtgcagccagtcacattaacttgaaataaacataaaagaggaatatttcacgaacgtcagttatttgtatgctttctttacagtttttaccatatctagtatttacttaatattctttataaagggatgcaagatttttagccttctcctaggaaatactatttagcatataaaataagttatatgctagttttatatgctaattaaatttattctactcttcatcaaaatagatacataaccttgaaattaaaaatattcgttgatgtccccccaaaaatcttgtgtgccgttgtttgagaaacagtgtgatagtttgtggcaatatcctgtgatgattctttttgcaatcttgacattattttcatcaaatgaatcctaggatcactttgagaagagccttgaagaagacttgagggtcctattgatgaactttgaaatattgattcagagaagtctgcttttctattttgttttagctttaaatttccctgtggcaagtctagattttttttcagttaaaattatttctgctgtatttgtagaacagaagttttgggattttgtaaaataatgaccagagactaagaattcccatgccaccccgtatcactgtggaagatggaga

SEQ ID NO: 224073 - DNA, 535 bp, Homo sapiens
gcgctaagatcataagagttagccactgcgcccggcccctgggacttctttttagaggtttcgtttgcttgccaccaccatgcttcccatccctgttaacttactgtgaataggtaatacagtcacgtgtttcaaaaaatcagaaaatataaggtgtacagagaaaggttttcatccctttcctctccctcatctgcccagtttctcttaacacacacacacacacacacacacacacacacacgagcacttttatcagtcgctgtttacccttccagagattatacaaatggcaaatacagccttctcagacctctttttttacagaaaaagtagtaaactgttgtgcaccttgcacttttcattcaacaacgaaaacaggctccttgtttttttgccatgactgtgcagtattctcttttgtggagatgccacatttatttaaccaaccctctgtagaaagacatttgaagatgctggagacaaaattaaagatctaatccagaaaacctttccacaaaagtagaagagaaaa

SEQ ID NO: 224074 - DNA, 328 bp, Homo sapiens
tagccatttcagaatgaaatgggtgaagatgcactcaacagaatttgtgatagatccaaacataaattgatgaattttatcttgcttgtaattttggaaagtgaaaaaaacttggtctgagaaaaatgatactggtagaagaaaacctgatgacagctgtcactaactacacccagtcacacttgttatgatggaacaagtgacggaagcatcagtcttacaaaattcggacattccaaatgtaacccagggaatttggaacttcatagaaataatgaaaacagccaacacctcacagagcaggaatcttaaacagtaaagtttcacg

SEQ ID NO: 224075 - DNA, 385 bp, Homo sapiens
tctgatgagtgcattgaagaggatgacctgcttggttattctgcttcccgaatacaaaaaattaggcttctgaaatcaaacataagaagtcattgttgcttttattccagagactgggtctcgctgtgtttcccaggcaggtctctaactactgggctcaaatatctgtctgctgcagcctcccaaagtgatgggattagaggcattagccaccccacccagcctcaaccaaggttaaatcttaataatggcttttttataatttttagacaatatactttttataattttctgtttctaatttatttttctaacaagaatacattaacgttatagtcttgaagtgctcattaaattttataaaataaatgttattaagcataac

SEQ ID NO: 224076 - DNA, 827 bp, Homo sapiens
cttttaaacgtgccaatttactgcctttatgttattttctggagaagggccacaatcttgaacatggctaaagagaacttgtatgatctggtgaactttctcagctccatagaaggccactcaactccaacttcaatactccagccaagataattttctctgatgtcccttatgttcttgtctcagggtctctgctcttcctcctactcccatttatctctgttcattattcagctctctcctgcagggggctgggctctcctgtgatgggcttcaaagtactatgctcttttctccttcatggcaccaatcagagttggtaataacagatttctttgttaagatgtttgattaatgtctttttctccactaccctataaactttatgagggcagtaatcatatttgcttcctttttttaaaccatgaatctctcttgattggtatgtcgtagttctcagtgaatatttgatgactctatcctctatcttcttcctaaattgccctcagtgagcgccatgtaaagaattatttgcatttcttttcactactcttaaaaatactaccttaagctacaggcaaacaaggcttttaaaagtaagcatggctgattttttttctgaagcttaattcaagctaggtgacactttgggcagaaaaagatgactctgagtcctagccagggtactttgtttcactattagattggattggaattgggggaagaaaagagagaagaaatgtcctctctatccatcagaggaagtatctcctgctgatcatgacaaaagagatgtgggagaaaacactttcgaacctcattgaacc

SEQ ID NO: 224077 - DNA, 525 bp, Homo sapiens
ttctttcttctgcttgatcaattaggatactgataacctgtgaatgcttcacgaagttctcgtgctgcttttcagctccatcaggtcatttatgttcttctctaaactggttattctagttagcagttggaagtaaaacactcctgacgaaatgcaaaagaatggaaatcataacaaactggtctctcagaccacagtgcaatcaaattagaactcaggattaagaaattcactccaaaccacacaactacatggaaactgaacaacatgctcctgaatgattactgggtaagtaatgaaattaaggcagaaataaagaagttctttaaaaccaatgagaacaaagagacgacaaaccagaatctctgagtcctagccagggtactttgtttcactattagattggattggaattgggggaagaaaagagagaagaaatgtcctctctatccatcagaggaagtatctcctgctgatcatgacaaaagagatgtgggagaaaacactttcgaacctcattgaacc

SEQ ID NO: 224078 - DNA, 538 bp, Homo sapiens
aataaatctgggcaacactctagtattataagctttaggacatagttccagatatgtcaagttgttactaactcattacatatggcttgctcaagttactttaagtaagttgcttgaaaactgcttaattacatatgattgttctgggacaaaattctccatgagtttcttgtgtttccacacattttgcatgtgagacactggctgctatttgttccaaaccatttttttttcaaagacgtttgattagcaatcgaaaatgaaagattgagagtatttctccctatatcaaagatcagacatgcttacttccaattataaaatgtttaggttccctaaactcatatttcctctcttgtaacataatatactacagagatcatgtgttcctgtttgcattaccatgtaggtgggaactggggcttcagtatctggcaatgaataaataataaaataaaataactggtactctgattacagttattgctgtgtataataaactattcttcatctctgaaaaaaaaaaaccaacaagcat

SEQ ID NO: 224079 - DNA, 255 bp, Homo sapiens
cagcttcaaactcctgggctcaagcaatccttctgcctcagtcccttgactagctgggataactggcctgcgctaccacgcctgacctcatttcgttttcttgacctgttcttccctctccttgaattatcagtctcagctcttttcctcaccaaatccaagtctggcattctcctttccggccactcaaggactgagtgacaacttttgttattgcatcagcctacagatacttctgtcatggtgcttgccata

SEQ ID NO: 224080 - DNA, 119 bp, Homo sapiens
tattagagtcatttggggcacgtaagtggccaagtactttaaaagtccctttgggggcatttttaaccacctaggctcattggataaatttgttttttttttaaactgtgatactatct

SEQ ID NO: 224081 - DNA, 318 bp, Homo sapiens
aatcgtggttgtcaggggtgaaagggaggggagggggaaatgtggagttactagtcagcaggcatgaagtttcagttaagcaggatgaataagttccgccatacagtattgtacctatagtcaacagtactgtattgtacacttaaacatttgttaagaaggtagtattcatgtatgagaataaagtaaaaagtaatagttttggcagtggctcatgcctgtaatcccagcatgttgggaggcagaggcaggaggatcgcttgagcccgggagtttgatactagtctgagcaacatagggagactccatctctacaaa

SEQ ID NO: 224082 - DNA, 2026 bp, Homo sapiens
  misc_feature (111)..(111): n is a, c, g, or t
  misc_feature (449)..(449): n is a, c, g, or t
  misc_feature (901)..(901): n is a, c, g, or t
  misc_feature (915)..(915): n is a, c, g, or t
  misc_feature (1097)..(1097): n is a, c, g, or t
  misc_feature (1900)..(1900): n is a, c, g, or t
gagaaccaagctatgcttccatgctaatatcaaggttccttgcttttgacagctccctgcccctgctctctaccattctccattaatatttacttatttttgcttgcctanaagtttttaggcaatagttttagatccattacaaggtagatcctcctgtgtttgtcttccctattgaacctgcccatcacaatgtatctcacagaaaccatgagtatttcatagccttcatagcacttttaatgtagcaaatacattttataatcatttgtattactttgttcccaaatataatgcaagagacaagttggctagatcagtcttatcttgcagatattggtcgggagttcaagggtcataaaactttcctaactggggtgcagggccttaagtggcagagtgagaatcaaacccccctctccaaaactcctgtcttgttccttaacttntgcaaatgagcatagttgatgtgaacatccctgcaagccctttacacaggtgagaagtagttattattatttcactagtactaattagtagcattaggtgactatattcaaggctttggaaggcaagactaaaaatcagatttgggacagggagttcaaagatctgggcttcaccataccggatcattttggcaatagtggtgatttttggtgtagggaaaacaaagacctatgtttgggctaaccacaagccctgtgatcttgaacaagttctggaacatccctgagcctaaattacctttcaatggagatcctgtgatctatcacaatgcatttgtgagaatcaggggcatttctgtgatggcgctttgtcagtggtaatgcagtctgtacatgtgtccgattctgggtgcccagcggggcatctggcacacagtgatgacaccttactntgcttgtggggctnaaaggatttagacctagacaactcctagttcaagtcctcgttgtgctgtttaatacagggtgctcccttggtggtcacaggcactatttgttttctccacgtattcatttttagatctcttattaatgaggtcaccacagttgagtatagtgtgcccgcaaaagtgggatgagtgccacagncattcacgggcatttccaggttgtgcgctgatttgtcaccagtggatggctgtgcagtgtcccttcttccactgccaccatcccaccttctcttgggttttgtttgcactgtttgtatctgttacccgtggagggtctgcttctactgttgtaattgcttgtgttgtgactttgcatcatagctggagatccctctgtagttcaaatggaaagctggtgttgaaggtgaaaccaggtcttcttcagaaacttgtgtgggaacctttcatgggctggataagcatgaggatcaggacagggcagggtcactgaccttaaaggaggatgctttgacctgcctccagcatgcacccttcctgctgaagccattgttagtgtcccttaattactcaggccaccacccagcagcgcaactgtcaacttgcagaggacttcagtggtatcagtagtgttcctttttactctcataggtgtcctgattcggaggatacgttatatggtcaccctacttataggtgaatattgagtgaggtagtgtaaataatgtgcataaggccaggcataaggcaaggactcaacaaacatccactgtttttgttagagggggtgctaggtgctcaagaaatgtctgctgagtggccaggcatggtggctcacgcctgtagtcccagcactttgggagactgagttgggtggatcacgtgaggtcaggagtttgagaccagcctggtcaacatgatttaacctcgtctctactaaatatacaaaaaaaaaaaaaattagccaggtgtggtagtgggcgnctgtaatcccagctactcgggaggctgaggcaggagaatcgcttgaacccaggaggctgaggttgcagtgagccaggatggcaccactgcactccagcctgggcaatagagcaagactctgtctcc

SEQ ID NO: 224083 - DNA, 480 bp, Homo sapiens
ggcttctccgagggtgttcaggagtctcccaagtgcacaggggctcgtgcccaaagggtggaggtcggcccacttcgctcaattcaggagtggagaaggaagctagaggaccctctggaggtggcaggtttaatgtcctgcttttttatttatttatttatttatttatttatttattttgtaatcaactgaaagaaggcagaaggagtcgatggcctcttaggccggaaaccttacaagcataggaccaaggcagaaaaggtccagagggttcatggtcctccgttccacctgaatccagctagagagcgagccagggggataggtgtgcccctcgtcgcccgtgcgctgaggcactgtcacgcaaagagacattcaccttccacgtcaacgcacctttaagggcgagagcggtccgccgtgcccaagaggaacgggatgacattcaactgggacttgcctcaccttggcttgggggac

SEQ ID NO: 224084 - DNA, 397 bp, Homo sapiens
cctttaggcttttacttgatgtctccatcatcttattttgcaagcccacagataatttgaggaagatgagttgccgcagtagaaatgatagggagaaaaaaaaaactacaaaaaacagaaataaaaaattctaaaaccacagcaatatagtagctttattataggacatgctggataaacaatccaacagctacctcagggagcttctgagagaatgcatgatgcaatgatcagtgaggcaagatcaaattgtgtttgatgttcaagaaaggaaaaacaattcatgtaagtctatccaaagtagtaaatgttttatatttaagtagtgtatattcacttgtcagatgctcagttcacttatctgaaacctatgaaataaagtcttatattttagaat

SEQ ID NO: 224085 - DNA, 584 bp, Homo sapiens
gtgtctccatgggccctaggatatgatcagcagagaactacaggacagatcattaccatagagaatgatgaattattctaacaaagggagattcagggtaaacagaaggcaagaagctcacaaatcatccaagacagaaaatgttaaatattgacggctgcctggcgatgctattttaggaaagtgcattaggtggacgtggtaaatgccaggtttgccattccagaaaaacagtcccatcagtccctggatggcatccctggccttccccggcctctgtgttccatcacacctaccgctgggtaaacacctcatcgtctttgaagcacaggaatgcacaccagtggaaaaaacactcaggcaccttccaggggaactaaaggccacatattttatcctaatgtagtcagaggcttcgatgcctcggccaggacaaggtctccccagctgacacccaggcccatctgtttcttgccaaacagctcaacaaactctgtctctggaaactccgggaaactaaatggcaagaaagctcaagaaaaggttaagtaaagccggtagccgggctcagtatttcacatctg

SEQ ID NO: 224086 - DNA, 622 bp, Homo sapiens
tgtgtccacagtagccacacctccagcatcttggcagcagtgagcacacagtgagtatctatgccaggccccattccagatacaccagatgccttcacattcacgtctcaccatgatccaatgaggcagagaccactgtgacccctactgcaccatgcaccaaagacagcagggcctcccaggttgggccaagagcattggctcatgcctgtaatcccagcattttgggaggccaaggagggagaattacttgaggtcagaagttggagaccagcctggccaacatggtgaaaccccatctctaccaaaaatgcaaaaattagccaggtatggcggtgcacgcttgtaatcccagctattcaggaggctgaggcaggacaatcgcttgaacacgagaggcagaggttgctgagctgagatcgcaccacggcactccaaaaaaaaagaggcctcccaggtctaagctcgcccagaaggaagcgaggtgggggctgaggctgactgtgtggccctggctggacaccgatgaggctgctccccccggtgccaagtgcttctgaatccctccgtgcaagaaccccaaggaggaggccccggccatgcttcgtttccagttggcaaa

SEQ ID NO: 224087 - DNA, 354 bp, Homo sapiens
caaatattcttattttgacattttccctccaattattgaagtgtgtacaaccactcttagctcacagggctgtccagaacagacagcacagggatttggctcatggacagtttgccgacctctgccctagagccactttgtccacttgagtggccaccaaccctatgtggctaatgagcacttgaaacatggctggtctgaaccaagatgttctgtgagtgtaaaatgcacactggatttccttagtacaaagaaaaccttggaaaatatctcaacaatattctgtattgattacatgttgacatgacaataccttggacattctgggtttaataaaatatattgttaaaattt

SEQ ID NO: 224088 - DNA, 140 bp, Homo sapiens
ccatgaggctcagcgggataagaccctcaaagcagctagagcatgcctggtgcacgggtagaaccccacatgccagaagtcacattgtcccggtggacgcagcaagcctttgagaccagaacagagcagggaagagggac

SEQ ID NO: 224089 - DNA, 442 bp, Homo sapiens
ttgaagatggcagagcctctatcattctagatctttgaaggactccatggagcacactcctatttccttcaaccccctcttctatcacattgtgatggggtattacaggagtgggaaataagtctctcttctggtgtacagtggaattgtctacaggctggataacatgtgatgtcacaacagatttaatgaagaaacaaatataaaaatcaagttctttccaaattgagccagaccttaaagacaagttgtgaaatccgtgaaaatacaaatcaatgttacttttttcactattttttgttctggaaaatatagttgtctttcataataatgttatttgtgttaacatgctcttttaaagtaaatgaacaaatatttattttaaaaacctctcagttgtaaatcctaatatggtaaatataaatataaacaaaagctcttt

SEQ ID NO: 224090 - DNA, 549 bp, Homo sapiens
tggtcccattgctacggattagaactaatttgtacaactatcagaattttaagactgattaaaggttttaggtgtttttctcctactttgcatactgagaataatatgtatagtatttttccagtatgatttacaattttataaatgtcagtatacatatgtatatataaattattctcaactccatttttttttaaataaaataagtacatgtttgtgtgctaaattgctcatttggcagtgatagattgaaaaacatttataaatttaaaaataaagcactataagatatgaggaatgaatagcttctatgtgaatttctatgtaattaatatcaatatttagaataaaagtgtatttgaggataagatatttgtttactaaaatgttttatttactaagagtagaggtgaattatgcatctttctaaggaaaagttcttttaatttctgtgtctatgaaaaagaattcataattcataattcttaattgccctcttttgatccatataattctttaaataaacgaaacaataccaattcaaaaagg

SEQ ID NO: 224091 - DNA, 392 bp, Homo sapiens
tatagagtatttcttctacatataaaaccaagctttttaaaatttaatttttataaactcaacaagtttatgtaatcataatgttctaaattatatcttttctttaaaaaaaatttccctcagatttgagactgtttgattcttgggggaattttcaaaattataaggattttattgaaaatatcatttattagtgtaatatgccaaaaatataacttttcaaatagcaaactgatacatacttagaggcattaaaatctcctataaattgatgataatgataggtaatatttattgagtgcttatacagtgccaggccctgtgccatttcacaggatatttaacaatcctctattgaggcatctatctctgttattataatacccatttta

SEQ ID NO: 224092 - DNA, 500 bp, Homo sapiens
acatttctctgggtccaatataggatttgtcttaaacttgtccgtattctctaattttttatccgttcattgccaatttcatttcatttcttcaaaatctctattttgtcatctctctagtcccacagcttaatatggactcttatttactttcggaactaataaaattacactgtccattcacacaactaagaactgggtaacctaacccaaacttttgtctccagtgttacaatctatcctacaaatatcaaaagttataaccactcagtgctctttccagaatgtctttctccactataatctcactgtctactgggtcaagttcaatcagctctcccagacactcaacatcctctacatctatccaccctacccctaagacatactctttgatcctatactttctctttcccatagcatgtttatttcacttttcaaaatcctatgttgattcttttcttcttgaatgaaggcccttccctctccatccacttctt

SEQ ID NO: 224093 - DNA, 177 bp, Homo sapiens
ccatggtgctggggaggtgtgagcggtatcttgaaggtggctttaagtttgggaagttcgggaagagcagtaaaggcacgatactgggactgagcccagtaggagtctgggaggcaggtcgggctggagaagcagggctgggcccgcggtgggctcagctgccctcagtaatagcga

SEQ ID NO: 224094 - DNA, 485 bp, Homo sapiens
gggtgaggagccaatgctgcctctgatgtcttaggttgtggagctggaaactcgtggaggagctggtattggtgtttctagttgtgggtcgtggtatttccagggtttcacaaaggccagattttatttcagttactcagaagcgaaagaaaatgtcttctgaaagaggtgaactcaatcattaccaatagaaaaagtatccactgtattcatctcttatagaaacagaaaaatataacatttccccccttagaatataacttaatgttccattgtatgtagctgaacaataacatctggaaaccagcatgaaaccctattattcacatgttaaaatgttgaaactatgaccaaaatatgaaaactgctagagctatcagaaagagacaagacaaaaaccttcttgcatatgtataaactaaatgtgacaatctcaaaaaacttttcaacattatgattaccttccagtttaaaaaccttaatcc

SEQ ID NO: 224095 - DNA, 1895 bp, Homo sapiens
tacggagattaggtcttgttatgttgcccaggctggtctcaaactcctgggcgcaataaatccttccacatcagccttccaaagtgttgggattacatgctgcacccccagtgtatcagcacttcttaaattaaaataatcttgccaactaatgtcttgttttacatccttcccctttagtctactacttgccattctatccttagtagcctcgatgacggctccccttttaccccatacctctctcccccaaaaaagcttggacagcaaccaaattggcttgtatcagtattgtcaactggaggcctacatgaggactcagcttactgtttttcttctggttaattgtggacataatcaagttcattgcttttactccccatctgctaccactcttgtgcagctatttatggtgatggctttgttacgtatatacacatagaccattgttaatcccctccttttcctttggctgccaaacagtattcatttgaacatcatcagaaggtgtgcaagcactttgggaggccgaggcgggtggatcacgaggtccagagattgagaccatcctggccaacatggtgaaaccccgtctacactgaaaatacaaaaattagctgggcatggtggctcgtgcctgtggtcccggctacttgggaggctgaggcaggagaatagcttgaaccagggagtcagaggttgcagtgagccgagatcgcgccattgcactccagcttggcaacagagcgagactccatctttaaaaaaaaaaaaaaaaaaaaaaccagcttgcaagctaagtagttatcacatgccaatttacatgatttttcttaaagtcatgagcatattgctgacagaagttacagaaagtacttgccttttgaggttaatctgagtcttccttaatttacaggaggaggatatgtaaaacattctaagcttaggtaaccaaataaacagctttttaaatctagatgaatatccagcaggatgacacgtttttgttgttctatactgtcttccacattgtcatcttacaacctgttttccatccactgaatgctgtttgctccctagatcactgtgtaaacccagttgaccccaccttcatttgtatagccactgaagagcatttgcaaaaatgcgtgtaaatgtagtagagaatatgtttgttagatttattattactgtcatattgcatgagacttaagagtttgattcagttcagagggaggttccatcttcgtgcaagtacaaagatcatttaaaaggctaaatgctgcctcttcaaaaaggtcacaagaaaggctctatgtgcttgatgagtgtaaatgcagtgtttttaaatttaccctgagagactatttttgtacttgtgatgagagaaaatttggaggaagatgtgacattagaattggtcctttaaacatagacttcagatagacctaagggaagaacattctagttgagaacaaagccattgaaatgttaatacgcaagttgggggaatctttgagttagactggttgggctagtaaagtatgatggagtgccaggatttcaggaatgtgttgagagataagaatggaaaagtagtacaactggtttactgaggaatcttaaatctgggtataaacgtgaaatggttttattttttccttactgggtctccagtcatacagtgtaaaacactcctaacctctgtactttcctctgcagtgcagtcctttaagaatcccttggtccgatgtaactttgccgccacttttggttactacaaaaaacttattccagaaattaagacaggttctagccattaaaaaaaaaatgaagtcacaaactcattgttttctctgaagaaaagttgaagctgttcccagctgcttggcatg

SEQ ID NO: 224096 - DNA, 394 bp, Homo sapiens
gagtccttactattttggaaaaatattggtgaacgagatggatttggatgtcatgaataattgaaatagttggtataaaggcaaatgagaagggaggggaatttcagttttcaagatccagtcattcaaatgaaagatagagagaataaaattactgttaggtcctacacctttctgaacagatgtttgttcgatcaacaaatatttattgagcatcctactctgtgctagttactttttgggggctttggtgtatattagtgaacaaaataaaaaggttcctgcccctgcggaacttaatgttgtagcagggagaagctgacattaaacaataatcctaggaaacaagcctgtaatatgttaaaggtcaaagtgctactgaataaaagaaaaa

SEQ ID NO: 224097 - DNA, 264 bp, Homo sapiens
attaaatcttcacatcccttttgatcctattatatttttaatggcagaagctcccagcgagggctcgagtgggatgcaatagaagttttaacattcaagggagcagatgaacttgcctcggtttgtgtgactgaatgagaaattacccagcgcagctctgctcagggcaataggtccctttgcctgtgctggatttgggtcaaacagctaaacctcaaatcagaaaatatcagcatcattttgtggggacacagaagtgtgggt

SEQ ID NO: 224098 - DNA, 270 bp, Homo sapiens
gcttgagtggacaaatatgcttttcattcattaaattggctcttccaaataattaagtagatcttgggaaaatatatgccacacttttacaagagggtataaaaggattagtggccgagaacagaaatttccaaaatgtgagctgtgtgacactgagatagctgaaatagctttaagtggtgcttgggtgaactttattctatatactaataataatgagatattatttgcaatgggctaaagtagacatttgttaaagagatcaatcta

SEQ ID NO: 224099 - DNA, 499 bp, Homo sapiens
gagtgtgtgtagcaggttgacttttgtgttacaaagggaaaatagtaacatatgttcatacttgcaggtttctaatcctgtctccaccgcttacatctgggtaaatttgggcaagttacatgttgtgtctgggcttcaatggtatcacctagaaacgaagataatcactaccacctaaaaaaaattgggaagattaaatgagaaaaatatttacaaagcacttagcaaggtatttggttcacaattgttgtaaaaaggacagttactactctaaggggctctgccttctctatataaacttataaactttagaaactaatctgacagcctagcacctactaatatttatttgctatagttcacccagtgtatttgtacatttaaaaatatatatctcatgaagtcccagagtgcctgaggattgaaaggggacagcatcacagctctaatgctaagagatacagaccattaaggctccatctgaaatcaagtatcttta

SEQ ID NO: 224100 - DNA, 348 bp, Homo sapiens
ctcagaagcacaactgcagtaagccagtgccagtgaaggagagatgggtgttgctgtgttgcccaggcttgtcttcaactcctggcctcaaggaatctgccctcattggcctctcagtgtgcttggtattataggcatgtgccaccatgtccagactaaaacattttctaattacaaaaattgtatgcatcataaagctttaaacttgcttttcaagacaaaagaagaaattttgaagaaacaaaccgctacaaaagcaaaaataatggtaggaaacgtgtagattaagagatacagtgtatgcaccttatttagatcttaatgcaaataaaatgtattttaaaaatg

SEQ ID NO: 224101 - DNA, 867 bp, Homo sapiens
gggctcaagtgatcgtcccaccttagcctcccaaagtgctaggattacaggcgtgagccaccgcacccagcccattttgtctttctaggcctcattttctccatgtgtttaatacaggcaaaagtagcatctgccttctagggctgtgctatccaatatggtagatactagccacatgtgactatttacatttaaattaattataattaaatagtttttcagttgcactaagccacatttcattagccacatgtggctagtgactaccatagtagacggtgcagatacaaaacgtttcacagaaaatctgactggacagtgctgttctaaggttaaaggagataatgtaggttaggaccctaggttctagaggcagcttctgacactttccagctgtgtgacttcaggcaaattacttaaccttgcagggcctcattttcctcatctataaattagtgcaaatcctaatagtgcccactccttgggcttgttttgaggactaaaccagttggtactgtattttaaaacagtttactaatattaactttttaaacacgttggctgggtgcagtggctcacacctgtaatctcaacactttgggagaccaaggcgggtagatcgcttgaggccaggagttcgataccagcctgagctacaaagtgagatcctgtctctacaaaaaaatttaaaagttagttggtcatagtgatgcacgcctgtggtcccagctacttggaagcctgaggtgggaggctgacttgagccctggaggtcaaagccacagtgagtaaaattacaccactgccctccagcctgggcaacacagtgagacgctgtctcaaaaataaataaaaataaaaaaagaa

SEQ ID NO: 224102 - DNA, 517 bp, Homo sapiens
agcacctgagaaaattcagtcagtataaaataaactttctagcaattaaactacattaaaatgtggtagaaaaagagaggcatggccactattggggactaaatagtggccttggatatcatgtagaagtagttatctttggaaaagtaaaaatccaaagacacggagatttcaaaaatcaaaacacctagaagacgagtctaagatatttaatgtgagtaagtgaagaaccacaaggagaaaaagggaaacgatacaggagggcacaattactaaatactataggaaactttagttcgaaagggctctcactctaataggttccaagcaacatgggtggggttggagtgtggggacacacctaggcagataaatttcattcaaatatttattgttacttcctgcagtgacaagtactgttttagttgctgggaatacagggtgaacaaagcaatgttagttcctttattgggtggaaggaagtaaatgaataaatatgtctcaggtggtaataagt

SEQ ID NO: 224103 - DNA, 321 bp, Homo sapiens
ctcaatcatgctttagactcacattaaagggcatcctaattggtaatcagtgcataaggaaccaaataaaattttaattaaatgctgtcgtgtgaattttccagtcattttatgcctgttgagacggttttcttatttaaagtcctcttctagtgctctgccttccctctttaaactttatcaagattttgtgctttttctcatgtaagggtttaattagcatcattaaagttttagtctgctgcatatttgcttaatgggcattttggtgcagtggaaagagcttggggtttggagtccaaagtggggaagttccttaaa

SEQ ID NO: 224104 - DNA, 387 bp, Homo sapiens
agctagtctcagaaatcttgagatctctgagcatcggtggacccttgaattggggtttaggatcaactttttaaacatgtgttatgtatgaataactgagatccaaagaaaagctaataaacaaatagtagaaagatatggaaaaaataaaagcagtgttataaacacacgatatgctcctccgaatctcagtcaccaattttagtctattgagtctttcattggacttccaggcttagcattagatgttgaaactatcttaagatcagaggagctggatacagtggctcatgcctgtaatgccagctgctcaggaggctgacacaggaggatcacttgagcccaggagtttgagatcagcctgggcgacatagcaagaccctgtct

SEQ ID NO: 224105 - DNA, 465 bp, Homo sapiens
actacgtccctaggctgtatgatatatatagcctgtcattcctaggcgacaaatttgtgtatcatgtaactatactgaataatgtaggcaactgtaacacaaatggtgagtatgtgtgtatctaaacataaaaagcgtaaggtaaaaatatggtattagaatcttagggggactaggttcagtggctcatgcctgtaatcccagctctttgggaggccaaggcaggaggatcacttgaggccgggagttccataccagcctgggaaacacagtgagacctccgtctctataaaattttttaaaaaattagccaggtatggtggtgagcatctgtagtttagctacttgggatgctgaggtgggaagatcactatttgagttcagtagttcaaagtgacagtgagctatgattgtgtcactgccttcctgcctgggcaacaaagcaagaccatgtctctctcttaa

SEQ ID NO: 224106 - DNA, 377 bp, Homo sapiens
atccacccacctcggcctcccaaagtgcagggattacaggcgtgagccactgcgcccggccaaatattctttttattttcgaaatgttcaactactactagaacagaatactggatcaccaagtacctaccagtcagcttcatactcattaacatttaggtgtttaaaaaaacctttctatggccgagcacagtggttcacacttgtaattccagcactttggaggcccaggtgggaggatgcttgagcccaggagtttgagaccagcctgggcagtgtggtgagacccccgtctctacaaaaaatacaaaacttagccaggcatggtggtgtgtgcctgtggtcccagctacgtgggaggctgaggtgggagaatc

SEQ ID NO: 224107 - DNA, 260 bp, Homo sapiens
catcttcagtgagggagctctgagtgaaggaagatctgggagttggctgtcttgtggaaggtcagcgtgatgacgtctctagacttaatcatgctgaatcctgtcccttgaatttgaaaggctatacaataattttgtcctgcttatcagagccataaaaccacattaaggtatagatagagggcacagctctttcacacatgtgtattgctaatggttctgaatctagtttttaaataaagcttgtcattttctgggtg

SEQ ID NO: 224108 - DNA, 259 bp, Homo sapiens
acccccacccccaccccaaataagggctcttcaaggggcagttgccagctccagagccagctgcttgacacctattgtccccgtttgggcgtcaaacgatttcgcctgaaggaccctagcgtcgattgctctcaaaactcaaggggcctttccttcggccttgccggggccatccccacctgcgtccaggaggcgccccacagcgccggggccgggggacggcggagaagctagcgggcggcctcttccgggcaggcgt

SEQ ID NO: 224109 - DNA, 561 bp, Homo sapiens
gacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggtaagtaaatagcttctattaaccttgcattgatgttgttgaagcaaactaaggaacaaagaacaactgaatgtggacttttacaggtttggatatttaaaagatcttacaggaaagttatgtgaagaggttgtcagagctgaaggatatttttgaagatcgagctatttacataaaaaatagatgaaattcaaaacttgtataaacaaataaaagttattcctattgtaaaata

SEQ ID NO: 224110 - DNA, 475 bp, Homo sapiens
gacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggtttggatatttaaaagatcttacaggaaagttatgtgaagaggttgtcagagctgaaggatatttttgaagatcgagctatttacataaaaaatagatgaaattcaaaacttgtataaacaaataaaagttattcctattgtaaaata

SEQ ID NO: 224111 - DNA, 677 bp, Homo sapiens
taaccagagacaccaatcaaccaaaggcaaagcgtaagccttgattggattttggtttaggaaaaatctcataggtataaaagacaactgggaatgttgaatgtggatctggtggtaggtgatattgttagtgatgtgagtgatgcctgctgaagtactgagagatgaagcatcatattgacaacttactccaggaaaaaaggtgtgtgtataggtgtgtgttcggagagtgtgagcgagaactaacatggtaaaatgttaggtggagcatatacagttctcattatactcttattttaaatttatatttgaacacagtcaaatctgaatggaaatacatttaaataagcatttctttcagtcatataagtaatttgcctaaaaatgccctctaagtccatcattaggttaagcgatttactgaaggtgcagatatcatgcttatttcattgggttgttttggaatgtcccccacttggagagtttgaggaatggaaatgagaatcggaggagaaataaggccagaggctcacattgcttgcagggaaccgactgagtaatgaagaagaggaaggaagcccttggaaggaacgtaaaatccatttcagcctgccgccccttggaatggagggtcttctagggaccagaaacaccagacacttcttctgccccaagca

SEQ ID NO: 224112 - DNA, 483 bp, Homo sapiens
tattgagagcagtaataggtgttgctcaatattgtaacacattggtaactatgtgtgtatctaaacatttctatattatacaaccattatacacaaacatattatagatatgtttagatattacatgctgtaaaggtttgcagcctaggagcaataagctatatcatatggcctaagtgtgtaaaagactgtgtcacctgggtttgtgtaagtacacactgctgttctcacaatgcagacatcgcctaatgacacgtttctcagaacgtatcatggtcattaagcgaagcatggccctatgtgttctaaaacaactactgctcactgttacactgcattgtctcattactgaaaactttctttaagacaaaaatcttctactatatcaatttttgttggtgttgtaagtctacttgtaggtagatgggacaaatagttagcagggcaattgtcgacgcggccgcgaatttagtagtagtaggc

SEQ ID NO: 224113 - DNA, 791 bp, Homo sapiens
ggctagtttctaagtcctctatttgtgtactggatttttcccccttttacctacttgataacttccctcttacaatcattgcatcatcgattttcccctctgctgtattatttccatcaggatataggcaatccatactatttcatgaccacaaaatactctcccatgacatcatatttccctctacattttagaaggtggtaatttacagggagtcacgtgacctagctctgccaccatctcaccaatgaccttgagtttgcacctttgagtgcctttgtacatctcagttttctcatgttaaaatgaagagatgatactagttatcttggaggtctatgacatattgcttcacaatgtgcatatgcggcaacagacacagcccatctagcctgtgttaggaagatgccaagctaagcaccatagggagtggaggaatggataaggcatgcagttttctgcctgtggaaacatagggggacccaagacaggaacacaagcgactcttctgcaaggttaaggataagggcctaaaaatagggattaagttcagagcagagcagcagaggcagatcaatgaggttagaagaactgggcaaagctttatggaaggtagtgcttataatgggactttaaggatactcaaaggaacagtataaattcaaagagatgaagcagctttgggttaaattcagttttcttttgaggtaaaataaaggaaagtagagggggagggcaagatggccaactagacacagacaggtggaatcatttccaccaagggactgaga

SEQ ID NO: 224114 - DNA, 231 bp, Homo sapiens
agactgattttaaagtttttccaacagcacatactcatatcatgtatacacacaaatacacagaatttgaaatttaaaaaaaagcaaagtcttgatatgaagaataaagaaagacaaagcaggcatttgacaacccattttcagatgtttgaaggattgtcagtggagaagcagcaagctgatcttttatgacaagaaggctgaacctcctgaagctaaaacaaaagccaa

SEQ ID NO: 224115 - DNA, 457 bp, Homo sapiens
gttatattagtaaatgcttagatttatacaattattataactttctggtgaactaaatatttatcattatgtaggaaacatttttctttctaatggtgttttacgtcttatagtctgttttgtctgatattaatatacctacaccagaattgttttagttagtatttgtttaaatatacattttatttacttttaaattctctgtcattatattttagagctgtctctcataaactgtacataactagagaactactctctctgaccatctttgtctattatctattaattggaatgtttagtccatttacatttgttgtaatgtatttatatttatgattttaatttgtggggttttttaaatctttttttcccccttctttaagtttcatcgaaggcttttgtgtgtgtgtgtatgtgtgtgtgcacgtgtgtgtgtttgagacagggtctcact

SEQ ID NO: 224116 - DNA, 207 bp, Homo sapiens
cctattaggtaggtgcaaaagtaattgcggttttggcaaaaaccgcagttacttccacaccagtctaatattaaatggaactagagtcaaatagaatttagcgattgccagttctgttccacagatttcaaagtacactaaggaaaatttcagcaaattgtgtatggctgttttacttgggggagagtaaaacagccataataaact

SEQ ID NO: 224117 - DNA, 401 bp, Homo sapiens
attccacgatgtactggaagttcttgccagagcaattagacaagaaaaagaaatgaagggcatccaaattggagaggaagaagtaaaactcaattcgcagatgaaaactcccatatatagaaaatcccaaagaatctataagaaagccactagcactaataaatgaattcatcaaagttcaagggtacaagatcaacacacaaaaatcaattgtggttctatatatctgcaaggaacaatctgcaaatgaaatttagaaaataattgtacttaataataccatctaaaagaataaaatacctagaaacaaattttacccaaaagatgactttaaccaagaagatgaaaacttacacagtgaaaaattttaaaaatggctaaaagaaattaaagaagaccta

SEQ ID NO: 224118 - DNA, 511 bp, Homo sapiens
tgtgacaaatggattaatctggtaaagacaggtgctgttttaggtataaagtttagcattgatccctaagtttacttctggaatagctgctcatctggagtcatcacttgcaggccatttctggtggacccaccagctgcaagatacagatttattatttgacctgttttcctccagtgcaaggatactgtgactgttaagcagcatgcattaaataactaactcatctgttaataagtgtgcacatagactttggccagaacacattagacccctgaacagagaatcttaaaatactaatgcatttattttaggtggcaaagaactagattagtcaactaaaagcacatgaaaactgtcaactccagttttacaatctacatgccatgtcgatacacaacttgtgataatgtgaatggcatttttagcagagaattgtagtatttaaagacaaaagttcatgagtgttctgaaataatggtactttttctcaacctctcgctacatggga

SEQ ID NO: 224119 - DNA, 671 bp, Homo sapiens
tggtatttggataagacttttggggaatcaaattctacccagcaaatacttaagtgatgatttgacctgttggtggtctttccagttggcacagacacattcagagagcttgattagaaaaaaagccctttcgactgagtgcggttgctcacgcctgtaatcccagcactttggaaggctgagttgggcagatcggttgaacctgggaggccaaggctgcagtgagctgagatcaagccactgtactccagcctgggtgtcagagagaccctatctcaaagagaaaaaataaaacacaaaaaagaaaatagtcctttatacagtagagaggttcttgaaagttgctcatagagtaagatgtttattgagtatgagtactgttaataatatagagggttcattgtctttccttgttaatcttagatatgagatacttcaggtttaaacttctgtttaattcttttccactctctgttactgagtatatataaatttaaatgcaccaaaggaactgtttcttaaagaatatttcgagtaaattattgtatatttaaatattgtatatttacaataattaatttacttatatttatagtaattaatttactcaaagggaataatgtccttccctttattgggatcaaggactcccaatgtattataaacataat

SEQ ID NO: 224120 - DNA, 522 bp, Homo sapiens
ggattacaggtgtgagttgccatgcctggcccggttatctttctaaagcataaagcaaccctgttgatcctctgcttaattttgatgattaagtagtatgttcaaaatatagaaatccatgtattgataatgatcttttaaaaaaagtaaaagccaaaatatcagctactcatcctacaccattgaaagtagtgaccattaaactgctctacctctacctccacctctctacctctctacctctctacctctacctctacccacggtctccctctctttccatggtctccctctcatgtggagccgaagctggactgtactgctgccatctcggctcactgcaacctccctgcctgattctcctgcctcagcctgccgagtgcctgcgattgcaggcacgcgctgccacgcctgactggttttggtggagacggggtttcgctgtgttggccgggccggtctccagcccctaaccgcgagtgatccgccagcctcggcctcccgaggtgccgggattgcaga

SEQ ID NO: 224121 - DNA, 414 bp, Homo sapiens
tctgatcttgactcactgctacctctgcctcctgggttcaagtgattctcctgcctcagcctcccgagtagctgtgattacaggtgcctaccaccacgcccagctaatttttcttttttgtatttttaggagagatgggatttcaccatgttggccaggctggtctcaaactcctggcctcaggtaatccgcccgtctcggcctctaaaagtggttggattacaggcatgagccaccgtgcccagccaatctgatggttttaaaaatgggaatttccctgcacagggtctctttatttgcctgctgccatccacataaaatgtgacttgctcctctttgtcttgccccatgattgtgaggcctccctagccatgtggaactgcaagtgcattaaacctctttcttttgtaaatt

SEQ ID NO: 224122 - DNA, 571 bp, Homo sapiens
ttcggcacgagtcaacatttagctctaaccacatttttcttcccaagctcgtaatcatcccaagggactggcattgttttacaactcttctttttaaaaagcttccagagttcattgttttctttctccaaggcaatgtgttgacaccctagtgttgacctcttgagcagctttctaattttgttcagtgtttaaaaccaaatattatctctgatgatgctatgtcaggaaactcagcagcaaactcagtgtcatggagagttactaatagtttaaaagcaaatgggagtctgggagtggtggctcatacctgtaatcccagcactttcggaggctgaggcaggcagatcccttgaggtcaggagtccaagactagcctgaccgacatggtgaaaccctgtctccactaaaaatacaaaaattagctgggcactgtggtacgcgcctgtaatcccagcaactcgggaggctgaggcatgagaatcacttgaacccggtgggtggagattgcagtgagccgagattgtgcctctgcactccagcctgggtgacagagtgagactttgcttta

SEQ ID NO: 224123 - DNA, 351 bp, Homo sapiens
actattttaaatattaatatggcatatagtatgattccatgtatataaagttccaaaccaggaaaaactatagcattgaaggctgcatacttaggagaaaagtaaaaagaaaagcaaatgttcattgtaaatgtcaggagagtagtttaagagagacttgggaaggagcctgtgcgacagcaatgttcaacgttttgacctcagtggtggtaacaaagggtgtccactttacagtcattcgttaagctgtatttgtatgatttaagcacttttctatatttgtcgtacatttcacaataaatgatgttgaaagagaaactgaacttaaaaaataaaactatatttgactaa

SEQ ID NO: 224124 - DNA, 387 bp, Homo sapiens
caagaactctataaatcactaataaatagaggtttaagaatggcttgggtaaactggtgggttagtaagtccataataagttatgcagctaggcggggtgcagtggctcacgcctgtaattccaacactttgggagaccaaggtgggcagatcacttaagatcaggagttcaagaccagcttggccaacacagtgaaaccccatctctactaaaaaatacaaaacaaaaactagctggacatggtggcacgcacctgtaattccagctatttgggaggctaaggcaggagaatggcttgaacccaggaggtagaggttgcagtgagctgagattgcgccactgcactccagcctgagcgacagagagacactctgtctcaaaaaaaa

SEQ ID NO: 224125 - DNA, 1596 bp, Homo sapiens
  misc_feature (671)..(671): n is a, c, g, or t
  misc_feature (1083)..(1083): n is a, c, g, or t
  misc_feature (1132)..(1132): n is a, c, g, or t
  misc_feature (1284)..(1284): n is a, c, g, or t
  misc_feature (1495)..(1495): n is a, c, g, or t
tatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatcactttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctnttaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatnatgcttattaaattgcgataaagaaaaaaataggttaatgggactcagnaattagtgaaacatacagaataatagacattgagtcattgttactttcttaacccacccccaaactgggagaccccgtgccaggctggtaggaacatgggctttggagtgagacttaggttaaaatgccaactttaccactctttagcagtntgactgtaagttagttctttaacttccatgagccacaattttttcatctgtaaaaagaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagagnaaataaatgataaaatctctaaatgttggtgctgttaataagttgtctagagcaaatttatacagtgagtttttttttaagacacaggaaaacaataaaaa

SEQ ID NO: 224126 - DNA, 411 bp, Homo sapiens
tctaaagaaaaatttgtaataatgagtgataaacaatgttagtgggctgaggggatatcatagcagaaagctgtgcggtaatcttaggcagggtcctaaaatgccctagggtaggttacattattgttcacaaatatttgctgcccctgcctggggaagacatacatcccagccccactgacagcccgcttggctctctgacttgctttggccaatgcagtacgtgtcccttccaggcggaagctttaagagccaggggcacatggtttgccatatgctttttgtccctttgcaataatagcacagcaatattctagatccaacttgtccaacctgcggctggctggccacctgtgaccagctttgaatgcagcccaacacaaattcataaactttcttaacacattatga

SEQ ID NO: 224127 - DNA, 1168 bp, Homo sapiens
gctgggagcttgccttccctccccaccaccctccgccctggcagctcctccctcctctactcccgggcaacagcagaatctggggacgtagtgggttcaagtcccaagctcgtgaggactttctgtccttgtgcttgtcgcttcatccccaggagtcggaggctcctcttttgtaaaatagggccaatggggggggggggtgctattaaattttaaaacatggaggaaactcctagtgaaatgtctgtcccagaatagatgctttgaaaaggggagctgctggaattggtcaaaaccggcgggctgtgtttgagcccagtttggttgcctcctggttcaagcacttgccagtcttacgcacaggccttgctcagatgtgtcggaatgggagcaccagggctggtggtgccctggatgttcctttcctagggaatctttgcgaaggtatgttttagactcccccaagaaccgcccagtccctgttcagttcaggtgccacactggggcagaggtagagaaaagaaaattctggaaagtggcttaattgtggaggttgggagtaggtaggacctgtgccctaggaaagggcagtgcctggcctgcaggggccttctggcacgttctcactcctcgccgttgctcttcttctatcttcaaagcagaagagattttgaagtccgaaagacctggtttggctctgctactctctgtgccacttgggcaagttgagtcatccctgtgtttcagtctcctcatctgtagaatggaggaaatactacctgcctcaaaaatggttttgtgggccgggcgtcgtggctcacacttgtaatcccagcactttggtaagctgaggccggtggatcacctgaggttgggagttcaagaccaccctggccaacatggtgaaaccctgtctctactaaaaatacaaaaattagctgggcatgatggtgcgtgcctgtaatcccagctactcaggaggctgaggcaggagaatcgcttgaacctaggaggtggaggttgcagtgagccgagatagtgccattgcactccagcctgggtgacaagagcaaaactccatctcaaaaagaaaaaaaaagtggttttgtgaggatagcgaaggacccagggcagaagctttgagtcaaatctaatctgcagagattca

SEQ ID NO: 224128 - DNA, 711 bp, Homo sapiens
aagtaggtttaggaggttgtggcagagaaaaatcaaaagcatggtgttttagaaacctttcatttttcttcatgtcccataaaatgttcatatccttaagacgcaaaagagaatctggctttctgtactttaagtcactgtcaatttgtagcatttattagataacaggaagggctgtaagagctgtgttcataggcttctattcaaaacatcagaaaatatcagggtgacatgtgacatgacgttggtctgggtgtatacacatacatatgttcactgagctgcacatttaaaatctgtgtacctcactgtatacagtctatacctcaatcagaaaaataaaagatactggctatatattaaaggaggaatcctggctacatcaatcaactttgtatcttggatgccaattatactccctttttctcctaacaataaaaaatgaaaatctaccagacttcatcatacaatgggatcagaatgatggctttcctcaagacacacatggactggaaaagcttctcaaggtgattctatctggaacagtgggagaaagggcacaaagaccattctttgacctggcagcaccatttatttcatggaacagcaaatggtgtcatactttcaaatctgatttccagaaaaaagaagaaaaaaagcaaactaaaagtaactattcaagaaaattaccaaataaaagttaaaaataac

SEQ ID NO: 224129 - DNA, 655 bp, Homo sapiens
aaaatgtaaggacatgtaaatttattcttttaatgtcatttatcctggttgaggcaaatgcccatagtctaatcccgtggtggctagtgtttcttttttttaatcatatactacaaaaacaatttttaggatacaccagaatatatgtatatgtactttttttttttttttttttttttttaagaaacagggcctcactttgttgccaaggctggtctccaattgctgggattacagatgtaagccactgtgcccagccaaaaataaatataaataaataaaaggaaatataaaaaaagatataagtataaaatataagataaaatgtaattggatatacagaaccctttttgaagaccacagatctcattaataactcattaacatttttttggaatgaaattagtgaattttgcaatcttaaggataaatgtccagtttattttctaatatcaccagtatgatattggacttaatttcttaccgaaaatgatctagaaaaccttttatacatagtaacactaattgttccatacagtttgtgaatcagaattatgactggaggccaggcaccatggctcacgcctgtaatcccagcactttgggaggctggggcgggcaaatcacttgagctcaggagtttgagaccagcctg

SEQ ID NO: 224130 - DNA, 713 bp, Homo sapiens
aaaatgtaaggacatgtaaatttattcttttaatgtcatttatcctggttgaggcaaatgcccatagtctaatcccgtggtggctagtgtttcttttttttaatcatatactacaaaaacaatttttaggatacaccagaatatatgtatatgtactttttttttttttttttttttttttaagaaacagggcctcactttgttgccaaggctggtctccaattgctgggattacagatgtaagccactgtgcccagccaaaaataaatataaataaataaaaggaaatataaaaaaagatataagtataaaatataagataaaatgtaattggatatacagaaccctttttgaagaccacagatctcattaataactcattaacatttttttggaatgaaattagtgaattttgcaatcttaaggataaatgtccagtttattttctaatatcaccagtatgatattggacttaatttcttaccgaaaatgatctagaaaaccttttatacatagtaacagtggaaaaaacttgagtcgacaatggatgcaatagttcatttatagtacatatacaacctaattgttccatacagtttgtgaatcagaattatgactggaggccaggcaccatggctcacgcctgtaatcccagcactttgggaggctggggcgggcaaatcacttgagctcaggagtttgagaccagcctg

SEQ ID NO: 224131 - DNA, 621 bp, Homo sapiens
agaaaacagcccatttactgctgggccagcactggttgttttgaaggccaaatttctcataccttttataatagcattgcccaacagaactttctgcagtgataaatgttttatatctgttctgtccaacgtagcagccaccaatcacatgtgcttattgagcatgtaaatgtggccatttagactaagaaaccgtatttttgtttttgtcttaaattaatggagccacacatggccagtggctactaaggagtgccttacttcacttaaatcagaataggaaatggaaggtcaagatctcataaggacactgaggttagaagtatgaagtcacctgctagtaagttagtaagttcctaactagtggtccttccacaaggacttattcacaacaatattattgcctttccaccaactgaaaaaagttctcaaactcgtttctgtacaatatgcctaatgaacattttaactttctaatcaagcatgaaataccattaattatgtccttctgcttatagttccacctttagttttggcacgctaaaatctagctgcccttattttgaacagtgttgagtataaggaaggaaaaataaagcttctagagcttgatgaagcgca

SEQ ID NO: 224132 - DNA, 254 bp, Homo sapiens
ctttggtccttttgttacttaggtgtgacaagttggggttttccttttgatttagttctaggaagtcagcgtgaatcagccttaggtgtcctgccttccgaccctattctcctgcttcagctcagaccaattgaacagggaattccgggatccctggtacctggaaggctgtcagggtttaggagaaggtcagtgcgagctcagtgtgggcacagggctctcagactccttgatgcatgaggaggagcacacac

SEQ ID NO: 224133 - DNA, 436 bp, Homo sapiens
ggagtttcaggcttcagtgagctataatgacactactgcacttcagtcctgcatgacacagcaagattctgtctccaaaaaaaaggaaaagaaaaaacaacttatacgatttattcattcaagggagaagtagcctgggtaagtattttagatttttcagtacaggtataaacaatacagaaccaccacaagttttgcgtaggaacaaaatggcaagttgattcccactcagaaatgactaccttcttctccacattcgatctcaaatgtcacttcatcgaaaattttctccatttgtttcttttgtttccatcaggaaacaagagctctcgtataaaaaataaataaataaaataaaaattttcagccaggcgcagtggctcacacctgtaatcccagcactttggaaggccaaggtgagcaggacattaaggca

SEQ ID NO: 224134 - DNA, 592 bp, Homo sapiens
agaaggagccagcatggacaatctcctttacagtttcggaagcaggtttgttgccatggagttcacattttgacgggagttgagaagtataaaggtaaccatttgttttagtttcaacgatctgacaaaaagataggctgttgctcttcttctggaaaagcctgattggtaagattcctttaagggctcagccccaaagagctttatcccatcccctcgcagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaacgaaaagaacaaaaa

SEQ ID NO: 224135 - DNA, 3683 bp, Homo sapiens
agaaggagccagcatggacaatctcctttacagtttcggaagcaggtttgttgccatggagttcacattttgacgggagttgagaagtataaaggtaaccatttgttttagtttcaacgatctgacaaaaagataggctgttgctcttcttctggaaaagcctgattggtaagattcctttaagggctcagccccaaagagctttatcccatcccctcgcagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaacgaaaagaacaaaaagtacgtatgcgcacctccctggatctttgtcaatgcctactcctctctaaagtgttctcagaagtggtgatgcaggtgcagattctagaaagcatgaggtgctcaggaactattcagggcaaatttcattcatctccacctgctaaaccccattacccatgggcttatggacctgtttttacaaacatctcatgggcaactactatttgccacataccaaactaaggcttttcccataccttgtaatatttaatttttgtaacaaccccatgatatagatattaaactataattttgaagataaaaacatcaaaatataaaagcaagtgctcctgggtgggactgtactttggtcttctagttgtaagttgggtattatttatgctctatcctgaaaaggaaagtgcatttgagtgaactgggacttttttatttcatctaaatctgatttctcacctttgacactattaatattttgaaccaattttttgggcattgtaagaattttaacagcatctgaaaaatatagcattaaaccactaaagctaaggaccctgatgaagtcactgcaccctccactacctctactggaacaggcactggtatccactgctgagagacccatagacggttcacatcacaggactctgtggagacaatccccagtaccaacttggagccgggtagactcggtgggtggcgagacccagaagagagacaacaatcactgcagtcagctcacaggaagccacatccataggaaaagggggagagtaatacatcaagggaacaccccaagggacaaaagaatctgaacaacagtcttcagccctagactttcccaaatgagaaggaaccagaaaaccaaccttggtaatatgacaaaacaaggctcttcaacaccccccaaaatataatactagttcaccggcaatggatccaaaccaagaagaaatccctgatttacctgaaaaagaattcaggaggttattaagctaatcagggagaggccagagaaaggcaaagcccaatgcaagaaaatccaaaaaatgttacaagaagtgaagagagaaatattcaaggaaatagatggcttaaagtaaaaacaatcaaaaattcaagaaactttggacacacttttagaaatgcaaaatgctctggaaagtctcagcaatagaattgaactagtagaagaaaaaaattcagagcttaaagacaaggtcttcgaattaacccaattcaacaaagacaaagaaaaattaataagaaaatatgaacaaagcctccaagaagtctgggattatgttaaacaaccaaacctaagaataatcaatgttcctgaggaagaagagaattctaaaagcctggaaaacatatttgggggaataattgaggaaaacttccctggccttgctagagacctagacatccaaatacaagaagcacaaagatcacccaggaaattcatcaccaaaagatcttcacctaggtacactgtcatcaggttatccaaaggaaaccattttaagagctgtgagacagaagcaccaggtaacttacaaaggaaaaatctatcagattaacagcagatttctcagcagaaaccctacaagctaagacagaattggggccctatcttcagccccctcaaacaaaacaattatcagccaagaattttgtatacagcgaaactaagcatcatatttgaaggaaagatacagtcatcttcagacaaacaaatgccaagataattcacaccaagccaccactacaagaactgataaaaggagctctaaatattgaaacaaatcctggaaaacagagcttctttaaagcataaatcacgtgggacctattaaaaaacacacacacacaagttaaaaagcaaaaacaaaaaagaaaaaacccaaagtacacagacaacaatgagcatgacgaatgtaatgatacctcacatttcaatactaacattgaatgtaaatggcctaaatgatccacttaaaagatacagaaccacagaatgggtaagaactcaccaaccaactatctgctgccttcaggagactcacttaacacataaggactcacataaagtaaacgggtggaaagaggcatttcatgcaaatagacaccaaaagatagcaggggtagctattctaatatcagacaactgtaaagcaacagtggttaaaaggaacaaagagggacattatgtaatggtaaaaggccttgtccaacaggaaaatatcacaatcctaaacatatatgcacctaacactggagatcctaaatttataaaacgattactaacagacctaagaaatgagacagacagcaacacgataatagtgagggacttcagtactccactgacagcactagacaggtcatcaagagagaaagtcaacaaagaaacaatggatttaaactataccttggaacaaatggacttaacagatatatacagaacatttcatccaacaaccgcagaatacacattctattcaacagcacatggaactttctccaagatagaccatatgacaggccataaaatgagactcaataaatttaggaaaattgaaataatatcaagcactctctcaggccacagtggaataaaactggaaatcaactccaaaaggaaccttcgaaaccatgcaaatacatggaaattaaataacctgctcctgaatgagcactgggtcaaaaatgaaatcaacatggaaattaaaatgttctttgaagtgactgacaataatgacataacttatcaaaacctaaggcagtgctaagagaaagttcatagccctaaactcctacatcagaatgtctgaaagagcacaaatagacactctaaggccacacctcaaggaactagagaaacttgaacaaaccaaacgcaaacccacagaggggcctgactgttagaaggaaaactaacaaaacagaaaggaatagcgtcaacatcaacaaaaaggacgtccacacaaaaaccccattcgaaggtcaccaacatagaagaccaaaggtcgataaatccatgaggatgaggaaaaaccagcacaaaaaaaggctgaaaaccagaatg

SEQ ID NO: 224136 - DNA, 998 bp, Homo sapiens
agaaggagccagcatggacaatctcctttacagtttcggaagcaggtttgttgccatggagttcacattttgacgggagttgagaagtataaaggtaaccatttgttttagtttcaacgatctgacaaaaagataggctgttgctcttcttctggaaaagcctgattggtaagattcctttaagggctcagccccaaagagctttatcccatcccctcgcagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaacgaaaagaacaaaaagattttgtgccactgtatcaagactttgaaaatttttatacaagaaacctttacatgcgaatcagagacaactggaaccggcccatctgcagtgccccagggcctctgtttgatgtgatggagagggtatcagacgactataactggacgtttaggtttactggaagagtcatcaaagatgtcatcaacatgggctcctataacttccttggtcttgcagccaagtatgatgagtctatgaggacaataaaggatgttttagaggtgtatggcacaggcgtggccagcaccaggcatgaaatgggcaccttggataagcacaaggagttggaggaccttgtggctaagttcctgaatgtggaagcagctatggtctttgggatgggattcgcaactaactcaatga

SEQ ID NO: 224137 - DNA, 201 bp, Homo sapiens
agtttggttattacacttaaaaaatgaagtattgaggttctgagtggttttattattttaagttgggacgctgactgtcttatgaattctgtaaagaaagttggccagcatcgccttcatcatttttttttcagagttctacctaaactttaggtaatctgaccaaatatttcataacataaagtattatctttatcaaaa

SEQ ID NO: 224138 - DNA, 831 bp, Homo sapiens
actctcctccagccctgctcatctttaggtgaggaggagagaacctgtagatagactttcttaaaaaggagaatgctgacaaaatgatatgagaattcaggggttggagaggttatttgtaactgagggcatggagagacttcagtaagaaactgagctttgaaggttgggcagtgtttcaaggcacaagaggaggctgagcagcactggtgagcatgggcaaatacctggagcacactaagaggaataatgcaaatgtgctttgaggacagaagatggaaggacttgaaaactttaccagcctgggatgtctggacttgttttggtaggaatggaaagcattagaaagctttgagcagggaggcacatgaccttaggaagatgaatataaagacgtataaaactcctttggtttgctcatagaacttaataggttcttatattgcaccctattttaactaatcaggttttctgatctaaagtggtttagaagcagggatcgagaaacctgaaaggcagcagctttgactgccggaagaaatgactgcttaccagagagaaaaagacagaaaaatgcttttagaatataagaatccagaactgtaaaagatagagcccagtcaatattgaggaaatcggtataacacaagttctttgcctccatagcccctgaagacagtaattaataactctgagtcagtgtgctttgcttgaagaaggtggtaatctagtctagaaatatccccaaagtttaaataaaatacaattttgcccttgtgaaggttttcattatctagataatatatttagatatgaagcttcattcttctt

SEQ ID NO: 224139 - DNA, 317 bp, Homo sapiens
gcatattgaggacttgggatcagtcaaactcaatgcaacagcaaatcttcactgaaggtgccagcctatgggtggactcgtgatctagacctaaagggttagtgtgagttcctagaggaaaagaaagccatgaggcagattgtggaaggctttgaaggccaggtggagggccttgaactttattccatagacaatggggagctattgaaggtttctgtgcaggggtggagtgatctgtgtggagcagtgtttagaaagaatgatcaaggccaggcacggtggctcacgcctgtaatcccaggactttcggaggccaa

SEQ ID NO: 224140 - DNA, 440 bp, Homo sapiens
cctgtaaaactgtgctataggatcccttgtagaattcctttttgatgaaaataggattctttcactaagggatacgtgagaattaaagtttaaattggattactggggctttaaaaaaattgtaaaaatatctgtagcaaagttaatcattttaactctttttttaagtgtacagttcagtgggggcattcttaaagtcatgaaaatgatatgttgttgcttaatgcttttggatcttagcttttagaataatgtaaggattgaggagtttacttatttgtttatgtcatggcattattgaattcctgaaagcgtatgagtatttactgtgtggcaggaattaaattagtagatgttaggaatacaaagatgaataagaaccagcctctgcactcatcttgtttagtagggataaagtagtgtgtaaaatatggaatcca

SEQ ID NO: 224141 - DNA, 718 bp, Homo sapiens
caaactagaataccacaatagaaagatatcagaaaagtctccaaacacttgaaaatcaagcaccctatgtctaaataatttacatgtcaaagagaaagaggttagggaaaggggagatgagaggatggtgggttggttataaaagggcaacagaagggttctctgtggtattggaactgttcggtatcttgactgtgatggtggatacaggaacctacaaaggtgacaaaattgtttaatatttaatacacacacacaagtacacatgcaatgagtacaagtaaaaccagaaaaatctacataatatcaatgggttttattaatgtcaatatcatggttgtaaaattatactatgttttggagaatattatcactggggggaatctgggcaaagtatataagggctatatctctctgtattatttcttaaccactgcatgtaaatctgtgggatatagctaaagcactgcttaggggagatttatagcaataaaaagctcatcctttaacccaagttgccactaatttttgctcagaaagctctgactgcaaaactatgaaaatattagctgtattagtcgtattctagacaaatagatcatagatttaaatgtgaaatgtaaaatgatacaacttttagaagaaaacaggtgaaacttttggtgatctagggttaggtgaccagttagacatgacatcaaaagcatgagtcataaaa

SEQ ID NO: 224142 - DNA, 492 bp, Homo sapiens
agagaaaccattctaggtatatgagattctgggcccagatcacataatactattattaatattttcttaattttagaaataacgaatataaaattcctgaaagttagtaggcgttcactgaagagcaactattattattgaagaaagtctataacacattctccatcctccatcccaccttttctagacttctagcacttgattattgatagtcacatactattttgtttctctttcatatatctacatttcactcctctaaccagattataaatgcctcaaaatagaaaccgcgtcattgtctttgtttaaaaccaccctacatcacagtgtctactcaatactgatgaacagagtaagttctcaagaaacatttgatagaaattaaatagaatgttgtctgttcaaattgtattatatcttttcttaaaattttgttttgcatatattccatgtgtgatgttgacaatagtcccataatatatattgtac

SEQ ID NO: 224143 - DNA, 745 bp, Homo sapiens
aagaaaaaattgaaaagtacagtctaactccaatttggaacttgttcatgctatctgagctttacagaaatcctggtcagtagactggactgacacaataaaactataggaagttgcaaataagtttgcatatttttgaaatgagtgacctcatccctcccaaagctaacatttagtacacgtgtccccttaggtggccagcctttgctgtaactgagtcatgcttcagggtttattaaaacgctaacttgaattatgcctgattttagaaacgtattgattttcatagttgttatatctggtttattctcggttaaccctacaaaaatttgagtgtcttcttcgttcacattacaaagaaacagaagtcccccaattcctgctctgaaggagcttacaacctggtcgaggaaataaatccatggaaacttgacgagaaaaaaatgtaaaaaaatttagaataacaggtcaggcgctgtggctcatgccagcactttgggaggccaaggcaggtggattgcttgatcacaggagtttgaaaccaacctgggcaacacggtgaaacaccatctctacaaaaaataccaaaaagtgagcgggcatggtggcacatgcctgtggtcccagctacttggaaggctgaagtgggaagatctcttgagcccaagaggtcaaggctgcagtgagccatgatcgcaccactgcaccccagcctgggcaacaaagtgagatgctgtcccaaaaa

SEQ ID NO: 224144 - DNA, 959 bp, Homo sapiens
ttacagatgcccaccacgacacccggctagtttttgtatttttattagagacggggtttcaccatgttgttagccaggctagtctcgaactcctgacctcaagcgatccgcctgccttcatctcccaaagtgctgggattacaggtgttagccaccgcgcccagccccggaaagtttaattaactgatcagagtgacactaccagccaggcagaaaggggacaagactccaggtctgtgactctcaggacagtgctccttccacagggatccagattgcctcatcccacaaacatgtttgctgagcaccagctatttgctgggccagtgaattcggatcattcctggccttcatggagctaggcagtctgaaggggaagactgacttaggggaaatttgattataaagtgtcacaggtgtgggacagacagacagatgtggggccttggaagcattgaggaggggaggtggtgttacagctggttctagaagatgagtgggtaagagctaagataggaactttgttccagccagaggacaaagaaccctgggaggtgagagcaagtgcaagcaggaacattcaggcctgatcttgatggcccagcctgagagaaagcaggagagagggcagggtgggatcggagagagggcagggtgggatcagagaggccttgagtgccactccaccctgaggcgccctttgcctttaattatgctggttcccactggcatttgcgggaaggactcagagcttcagaatagcgtaccatcaccacagttagggaaggttcttcccatccttgtctcctgagctgcataaactgtgtcacactgggtcttagaataaaaattccatgagggcaggaattttaggctgttaaaccagttcttggcacatagtagacattcagtaaatatttgcaagatgaataaaaggcagtattttcccaagatatcat

SEQ ID NO: 224145 - DNA, 220 bp, Homo sapiens
aaaaaataaagaaaaaaagagccagatatggtggtgtgctacttgtagtcccagctacttgagaggctgaggtggaaaaatcgcttgagcccagtggttggaggctgcagtgagctgtgatcccaccactgcactccagtctggatgacagagcaagagcccatcactaaggaaaaaaaaagtatttttctcaaagaccgaggctaaaagattagaaaaa

SEQ ID NO: 224146 - DNA, 644 bp, Homo sapiens
ctcaaataagtgcactcagcaaattttgtcttaaaaatgtggacatattcttactttcccagtcactagcatggggggaaagaaagcacctttgcttggtagatgtgatacttggcctgatgcaggaaggagacaagcccatggactgttccagacgggatcagtggagaggagcggggaactgaaagagaggtgctgccaaggaagggaggagtggggcatggaagactccctcaccctgtgaagtggactttctgtttcattccacaaactcaagcaagacctaaggaaatcatgacatgctgagtatggctgtgttttcgtgtgtgtgtggaaggaagctggtgtacagccacagcctgcgcatgaattgacggaggacaagacacaataagaaggatggatgagggcactgctgacctccggccgggcctagccacaatgtcagtccctgctctcagggaggccctatcttgaagaagacaggctactgacttgatggtgtccccacccacaggctgctttggtggctttgaggctgggtgatcttcatggagatctctattaattatgtcttgaccttgcaaggagagaagaaaaggccctttcccccttgccctgagtttctcttctaagggtctggc

SEQ ID NO: 224147 - DNA, 296 bp, Homo sapiens
gaatccagccattccagaaagcacccccagcacattaaagaattccaaatgcttacttttctggtgcagaaagattttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 224148 - DNA, 338 bp, Homo sapiens
tttctttgcactctgcccctgcagaaggtttggtattgttattgttgttgctgttctttttcttagaaggcctcactccatactccatctcataaataaataaataaataaataaataaataaataaatgggatttcgagaccaggctgtccaacatgatgaccatgtttgtattaacttagctgggcgtcgtggcacatgcctgtgatcccagctacttgggaggccgaggcaggagaatcacttgaacccgggaggcagaggttgcagtgagccgagatcatgccattgtactctagcctgggtgacaagagcgaaactctgtctcaaaaataatt

SEQ ID NO: 224149 - DNA, 450 bp, Homo sapiens
ttctttttcttggggaaatgccaacaagcagaagggttgggtcacatggtagtgaagtatgatttgcttcttaagcagctgcaatcaattttccaaaatgattgtatcatcatacattcccgccagccgagtttgaaagtcccagtgcctccacatcttggtaagttattattattattattgagacggcgtttccctcttgttgcgcaggctggagtacaatggcgcgatctcagctcatcgccacctctgcctcccaggttcaaattattctcctgcctcagcctcccgagtagctgggattacaggaatgctccaccatgcccagctaattttctattttcagtagagacagggtttctccatgttgatcaggctggtctcgaactcctgacctcaggtgatccacccgcctcagcctcccaaagtgctgggattacaggcatgagc

SEQ ID NO: 224150 - DNA, 343 bp, Homo sapiens
aggttaggtcagtcacccaaggtgactcagctggtcttacaacattggttctgccaccctggaaatgtgtggcttaggaactcccaagtggacatttagacacttgggagtactttagaaatgccatgttactaccgaggtccctaaaagttaaggttgggaagcaggcagcatgtctagaatgcagatgtgctttaagctgtctactgagctccatcttaaagtcttttctcattggaaataaagtgagagtttttgtgcagaaaagaatgtgccaacagtcatattctgccccaaatgagcgcctacggaatgctgttactctgataagtattcagtgctc

SEQ ID NO: 224151 - DNA, 614 bp, Homo sapiens
  misc_feature (41)..(41): n is a, c, g, or t
tgagggttatgaaaggtaagaaaaaaaaaaaaaagaatagncaaatggatttgtggaacatactagaaagccagtaagaggcctctaacaatatagtcatttgaggcatgagccaccacacccagccacaaattcatgtttctatgagactttagttatgttaaatttggcatttcaaattggtggaggaagaatgcactattcgataaatgaccttggggataattgcttaccaattagaaagaaaagatatttagaaacttcctcacacagttcacacacaaaaaaaaaattccatctccatgacaacctaaatgtaagaaagaaaaaatattagatagaaatataagaagaggatttattaccttggagaagaaatgtcttcttaagtatgacataaaagctataaaagaaaagattgacatgtctgactatttaagtgttaaaaacttcactatggccagggtagaattttttccaggaatgcatggttggtttgatatcaggaataatatctaataaattaccatagcaacaaaataagggagaaaaaagcacataaatatattgggagggccaggtgcagtggctcacacctgtaatcctagcacttt

SEQ ID NO: 224152 - DNA, 553 bp, Homo sapiens
acttgatttggagcctgcctgaaattgatttttcagaagctgaaaaagctggagtgcaatggcaccatctcagctcactgcgacctccacctcccatgttcaagtgattctcctgcctcagcctcccaagtaactgggattacaggcatgcgccaccatgccccactaattctgtatttttagtagagatggggtttctccatgttggtcaggctggtcttgaactcctgacctcaggtgatccgcccccccttgacctcccaaagtgctgggattacaggcgtgagccaccatgctgggataattttgtatttgtagtagagatggggtttcactatgttggtcaggccggtcttgaactcctgacctcaagtgatccacccacctcagcctctcaaagtgctgggattacaggcgtgagccaccacgcccagcccactttctttaactttaatagaatgaaaatacaaatcaaaccaatccaatttcttgagaataaattttgaacttgtaacaccatttcaatataaaaatgacactttgttgcctttag

SEQ ID NO: 224153 - DNA, 401 bp, Homo sapiens
ccttccgtaacagtttgcttatttccttcctgatttgttttggctctctgtccccacccaaatctcaccttgaattgtaataatccccatgtcaagggtgggaccaggtggaggtgattggatcatgggggcggttttccctatgctgttctcatgataatgagtgagttttcatgaaatctgatggttttataagcatctggcatttcccctgctggctctcattctctatcctttcaccgtgtgaaaagatgccttctgccatgattgtaagtttcctgagggcttcctagccatgcagaattgtgagcaaattaaatctcttttctttgtaaattacccagtcatgggtatttcttcatagcagcatgagaacagactaatacacttcctaatactta

SEQ ID NO: 224154 - DNA, 447 bp, Homo sapiens
cagggtctggtttgggctcccttccggcatgctggctggccacgcggaagctgtgtcggctgttctaacccagctccagaagccaagctgcggtacacgtaccacagcccattaattgagtgagctacaaagatccacccgaagccaaggggagcacacgtgaactcctgctctgactggggggggcaggagggcaggaagattcagaaaaagcaatgaaactagaaaccacacagaggccatttttagaaaataccagttgctataattaacctccagagtctttcaagagctggaggaagagcaggggaaaagaaggtgagaggggctggctggagtcttccttcacaatccctcagaactcactagttctttttttctgtaattaggtgggatattactttccagttattcttttgttcgcactattgccaagtgttcctgtca

SEQ ID NO: 224155 - DNA, 473 bp, Homo sapiens
cagcttctggctggcatatattgactcaaggctcccattgtaggtcagatggttgacagtttattaatgttgggtggtttatacataaacattgggaacacttgtcagtgactggctgagcttactaattgtaaatcagtagaaaaacattgagcaaactctccttgagtgggcacaactttaacgtgaagctttttctaaatggataagcactcattatccctgtggtattgctgggttgtatttattaggtgtgtttgcctgagttttataaataatatatgagagctagcttatatttctaacagtgcctttttttagagggcctaagtagttggctaataaaatcaccactgtccatgtgcgacacttgcggggaatttaaaaggaatttttaaaaatcactattgtgcagctactctcattgaagtgaacttaccatctaatgataaattatatctgaccagctaaaa

SEQ ID NO: 224156 - DNA, 465 bp, Homo sapiens
gtattctactctattggtttttgtgtcaataccacactgtcttaattacagtaactttgttatgataacatgataagcactatgttagagacttaccatttaatacctggccaaataatcaaagacaataaaggtaaaatatggatattgggaagcattcaaagactcaaaaattatatctcccatgctgttttactttggaacctaatgcaaaatgtgcttcagtaaaataaagagtaaatcatgacagggattcagtaaacatgtgagccatagaacactactaaagagaaatcctgggatgacagctgtttagcgggtgtaggggagaaacaatccaaatcagaacatctaaagtacataaaactgtgtttgagtgttttgaaaatgttaatattcaaacattttttattatgatttcaaaaatcatagtcaatgtttgactaacatttcaaacatgactgt

SEQ ID NO: 224157 - DNA, 326 bp, Homo sapiens
taaataaataaaaataaggttctctaaatgactgctaaattagtaggactaatcttcatagtgatttagaattggtcccattagtttgagattgaaaattttctctagctgtttacaagatagttcttatatacttaaggtaaaatttccttatgtcctgttattatattccttgcaatctgaagtaagactgaaataattgtaataaatcaaagttcatctctacccaccctcaagcctcttatctaattataaatggaagcatggaacttgtatttgaattccaattattgaaataattgttactaaaaattttcccaaggcaa

SEQ ID NO: 224158 - DNA, 226 bp, Homo sapiens
tgttgaattttaagagttctttgtatattttagatacagtttcatattgttttttaaagcccttttattccttattaggtgatcaagccacctgcaggctatttttaacttgtgactttattattagtaataccaactttacattactagaaaataaggtattctgtataaatgaaattttcaaataactgaaatatactttttttgccacaaaaaaaaagttagc

SEQ ID NO: 224159 - DNA, 256 bp, Homo sapiens
aagaaaagaaaaaaaatgtatttagcctttaggcctgggacacgggaatatgaaatcaaaacctttgctttgagaagttcacaggcttatagagagaacaagacagagctaactctgaggaatgtgtccagaattcaagagcaagttcacaagcacactggggtataatcaacagatggtcaaaacctgcagcactcatgaaacccttcttggtggactgcactccagcctgggcaacggagtcagaccaggtcaa

SEQ ID NO: 224160 - DNA, 574 bp, Homo sapiens
aatgattccaggggctgtggctgtccttgggtggttacattctaaggtcttgatccttgcattttcaggcctagagactccttatgtcctcccacccagaaatcattagctctcagatactggtgaattattgtataccaagctcaacttgaaatcaacagatgctacgttaacacatgctttctgtagccagatctccttgggaaacctagtagtcatcaaaaagctactcagtgactcaatgatagggagttggttgtgtataataacaagtggcatcaaagctataatgacattgtatcccctttcgatcaaccactcaacatttgtctgcactggcagtgcacctttactgaagaatattagattgctaatgtctgcctctctctcttttggaagtatcatgtaaactgcccccttttgttgttgtacagtataatacagttaattcagatttaagtcttttgtgtttacagattttagttattccatttctcttccctccctacacacatatcaccttaattatattgttgctatgcctaaacttgagtaaaaaaataatttgaatgtc

SEQ ID NO: 224161 - DNA, 412 bp, Homo sapiens
tggcctttgtgttaggaagacaagagggggtgcatgggacttgggaaatggaaaatatgtagtccatctgaaggtggcagctgctactcaattcttgtagctttattgtcacagggaaatggcagcccaacattgtctgatcattttactgttttagagagaaaccagaaatctaacattttatgggattattaaatattgaccaatagtctttgtgccaaataaaacgggtctgtgagctgggctgggccactgaacactaagctttgagcacagttccagagacttccttctctttccaacccaatctatcttaaacactattttaaacaatttcaccctctcaaagtgtaattcacatcatgttcctctcctgcttaaaagttttcaatagcttcccactgcctaccaa

SEQ ID NO: 224162 - DNA, 581 bp, Homo sapiens
ggcctgaacagtctcaagaacgagagaggatgtttggagttccacttcccatccagacagcactggaagcaggatcccatggcagaaatgcccatatgatcttcagtaaatgtatatgtgtcttcatttattttattttttaaattatactttaacttctgggatacatgtgcagaaagtgcaagtttgttacataggtatacaagtgccatggcagtttgctggaccaaccaacccgtcatctacattaggtatttttcctaatgctagtgtcttttttttttaatgatatgtgggtcctctaaagtattaagacaaaggaagaagcctcttttgcttgtgcctaaatcagactgatggacaacactcagatttacttgaaaaatatagcatattttgaagaggagagatttataatgtcagtgaatgctataacagaggaaagaaatgtgatttatcatgtgacttaatatatgtatttctaagtcctagaatattatccattagcattatcatatttatagcaaagtatatttttcttcctttatctaaagtaccgagtgcatttaattatttatttt

SEQ ID NO: 224163 - DNA, 514 bp, Homo sapiens
tcgaatgaaaatatttagttttaactacgtcaaatggttaagaaatgcaaaaaacactgcactttaccttgaaaaagacctgcagtgagcttgtggaggtcagagggttgcagcttgtgagttactgtgaagtgggggaaggagggcaatcttagtggaagggaagcttgcaacaccagctgtggatggatgtgacccacagttgagagggaggccctggtgaaatcggaggtttgttgtgtgtatgtgttttgtgttttcctacacaactccacagcattctgtagtcacttggtatttctcagggatgaaatcacacataagcaaacatgaaattcaggttaagctcccattgttctgataaatcttggtactgggataaatttgtttcagcataagtgttatagcagaagtcactgtgttcaagtttattcactgcaccattgtgtacggtgggtccatcaaaggagaactggctaaatacatgcatgcactcataccacaagatgccgtg

SEQ ID NO: 224164 - DNA, 361 bp, Homo sapiens
agactttaaaagttcatacacagacacacccaaaacagggaaatttaaagcatcaaacatttttatcacccggtgcaagtacgtgttaccttgtattcttttttcactgagtgttacctctggtacacattcctgtgtgctgtgttgtggacctatgttgcctacctgccatcttcgatggtgtcatcatattatgatcattttaatggtcagagttatttcatgtgtctatcttgacttctttccaagtcccctctgttttaaatgaaactcctgaaaacttctgtggatctagggtttagggaccatttccttgagatctgtcaccatcctggagcctttgagtccaagagtgaagcag

SEQ ID NO: 224165 - DNA, 378 bp, Homo sapiens
atgagttgggaagtgttcctctatgttcttcaaaagtttatgtagaaatggtatgtcttaaattcttgataagacttcagcagtaaagccatttgaccctgtgggtgagtttttaaactataatttctctagtagacataaacctattcaggttatgtttctttttgaatgagctttagcagtttgtgtctttcatgaaatgtgtccatttaatataaacagtaaaatttggccgggcgtggttggtggcgggctatagtaccagctactcgggacgctgaggcaggagaatggcgtgaacccgggaggcggagcttgcagtgagccgagatcgcgtcactgcactccagcctgggcgacacagcgagactctgtctc

SEQ ID NO: 224166 - DNA, 305 bp, Homo sapiens
gtcacccaaagccgtgatgacagcccgcttttctctggtggttctactcaaccgctccactgaggtgatgggagaggtgaggggcccaggaggaaggtggagctcaaaggcactgtcttcatagtccacaggtctcaaactccagcatctcagaatgaaaggattcacaagtgctcacaagaggcttggctgccaggggaagctccgacctgaagatttgaactaatgagggactataaaggccaagaccttgttcttgccattttagagattcagaatataatctacaaagttagagattataa

SEQ ID NO: 224167 - DNA, 727 bp, Homo sapiens
tccttacgttgtgactgttaattttaaaagccccttgagggtttagtgtggtgctaagctagggggaagagtccagcgggagggtgcagaggaagtagagaacaggtgcctcctctgtcagtttgtcaggcagggctgaggggaggagcctgcaggaatgctaaggacttggaggagcgggctctgggctctgtggcagctaagatgccaaagaaaacaagggctaaagaaaccccgctattgttcctgcccagctctggcatttcctgctggagcagctcctcccccaggtctctcctcttaaggccggaggtcagtctgtcctttcttccatgggtcccagcgctttgtccccagccaatcatgccagctgtacatgccagttgtacgcaggattttcttctgggcctgggacttgggctggacaatgaccctgatgaccccagaggccattgggggccaggctcctttgctgctgaacttgcctccagttcgcaccctttcacttgctttctcatcctctctccccaggcactgtcttcatagtccacaggtctcaaactccagcatctcagaatgaaaggattcacaagtgctcacaagaggcttggctgccaggggaagctccgacctgaagatttgaactaatgagggactataaaggccaagaccttgttcttgccattttagagattcagaatataatctacaaagttagagattataa

SEQ ID NO: 224168 - DNA, 375 bp, Homo sapiens
gagtagggggtcttgccatgttgcccaggttggtctcaaactcctgggctcaagtgatccttccaccacagcctcccaaggatctggggttagaggtacacaccaccacacccagtttagtctaccagtttttaagtgtcatataaaaagtaaattggcagccgggcacagtggctcatgcctgtaatcccagtactttgggaggccgaggcaggcggattgcttgaggccaggagttcaagaccagcctggccaacatggtgaaaccccgtctctactaaaaatacaaaaattagcggggcatagtggtgcatgcctgtaatcccagctactcgggaggttgaggcacgcgaattgctttaatccgggaggtgg

SEQ ID NO: 224169 - DNA, 448 bp, Homo sapiens
ctgtagacttccaagctgtataatttggattcactggccaaaatctcctctgagatacttacatttttaagagtctatggtctcttctcttcaagggcatgtatatggtgctgagtgtatgtaattttctgagatctatcaaagtatcaccattttctcatgcccaatgaaactgtggtatatgttattcatattctctgtcatttccagtcctcttttctctctgagaagacagaaaaattacagttctctacaaagttataggtaagcatgatcatgtgacctgctttggccaatgaaaatggtaagaacatttaagagacaatttatttcttgttctttctctgctgtagaaaaccctaaagactcatgtcgagatggtcacatcaaaaagcagccaagcttctgagcgtataggtccctgaacgtccaagataagcatagcccc

SEQ ID NO: 224170 - DNA, 508 bp, Homo sapiens
gtaacccgtgtgcttcttcgagatctgattcgtagattgggactgcccttctggatcggctcagataacgggcctgcgtttgtggctgacttgctacagaagacggcaaaagtattggggatcacacggaaactgcatgccgcctcccggcctcagagttccggaaaggtggagcggatgaatcggactatcaaaaataatattattgtcttccccgctggatatgtaaaacaacaccacgaggggcatcaaaccacctgctacattggagggaatcttatcctctccccacctcctccggtcccggatattagaggcaataacacaggggtaatgtacacccactgctttattgggagtaatgtcatcctctgccttcttggatattaggaacaatatcacagtgtgcgtgtatgcctgtcgcgaaattcaatggaatgtcatcctgtgcctccctggatatgacgaacaatatcacgggggatgtacaacttctgagatattggga

SEQ ID NO: 224171 - DNA, 406 bp, Homo sapiens
aaaaggggctggtagcaagatctgttttaccacttatgtaaaaagctcctctacagagagcaaagcataaagtgagacttccaaaattgctttttatcaccagagccattggctaaatagttgaggacccacaagcaaacttctacattggcaatttcctttctagcatcatttttcacagtcataagtcatgttataagaattttctaattgctaatgatggtccttgtaaggaaatatatgataaatgttactataataataccaagacctaactggtacttgtggctgccttctatgaagtcattcttccccatttaaacacataagagtctgccttacatcagaatgagacgtaactatcccctgttagtgtggttttaaatcttgaatctaacagctaatg

SEQ ID NO: 224172 - DNA, 668 bp, Homo sapiens
gggatttggatcctgccagctcgtccctgcaaccccctactccggtcccctcaaacctgtccgtggctggcagccctgtgatacctcgccacattctgcaacagaatccgagatagaggtagaagtgggggagtacgtcgtggctgtcagggcagctttctgtaaaatgctgcctggaggagcatgtgattccagaccctcctctctgcaacgaaagtgaggttgacacctgcaggcctggggcctcctggcccactgagcagaacacacagaagctgggcccacccctgccctccccacaaagggtcacgggagccaccgcctgactttgaagcccactgacttgcggctgacaagagaaaagaatgtgcccctgtgatcatgtgaaagcatcagccaggggtccaagaacttccctctggagcctcacactcccagcgtggcacccagcagggaacagattctctccaaacctttgtgaatgaatgaaggatgacgtcactagaatccatccctgttttattttttatttttattttttgagacagagtctcgctctagcctgggcgaaagagtgagactgtatcccaaaaataataaaataaaataaaataaaataaaataaaataaaataaaataaaataaaataaaataaagcacactcagtt

SEQ ID NO: 224173 - DNA, 314 bp, Homo sapiens
aagtcttgttagagatatttgcccctagttaaatggctccagctatgcttttgttagttctttctcctttttgtggtttttatgtatcttccttgactgtgagactcaacctcttctccctaacctaaaataattactaaaggcaagaaataattactaaataattacttaagatatatggcaattatttttatttctatactactatttctatttctatttctatgtgaattaccactactactatttctatattaattacagatgagatttttatataaatgatcccagtggaattagaagtaatatctagg

SEQ ID NO: 224174 - DNA, 673 bp, Homo sapiens
agagggagttcttaacctctgtggcagagcaacctgaaaacagaattatactccatacacatagctacaatgcctcatgcagaatgctcttcccaaaaccgtgctcaaggatacaaacccaggctgtccaatttggggaaatcattgtttgagggtggcacagacaagcagtcggcttggggtttgctccctgtgcacagctcgatcatcaaggaaaggcctcttccgggcctcaaagctccctttgtgaggaatgaggcccactgtcgaggctcacacaggcagctgtaaccaggctgcccctctctctgggtgtttgttttgatagaggttcatttatgccagagacaatgcccgctctctttgttctgcccccagcaggaagcagtgcagggagggggaccagcattgtcacacagcttccaattcaggttttggtggccacaacaatggggcctcaagggccacaaataaagagccgctcacggggagcagggcagagagactggcacatgtggaccccagcacaccccaggtagaagtcacctcctaacaagtgctcaggctcactatcaagggctttgagggctctgaggttggggagagggaggccacctcctcttctcttaagtggtgctgggagggagaagtaagcaaggtccccggggatgac

SEQ ID NO: 224175 - DNA, 782 bp, Homo sapiens
ctcttccttatagaataattctaattaataaatgtagaagaaatgagaaaaatatagaattaccactaggcaaataccacagtagtaacccttgcgagcaagatccatccatagataatagaaatcaatgggtcaaagtttgaggaacaagaagatatttatcaatccaaagggagaaacagtaactttaccatggagaaacttggcagacaccactttaaacaagtaatcaaggttaatactaccaataaaataagacatagcaactacaggtaccccctgaaaaaaatgcactatgaaggacacaacatcacttctctggtattcttgacaaaaaggcacaacctgaatccaaaaatgagaaaacatcaggcagaaataaacttagatattgtacaaatcaattatcaaagcacaatacgcatcaaagtgttaaagtcatgactaaggaagtgtcacagagtgaaggatactgaagagtcacaacaaccaaatgcaacgtgagatcctgaattggttcctggcaccaagaaggacatgaagaaaaaaacctggtaaaacttgagtaaggtctgtagttgagtcagtaatactataccaacatgttaatctcctagttctggtaattgcactacgattgagtacgttttaacattaaggaaagctgggtaaagagtatatatgaactcttctgtaatattcttgcaacttttctgtaagtttaaaattatttcatacaaaatcagattaattcaaaatgtctagggcctaaagacaaatta

SEQ ID NO: 224176 - DNA, 598 bp, Homo sapiens
tccacgttaacaacacttggtatggtcattctttttaatgttagccattctatttttagcccttctgtgtagtggtgtcttattatggtttgatttgcatttccctaatgactaacaatgttgagcatcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagcatctttttcaagtgtttatttgaagggttcaggccttttcccacattttaattgagttgtgtttgttatttcattttgattattttaaaatatattcttggtacaagtcctttataagacgcatgctttgcccatattttctccaggtccatcacttg

SEQ ID NO: 224177 - DNA, 735 bp, Homo sapiens
caccatgcccagctaattttttgtattttttagtagagacagagtttcactgtgttagccaggatgatctcgatctcctgaccttgtgatccgcccacctcaacctcccaaagtgctgggattacaggcgtgagccaccgcgcccagcccctctcttctttttttaagaggcaaggtttcgttctgccacccaagctggagtgcagtggctcaattagagctcactgcagcctcgaactcctagactcaagaaattctcttgcctcggcctcccaagtagctgggactacaggtatgcaccaccatgcctggataactttttaattttttgtagagatggggtcttgctatgttgcccaagctggtctcaaactcctgccttcaagcgatccttgaggcctcccaaagccctgacaatataggcctgaacaactgtgcccagctatcttatgagataagatatatcctcctcaaaaggcttgcaggaattatgactttatcattaaatctgaaagagggaataacaaaatgctcctttttatagggaggaaaccaatccattgagtagaacgtcctattaaacactgagaaggataagatacacattgaagaaggatggattttttccccccttgagacggagtttcgctcttgtcactcagcctggagtgcaatggcgcgatctcagctcaccacaacctcctcctccctggttcaagcaattctcctgcctca

SEQ ID NO: 224178 - DNA, 433 bp, Homo sapiens
cagtgaccactccctgatatgctgcagatgcaattgagtagcagcttcattccacatttctccaacatctttcatggtgaggtcaagagcatattcaaaaccatgtgtggctcagtccaactggagagaccaagtcaaagagcctcatttccataaggcacagagttaagaagtggcaagttaacacagccagagcatgcacagaagaaaacttcgacctcaaataacacctagaaccaaagtccctaccgcagaactaaaagattgggatgtggctggaactcaagcacctaaacactttcaaaaggctttgccttccagtgtctacttggccttccagtgtcagacagcttcttgcacctgacccacccagctgaggacacagatgtcaaaaaaaaaatcataaatacagaattccagaaaattttaccaa

SEQ ID NO: 224179 - DNA, 454 bp, Homo sapiens
atcatctttagaatttgatgagaaagtaaaattgcttcctcactgtcctcaccggattcacagggggaaatgattcagaggcttttgcctttacctcctagagcatgttcttgcaactgttgggctagtcttatctggccaaactctgttactaacagaatgtctagttattttgcaggcacagagttaagaagtggcaagttaacacagccagagcatgcacagaagaaaacttcgacctcaaataacacctagaaccaaagtccctaccgcagaactaaaagattgggatgtggctggaactcaagcacctaaacactttcaaaaggctttgccttccagtgtctacttggccttccagtgtcagacagcttcttgcacctgacccacccagctgaggacacagatgtcaaaaaaaaaatcataaatacagaattccagaaaattttaccaa

SEQ ID NO: 224180 - DNA, 405 bp, Homo sapiens
gataatttattttgtatttttgaataaaaaacatttgtacattcctgatactgggtaaaagagccatgtaccaatgtatggctttcaacttaaatcactgaggcatttttactactattctgttaaaatcaggatttttagtgcttgccaccaccagatgagaagttaagcagcctttctgtggagagtgagaataattgtgtacaaagtagagaaatatccaattatgtgacaacttttgtgtaataaaaatttgtttaaagttaaaaaaattttttttaattagtgaggcatggtggcatgtgcctgtagtcccagctactcaggaggcatgggtgggaggatcagttgagcccagaatgtcaaggctgcagcgaggcataatcaaggcacttcactccagcc

SEQ ID NO: 224181 - DNA, 655 bp, Homo sapiens
taaaaatggtatggaaatatatggaactaagttatgttactagaaaatcaaattagaatttgtaaatctagaatcaaaaaagtatagacaatttcagttgaaataagtttggggttaaatcaactccttttgttttaaaaggctgattttagttactgatagtttatcattatgtatgatgatagttttaggatggcaaatctattttcataaacacagattatttagtcagacaatgaaaatgtttttattagcaggtatagcaaagaaaagcagatgtcttataataaataggaccttgtgttctaaattcagaattatgagtgatctatataaaattggggaaaaattacaggggaaggggatacctcatgcctacaagccctcactgtttctgaatgtcatgttccttctactactagaagtgatggtctggactatgttgtaattttttacaactcatgatgtgaaaaaaatatcatgtaaatatatttctgctatttttcttaaaatgtataaaatctatggattaggatttatgttcctaaaaataacaccctggtattctacaccaaagaagaaattataaggggaaggtgataattaacaaatatttagaagactttatggaaaaactgattttgtgttacctata

SEQ ID NO: 224182 - DNA, 874 bp, Homo sapiens
tggtcttcatgcaaagtctttcttagatagcctttatggctccttctggctctgacattgtatgatatactattgattatttcccctggaaaactttctcactgtaatgtgttccttcattgcctgtgagaaggagcacaagacaaataaaactttttttttatcctggtatttttccaggctcctggtattagaatgtttgaaatgaaattatacaaaatgtcttcagataaattatgagttcttgggaaattatgtttgaatttgctggtgacagataataataataaataggtagaaatgaagatatgaataatgcttcaatttcctaaatgccaaaatatggtacaattagacatttgtttaaacttccttgaatgggtgttactttcctgaggtttaactttaaattagtggcctgcatttgcattcaattcaatgaatctattggggtgactaacctccttatacagtaacaagagtcacaagaggttaaggctaggcttctagaggtgttaagtcatctctgatagcagtgtatcctacctgcttttaaaaagaacattttagtaaggataggaggtatacgttagaggaatatataatttgctttgtttgtaacaggaatacctgagaatgtactgatgaccatgtaaacaaggtacagtttagggtagaatttctgcagatataagcaaagttttggtacaacaaatggttaatttatcaagtcttctattagtcaaggattgtttgagagtatgctaaaactgttgtctgttccttaaccgtgggttttcattgtcttgggatgagaatccatgctttcagattgccagaattctggaagtgttcacagctaggggaaaaaaag

SEQ ID NO: 224183 - DNA, 484 bp, Homo sapiens
atgagaaaagatacaactgaggcatatgaagttctaataaaaaagtataaaagaaaaatgtgagaaacatactcccagataaaccttgtatgacagaagaaaccaaaagtaaaaattatttagaaagcaataaagatataaacgcttcatatccaaaggagcaaaggctgtaggaaaatgtataaccttaaatatgctcatcatttagaaaagaaggttggtattcatctagataaattataaaatgatttttaaaaaataaaataaaccaacaaagagaattaacacagattaaggccaaaattaaggaaataggaaatataaaaataacagaggttaaggacatccacaagtattttccctttaccagtagataatacacttacaatcctaattaaggggggaaatgggagaaaacaaaagtatacaagattgcaaatgagaaacaataggataatgaccacaaatatagaagaggttgaaa

SEQ ID NO: 224184 - DNA, 375 bp, Homo sapiens
ttattatttttttaaatctttgtaggaattatcatcctcccttatcaacttcattttaaatgtcattaaaatgaaccatattacatgaatgtcttcttaattgtaccatagcacagaaccttgctcatagttgctaaaccagcatttctttaatttggtaaattccccaaagaggaatactaccttttaatatagaaagttaaattatttcctgcagcatatatttatattcgaagtcataattcaaaattttaaaacaaggagtacttatctataaagaagcaaataaatatgcagtcattataggaactcagatttcaggaaagcacatggattattttcattgatttaagaatttaatcatgttactcagta

SEQ ID NO: 224185 - DNA, 468 bp, Homo sapiens
gatctgggcacaaatgtgcaatacattggcaggaggacagttcacctatacctaggatgtgttagacttttaaaaatgaactagttgataaactagcctctcatttttccatgctatgtacaaatataactctagaattctcacacagacacaaagggaagataaatgacatgtggctctactttgttattagccctggtaatgttttctaaaaaaattccttgggttttcatcattatgatgtaattgtttttatacggtttagagatgtttttcaagtgccttctttcctctagtaagtgacatattcacattacactgttcgggtgagttactattcttcccaaaattgctaacacatgtattttgtaaagagtaaaagacttactacatctccatctctaaaagcagtgtaatctaaagtttccaaatttcttaattgtataataaataatggattagaataca

SEQ ID NO: 224186 - DNA, 490 bp, Homo sapiens
ggacatgatacaatcgagctcggtacctctcatggcattgtgtgaactaatccctattatttgggtaaatattgattcttgggctgtcactaatggacttgcaattggtctaacaagtgggtcacaaataactggacaatagaagggccctccatgtgaggagctgctctttggaaatctctatgaaaattctaagggaaaaatcaaagtagggcatgctgatcccaaagaaactctatgccagaattttaaggtgattggaaccaacagttgatggcctaacttgatctcttgaaatggcaaccaagtctatgaaatgggtggaggaactcaagccagccagtgacgcactgaacaatgacatataccagtgggctccattgaagcttaaactattaataaaaattgtcctggcatagataattgttgtcatggcttaaaaaaattttttttttaagagatggggtcttgctatgttgcccacactgga

SEQ ID NO: 224187 - DNA, 1055 bp, Homo sapiens
tgcggtggctcatgcctgtaatcccagtactttgggaggctgaggtgggtggatcacctgaggtcagcagttcaagattagcctgggcaacatggtgaaaccctgtctctactaaaaatacaaaaataagccgggcgtgctggtgggcgtctgtaatcccagctacttgggaggctgaggcagagaatcacttgaacccgggaagcagaggttgcagtgagccgagatcgcgccattgcactccagcctgggcgacagatcaaaactctgcctcaaaaataagatggacaatgtccaaagaagttctgtcataaaatggaaatgaactatatgcagcatgctaccaggggatctatgtgaaagaatcatcagattcatgagcaagtagtcttttcctcctaggatccctcctttcaattatttgcccatggatgccaggcaattggactggttcacagatgactgttctagaactgagggcaattctgtatgaaaagtagatgttcagagtccagcagaaagtaaaatcctatggaaaaagttaagaacgagttggtcaacagggctgaattataggctataatcatagtcctgatagaagaactggacacaaaagccctattatttgggtaaatattgattcttgggctgtcactaatggacttgcaattggtctaacaagtgggtcacaaataactggacaatagaagggccctccatgtgaggagctgctctttggaaatctctatgaaaattctaagggaaaaatcaaagtagggcatgctgatcccaaagaaactctatgccagaattttaaggtgattggaaccaacagttgatggcctaacttgatctcttgaaatggcaaccaagtctatgaaatgggtggaggaactcaagccagccagtgacgcactgaacaatgacatataccagtgggctccattgaagcttaaactattaataaaaattgtcctggcatagataattgttgtcatggcttaaaaaaattttttttttaagagatggggtcttgctatgttgcccacactgga

SEQ ID NO: 224188 - DNA, 81 bp, Homo sapiens
caccaacagaagctgctcccagttcaagtataaattcctggggtaggaggtggggggaataggaagagagataattggtgg

SEQ ID NO: 224189 - DNA, 464 bp, Homo sapiens
acttcactccagcctgagtgaaagcaaaacttcgtctccaaaaaaaaaaaaaaagtttgttttggtaagcctagtataattgattagttttgtccatgcaactttccccttgttggactctgtacttaataatacagtatttagattctcatttagtatcctgctttctctgtcgatttgatgaaggtacccaaaatgattcctaaactaacacatgaaatacgtgtgtaaaacattgctgttttaatctttagttttcctcatttctgatgtaaggcattgtatagttgttctactataaaagatgtagaatatggccatgtagtgcctcactgtaagttagtacatgtgtcttgagcaagtggaaatatcaaaacattgatactttgcttctccctaatcatttggaatgtcctgagatggatactatttccagggcaaaattaaaccttccagaaaagtag

SEQ ID NO: 224190 - DNA, 543 bp, Homo sapiens
aaacagagttgaaatttactcttcttataaatataccttcctactgaggaaacaatgatgaaagaacttccagaagtaattttttgcggacaataaaatgtggagggaaaaatcctgtacatcatctttactgtcatacattgtcacaggatttagaggggaaatatgcttttatctggggaattagggctctattgctaagcagctgagtacaggtattttcactttccctgcacagttatctccaaacaatatttgcaaataaaatagttatttcatttttcaatatccaaatataatttttaactatatagtaagtcatacttagtatagaaaatttggaaaaatacagaaagacctccagaaaaaaataaaaataacctgcaatcatataatctagaggtaatttgaatgtatttccttttagaatgtgtttctatgtgcttatgtctatatgtattttttatataagtggaatcacactgcacatacattttagattcttcacttctctctataacaataaacatgttatttaatggt

SEQ ID NO: 224191 - DNA, 515 bp, Homo sapiens
caaaaaaagcagtaattaatggttcccttaattgtcttcataaaatatttgcatgggtctaatttgcataatttgcatgtattaattaatctttcaaaggaattttgtgctgagagaagccaaaaaatctctttgttttatttaagagctaatgaaatatttatcttctttaatgaacttctcatcttcattaaaataaaaattgcacaagtttgtatgttttaaatgtttttataattgaagtattcaaaaaatctctttagtcttacaacagctgaaaaacaaacatattattttgcattcagtatcattttaacaacagcaacactttaaaataaagaaagttcaatttcactttctcaaagatggcaaatcatatggcaaatacatacagcgatttagttttaaaaataagatttataaagaccagctcattttttttaatgacaatgttatttttatggctgaaatactgggcaattagagggtatgggtatttttctcatccatatgag

SEQ ID NO: 224192 - DNA, 363 bp, Homo sapiens
ttcttaaacagattgaaagcattagaaagtttaaaaatataaggtagaaaatctgatgtaaataatcacctgttgtcaaatttaataaagaactgaaaaggcttgggtatataagaaatgtaactgatggatcttaggggatatgaaaatcatttcccacccctagcactttccttgaataaagtgacatgataggcttttgttcattcaactcagttgtacactaaatgtaatgtctcaccaccccctgcctttttggttgttgttgtcacctattttgggtctctacgtttaagagtcaggactgttttgttcatttgctgtgcctggtacaatgccttgaatataataaagaggtaccta

SEQ ID NO: 224193 - DNA, 233 bp, Homo sapiens
agggttgacctggcgaaggctaagtttgcagaaccagacctcacatctcagctcagacattggtaactcaggcagccctgacatggttttagtgacacttgaggtacattaatgacataaccttccctacctttgtctctctacatgccacagttgtgtttacttactctagtcactcactctaatcccagtccatgaaaccaagcctattactgctctgtggactttactta

SEQ ID NO: 224194 - DNA, 634 bp, Homo sapiens
  misc_feature (169)..(169): n is a, c, g, or t
tttggtttttttaaatattttcctgactttttaaagattttattgggtattatttaatgcttccattttaccttcagtattgactttttaattatgcctcttaaaaatatttatcttcatcggtcacaaaggaatagttgtgtttttgttgtttcacagttgtcttaantattatctaaaacaatacaattattttttttctgtttgcatgtcttccatgtttttacagggcagagtattttactctctcggcttccacattttttcatgtcattattaaactcatggaggatacaaccagaagctgagctctgaagagggatgaatacagagggctaccagcacagtgatagcagttctggaagctgggctctgaggagggatgaatagagggctaccagcacactgacagcagttctgccgtaaactgccacatagctggcaaaaagggcaagcacggttaaatcataagatttaatgaaacattatttaaaaaaattctttagaacaatgggaacagtgaattaagtttactatataccagccattaatttttttttttttaaaatacagggtctaactctatcgtgcaggctggaatacattggtgcaatcatagctcactgcagccttg

SEQ ID NO: 224195 - DNA, 555 bp, Homo sapiens
gttattcgtaaaaagtctgtcaactataacatagttaaaaaagaaaataaaaaatgatcgaacaatccatcactcaattatcttgtaatatcttgtttcagtctctttcttctggcatattttgggatggtgacctatttttccttcttttactctttatgctgtctctcagaaatctgctggttaataatttattgtatcattatactattttgtaaaggcaatgtaatgttacatcagtattactgatgtacttgtgataaatttgaattaatgtactattgttaatatgtactattgtactatttttaatttaaaatcattgtgagaggtgacagcgtgctggcagccctcacagccctcgctggctctcagcacctcctctgcctgggctcccactttggcggcacttgaggagcccttcagcctggcgctgcactgtggcagcccctttctaggctggccaaggcagagccggctccctcagcttgcagggaggtgtggagggagaggcgcaggcaggaaccggggctgcatgcagtgcttgcgagccag

SEQ ID NO: 224196 - DNA, 428 bp, Homo sapiens
actaatatcactgccattgtcttaatggtgcctacgtctggaacaataccaatgtttggcatcagcagaggaaaccaaaaagcagattcagagattaatttctaaatttaggtttacccccaaagagctcacactcatttctttcaaaacactgtgtttaacttgactttgcatgtcacttcttctgaaaatgtgagcctttaaaaacatcttttcacttttcaaaatgatttaccgcaactagaacaaatggtattactgatatttgacaaattgttttaaatgttaacattggtcgtttctgccaagcatttattttttgttttcggaagaatatttgtcttctgttgagtcatatggctgttcctaaattatttggctggaataattattaacagtttgtggagaggtccttccagataacgaaa

SEQ ID NO: 224197 - DNA, 356 bp, Homo sapiens
gaggtccacagatcaccaggaagcccatgtcttggcatggtaacctggaggagcctggagacgccaggtttcggaatctcattcaccacgctgcccagggaccaaggaagagggacccagacacagaccgaaaaccaggaaagtgcatgggactcagtgcccccccctcaacccagaatgcccagattgcaggctgaaccactgcagggtctgcaatgacatcgctctgtacaaggctcagatgtggagcctgggaggagatgatggccaccagtggcatcccagcagtggactgaggcgccggatttcatgccttaagtgtgcactgcccccaaaaataaattttttatgttact

SEQ ID NO: 224198 - DNA, 490 bp, Homo sapiens
cgggcgctgccctacccatgcccgcgccctcctggacaccagccccgtctttctgctgtctgaaagcccccacgcctgcctcttaggccactctaccagtcatgattctcctcatgtaaagaagtatgtaatgatttcttctgtgtgtctctagttctgaatttatgaacaataatgccttagccataaagactctatttttaaaaattgcttttagtgcttcgaaggcttagaaaatctacaggcagacttttaattaaccaaagtaatatctatcaatttttaaaatggagaaccatcactccaattgtaccaccctggcacaagcatcattaatgtttatttataaatctgtttagtgttttattgctgtgtgtactatgtattttaacatagatattaactatattgctgatgcaatttggtgttctgtttctctcatttaacatatattttgcatactcatgaataaaattttaagactgcttaa

SEQ ID NO: 224199 - DNA, 423 bp, Homo sapiens
acattaagagaatgattctcatgattttataggctgaacattgatctttctccctacaatttaagtttcaactatgttttttaaaatacctagtcttttcttaaatgaccaaaacaatattagttttgactgtgtgtagtagttgttaataataatagcaataacagaagtgcctggcatttattgagcatgtgtgtatactacataactaccatacactgggtcagcactggtttagtaagtgaagcaatcacttagtaaaacaggtgtatttataagatgaccactggtctgtcatgagctttgagtgatgttacgtgacactaatggacttctactgaactgttttgtcaacatcgtagtatttttagcttttttttcttttttgagtaaacatggagtgtctcataggggccagacccc

SEQ ID NO: 224200 - DNA, 517 bp, Homo sapiens
gaagacttacttgtgatccatgcaagaatgtttgtagcgccccatgatttgtaatggaaaacaaaattgggaacaatagaaatgtccatctttgagaggaagaaactctgtgatcacatgtggagaatgcccaagtggtgaatacgaatgaaccagagtgagacctagtagcccgaacgagcccagatgtcatgctgagtgagcacaggaagatgcgggacacatagaaggacagcgtgtatgtgttcaaaggcatgcagagtgacgacatatgctattcaaggatgcgtgtggatggagcagaaatgttaacacacatgggaataacaaatcactacgtccgagacagcgattttggggagcacacagggaggggacttcatctgggaggaacgcattattaggctgctgtgacaggtgtgtgggcgtggaccatctctgtacctttgtatatgtctggaatattgcataataagtaatagcttaagaaagagagagagacagccagggtgtgtgg

SEQ ID NO: 224201 - DNA, 217 bp, Homo sapiens
tcattctgcttttgggccggagactgggctcagacagggctagggacttgcccaaggtcacactaccctggtgggtcgcccagggcggaagctcccatggggtgagcgggctgcccgctctggcatgcgctctggctggctgtggagtcgggatctccactcccatttcggtcctgacacgcactggctctgtctgaacctcagtttcctcctcggc

SEQ ID NO: 224202 - DNA, 369 bp, Homo sapiens
tttgtatttttagtagatacggggttttaccatgttgatccggctggcctcgaactcctgatctcatgatcagctgacctcggcctcccaaagtgctgggattacaggcgtgagccatcgcgcccagcctagaactttttaagtagaacctgtttaagataatttgatgacttaatcctcaaaataataatgtcctctatatattcccaaattcaaaacacttgtcatttcatgagtactagctatttcatcatcatgatgagcaaaagagaacaaagctgactccctaaaatatcttcaggaataccggaaaattatggtacgaatagaaagatgtcaagacaatcaagcaattaatagatttcaggg

SEQ ID NO: 224203 - DNA, 428 bp, Homo sapiens
ccattcatatactttgagcctgtccatgtttatatttaaagtaggtctcaggtaaacaacatataactgagttttgcctttctgtccattttctgtgttttaattggaacaccaaatccatttatagttaatataatttttgatatggttggaatgagggctatcattcatccactgttttctgttgttccttttgaaagctgccatttgggggttaagggaatatttattatttaattatttaatatttattattataattctgtttttattggttttgtttttgttttttgagatgggttcttgctgtcacccaggatggagtgcagtggcacagtcatggcccactacagcctcgaactcctggactcaggccattctcccacctcagcctcccaggtactgggactacaggcatgccactgcac

SEQ ID NO: 224204 - DNA, 622 bp, Homo sapiens
cctcagtctttcccctttcagttggcgggcccccatcctccctgatgcgtaactcaaaagccttcatctatgaccactacttctctcacatagtatatccaaatccataacctatcttcttagtatcttctacacacacagtcagactacttctcactactctgatctgtgttctggattgctgcaataatctgctgagtgaggtccctgcttcaacttttgccccttttaatatattcctcaaaataggagccggagtgattccactgaaatgaaatacaaccctttagcagttccttatctcactcagaattaaaattagcacctttaaaatggcttgcaaaactccatactgtttggcccttcacttactctgagccagccacaatatttctcaaacctgacaggcatgctcttgctttagggctttgcccttgctgttccctctgcgtggagggggcccctcccctcagatatcctgagagctcactcctccttcttcaggtctttgctctcagagaagcccgccctcaactactctatttaaaattaaaatttccctagtccccaccaatccctatcttctgtctctacttactacagtatatgttgatcgctacca

SEQ ID NO: 224205 - DNA, 524 bp, Homo sapiens
attcaatgtatctgcttcatcccatcccttacctattgtcttgtgtgccctgagatgatgaacacacattttgttgccattcctattattaatatattatagctctgtggagggcaggagctggcacccagccttcacacggcaggagcaggttgacattctatctggactgacaccgactccataactagtgctcccgagttccatgtgtcatccacttgttatccaagcaactgcactgtctcctagcgaatgatctcacagtattctgtgtctgctcaccggtctgtcttgagaggacccattttatgttttactgatgcatattactattaaaagcaagaattttacgtgatctatattttattttagattggtatattactaaatattatatgttaaaattcattttaaaataataacagatttaaagattttgtattgataagcactgtatacttttaaatacatttcaaagcctgatttataaacatcaattaaaaaaaagtataccatgaaaggtt

SEQ ID NO: 224206 - DNA, 633 bp, Homo sapiens
cctgcctcagcctcccgagtagctgggattacaggggtgcaccaccatgcctggcttaatttttgtatttttagtagagatggggtttcaccatgttggccaggctgctcttgaactcctgacctcaggtgatccacccgcctcggcctgccaaagtgctgggattacaggcatgagccaccgcactcggccaggactcaattttgaagttcttatgcaagcaaagctgcccatatctaggagtttatgcacacagtactgattcaatacctgcgtcttagtggtccatcaggaatttttcactcatgaaatatgactttaatacacgtgttgggaccagagagaaaaccttccctctgtgcatctttttttggagaacactgtcatgaacagccgaaaacatcagatcaaaagcgagagggatactgacaaaacagggagtgcggatttccactgtgggtggggacattgggagacacggtgactcactcctcagtaagtgcattcttaggctctttactctgtgtgcatttttattttctcatgggcaacaatataatttctttcaaacatgaagagccatccagcatgtttctcaaaggcagacttaaatgatatgaggggtgtgcctaa

SEQ ID NO: 224207 - DNA, 542 bp, Homo sapiens
ccgggctgcaggctcgtgccgttctttttttgtttatttgttttgcttctgttttctgtaaatatctatttcttattttggacatgcagggatcaattgagattctggagtggggggaggggcggatgactgggtctttttattttttcctttctctcttggattttggtgtttgaacttgaaaaaaataattacaagtatatatataagcaaatgacttacctttaaacaaaagaaataagttgatttcattcttttgatttatcttgtttctcattggggtcgggtgggggtggggggtcttttgggtggagggcttttttgtgagctgtatagatttccagtttggacttgttcaaatgatgcaggaacaaaaattaaaacgaattaaaaaaaagacaacataaaaaaacaagaaaaactttgtgatgtataaaagctgtaaatagtcaaagattctttctcttttctaatggcaaattatttctgtcactttatattcaaaaaataaagaaacctaccacaaattatcagggttaaaa

SEQ ID NO: 224208 - DNA, 737 bp, Homo sapiens
ccgggctgcaggctcgtgccgttctttttttgtttatttgttttgcttctgttttctgtaaatatctatttcttattttggacatgcagggatcaattgagattctggagtggggggaggggcggatgactgggtctttttattttttcctttctctcttggattttggtgtttgaacttgaaaaaaataattacaagtatatatataagcaaatgacttacctttaaacgggtgggggtggggggtcttttgggtggagggcttttttgtgagctgtatagatttccagtttggacttgttcaaatgatgcaggaacaaaaattaaaacgaattaaaaaaaagacaacataaaaaaacaagaaaaactttgtgatgtataaaagctgtaaatagtcaaagattctttctcttttctaatggcaaattatttctgtcacttttatgtttgattattttgtaacctaacacatatttttaggtgttctataattatttataattctgattttttggccgtcctcattttcatctattttcgcttttttcatttactggtcgttcctttacatcttattcttgtgaatatctttttttgcttactatactgctttgtttaattacctcttttctttttgtgttttcttataggtctgtctctgtctgtctattcaaatttggtttttcttattgcactttctatatgtcatcgtcttttgctttacatctcttgtatcg

SEQ ID NO: 224209 - DNA, 438 bp, Homo sapiens
  misc_feature (237)..(237): n is a, c, g, or t
  misc_feature (239)..(239): n is a, c, g, or t
ccgggctgcaggctcgtgccgttctttttttgtttatttgttttgcttctgttttctgtaaatatctatttcttattttggacatgcagggatcaattgagattctggagtggggggaggggcggatgactgggtctttttattttttcctttctctcttggattttggtgtttgaacttgaaaaaaataattacaagtatatatataagcaaatgacttacctttaaacgcgtgtncncatctttctactttgctccttctcttctcttccttttcttctttcttttttagtttcctgttctctcttttttatgctttctttagctctatactcctttacttttttttctcttttctctgttctctacctcttcatcttctattcttttataactatcgtccttattcttctctccctcctgctctccttttcgtcc

SEQ ID NO: 224210 - DNA, 432 bp, Homo sapiens
gtgatggcatccggtttctgtgttaaaaaatgacccttcctgctgtgtggagaatcgaatgtagtcaggggtgtcagtcaggagacacattcaggcagccagacaagaggttttatgaagtaaataaagtggcagagagatgacaagaggtggagggatttgagatgtgttctggatctgcctgctgattgcacatagttgctgaggagcggacgagaaatgcggagggctttgatttttggcttaagaaacttggtgggtgctgagaagaaggaagtgggagagggagtggtggtaggaagtcaagagtcctggttgggcagtacttggtttgcagtgagtaggcatgtgaagtggggagctcggttaggactgagtatcttctctacatcatccaggtgctatttagagccttcatgggagtgcatttgg

SEQ ID NO: 224211 - DNA, 388 bp, Homo sapiens
ggaagagattagcgtttgaatcagtcaactgagtaaagaagattcaccctcaccgatgtgggctagcaccatctactccattgaaggcgcagatagaacaaaaagggagacgaaggatgaattctctgccttcttcagttggcacatccatctcttcctgccctcagacatcagtttccagttctaggccttcagactccagggcttacaccagcctctccaccctcaccctggttcttggagtctcaggcctttggcctcagcctgaattacaccacaagctttcttggttctccagcttgcaggtgttttattgtgggacttctcagcctctgcagtggtatgagccaatttccataataaatcccctcatctatttatcgctaaa

SEQ ID NO: 224212 - DNA, 392 bp, Homo sapiens
cagtgcttggcaacaggaggggctcaactgtgtgtcattatcatcgattcagcccccatgtaccattctgagaaccccacctccgctagaagtgagcctctctcctctgagccctgaagttctgtctgctcctccattcagcctccctgggctgaccttggggcagatcctgtgctgggctctggaacatagagcagaaggagtggtccttcctgcaggagacacaggctcattgggggatagccacaggctcacaaataggcatgacacaaggtggctgggctagaagaggagctaaaaagtgacatttcacattctgtcacactctaacaagattttttttaaaatctggctctcttcctactgactaaaagtggtttaactaactccta

SEQ ID NO: 224213 - DNA, 417 bp, Homo sapiens
gattacaaagaggtctgacttttggggtgctgctagctgataaagaatgctcattaagcaagttgctctctacaaattactctcactgcatttcataggcaccttttcaaacagataaaatgtttgggtgtataaatctcagaatggtaggaaaagaacagaccagaaattgtggccctgtgttgaaggtgatggtaaataaaatagttcttgtcatatactatgtggcataagttagggaaggacgaacgcatttctcgaagagatgtgaggggtaggggtggttgagagggtgagagaacaccttggttcttgctgcagtgatccagaaatccaattcctgagtaaaatgcagtcttcttaaacctcttgcgttcacccctgattttcgtactcatgaggcccatatgtgcatta

SEQ ID NO: 224214 - DNA, 171 bp, Homo sapiens
cgggggggagccttgaaaattcgtggtttctaatcatccttcagtcatccaccagttgaattgtattttcaacctggaccagtttttaatatacagggacccttttatctggagcccagggttctgggtttggatcctggctctatctcttacctgctatgtgggcttggg

SEQ ID NO: 224215 - DNA, 162 bp, Homo sapiens
ggcagaagtggatcaagtcaattgaagtcagaggggattgcaagcccggggcttcagctaagagaccctgctttcatccatatgaaggcgtatggctccaggaatggagagtcacagaaaccgtgcagagcagggggtggctgatgctataactgataggag

SEQ ID NO: 224216 - DNA, 654 bp, Homo sapiens
agcccaggaagaataaagcttactcaagactgcaaagaggccaacacactagaaatcagaaatcttgactcctagcccaccgtcccctaaaacatgggcttttttcttacacagagatgaagatggggtaaaaactaaatacatgagtttttaaacactgagatggaaatgtccaggtgacatacatgccaaaatgtatgtagtgacctttcagtgaaaaagaaaaaaaaattgagactagaactccattataaaaataagagcagactgacttcatccctgacatctattagcatttatgcattttactcactacgttctgagggtgctatggtttgaatgtctcccccaaaagttcatgtgttgaaaacttaattgccataggaacagtattaagagatagggccttaaagaagagattaggccatgaggactctgtcctcatgaatggattaataccattatcacaagggcagttattatggaagtgatttcttgattaaaaaaaagaaagatgagttcagcccaagttcttctgtgctttgcatactcgctgctgcctttctgccttctgccatgggataaccctcaccaggtgccagtgccatgctcttggacctccagaactgtgagccaaataaactggtctttatc

SEQ ID NO: 224217 - DNA, 408 bp, Homo sapiens
agaccccagggtaggtacaggcaggtgaagcgggtatatgcaggtgtagtgggtatatgcgggtagagggtatatgcaggtacagcgagtacatgtgggtgcaatggctctgtggacacacaggccctcccctgactgcctgttgtcccagcctgagtatcagttgtgttctgaggcttctattctgctgctatgggtcagaaggaacaacaatttcagccccagggcctagtgggaggagtcaggtccaagactagcctgaccaggagaatgagacgtgggaagagttggggaaagtctgggaagctcagaaaaggcactgcccctggaggcccatgccctttaacatgggagaagctggtgcgggggtgaccacaggcagctggaacctaccctccttttctatgc

SEQ ID NO: 224218 - DNA, 388 bp, Homo sapiens
tcctgatcacgtgcctggccctgagcatccacattgccttctagatttccaaaactattgtcacagccctgaattccagagggtgtcctttccaagtcttccttcctagggtttttcaacaagactatttttgccccaactgatatccttttctcagatgagtggggtcagccatttccatttaaatgtttttaacaggcatttagttattgatttgagatttttctgctttttcattgatggaattctgctgtaagcttccttcagagcatggttttcaattaatcctgtaagttttttttttaggttttgtctactttttcatttatcttaaaatactgtcttatactacttgtggtttcttttttggccttttattattttggaa

SEQ ID NO: 224219 - DNA, 463 bp, Homo sapiens
aaaaagtgcgtgggagccttgcttctcaaagtgaggtccaaggaccctcagcgtctgcatcatctggtttggggagcttgttagaaacgcccagcggcaagccgggcccagccctccagcaccagcaccgcattcaacctgatgccaccgattcctgtgcacctgagaggccccatggctgagccgtcccctcctccaccgcctcagccctgccagccccctggaaagatggtggaaactacagaccccctggcctcaccccggggatgcaggccgtgctggtttggctgagcctggtgcctctgtgcttctctagggctctgcaggtgatgctaaagtacagccggctgagaaccgctgccctgggccagggccgtccaatagaaacacagcatgagccgaagatgtgcttttcattgtctagtggccacattaaaaagatgcagatgaaactcaaagcggg

SEQ ID NO: 224220 - DNA, 360 bp, Homo sapiens
gggaactactttcctgaaacttgctatgctgcacatgacttcgagttgcagtgattcgcccggaggccgcggcttttagtcctacccacacaccctcacagcctgggcaccccgctcggcagccccaccccgcgcccgctctggcctccggggaaagcgggcggccgggagaagtcgcgagggactacttcgcctccttctctcgcgggcgcccccggttcgggcagcggctgcggcggcggaaggagcgggcggcgtgagcgcttccgccgcccccctcgcggctcccctctctcgggcgtgaggagctggcccgctgagctgctggtgggcactggctggcggggaacctgcagccgc

SEQ ID NO: 224221 - DNA, 602 bp, Homo sapiens
tatttattttgttaaaacactaaaatagtatagaaatctttctgagcaagagttaacactaaggttaactctattattgcggccaaagatagagaaagaaataagtggagcattgatatctaatgattactataatggctgatgtactccttaaggaaagagttttattgccatcattatattagattttaatataatagaaagtaaaaacaagaaattgttcagaatgttgttaagactcaataaatacttattgaacatctatgtgttaggaactatgctagttgtttacacagatattagccaaacagaaacgctgaggaggggtacttccaagtgtattttacacaaagcatacaccaaagctgagagttaagtaacttgtccaaattcacaccactaataatgtagaagtagtataatagcaaaggtcttcactttaaattcagtgctttttctattatgtctggttttagtgctgtatttagggggtaacttttaaaaaatttaataaaactttattttgaaagaaggaatgatttgtgcagtgctttcttcgtttcggatgccaagaaagtatggtagcaagtgctaacttctat

SEQ ID NO: 224222 - DNA, 495 bp, Homo sapiens
ggaatgggaatgtttacccaatgcctataccaccattctatcttagaagtaaatagttaattttttatcttacaggattataggtagaaagaagatggcttgaatctcagatgagattttggacttttgagttaatgctggaacgagttaaaactttgggggactattgagaagggatgattgtattttgtgatgtgagaaggacatgagatttggggggccagtggtggaatgatatggtttggatgttttgtcccctccaaatctcatgttgaagtgtgacctccattactgaggtggggctggtgggaggttttggatcatggaggcagatccctcatgaatgacttggtgccatccccatggtaatgagttctcaccccggtagttcactcaagagctggttgtttaatagcctggaacctcccatctccctcttgcttctgctcttgccatgtgatatgctgggtccccttttgccttccactgtgattg

SEQ ID NO: 224223 - DNA, 223 bp, Homo sapiens
ggtgtcactttctccctcaaattacacctgtaaaaatctcttgctcatggtgggcggaacttcagggtctagctgactgcctagcacacggtgggaaattgttaggttgtttgctgaactgactgtaaagtgtcatagtcaatattcaagtgtaaatagcagggctttaggtgagtactgttttagtccctgtctctttatttctcacagctgctgcaaggga

SEQ ID NO: 224224 - DNA, 334 bp, Homo sapiens
tggagctggcttttgacaagatggacacatgttcctttttttctcaggaatgtggtgattctgaaatgcctggcccttcggctagcactcagacttctgtgtttatggaaggcagtgtggtcacatgtggcccccagctctgcccccatgctgagtcagaacacaactattaacgatagggcggggagatggcttaaaaaaatctgtggccgggcgcagtggctcatgcctgtaatcccagcactttgggaggccgaggcgggcggatcacgaggtcaggggatcgagaccatcctggctaacatggtgaaaccctgtctctagtaaaaataca

SEQ ID NO: 224225 - DNA, 523 bp, Homo sapiens
cacaaagaaggtgacaattaagctttccctagaagagtgaatcagatttcttcagagggagacagtgaaggtaaaagatcattttggttagcatgaggaaaggcatggaggtgtaacggtataagatgtttgggatgttgtgacattacattgcatcaagtctaccaataacaatatataaacatatctgtttcatactttgtaatgaaaccatctgttaattgagaccttacctcactttttattgattttccccttagtttagtttctttacagtcagatttttttaaaactgtaggtcataaaacaaatttagcagctctctaatagcatttctttaaaattgaatagcatagaagagactataataatgtcaagtagaaaaatatcagagtgcaatataatagtaaagtacgtaatgtttttgtgaaacatacttagtttatttgtgtctaagtgttctatgtgtctgttccataatgtatttcatattgtgggtcacaataaaaatttgaaagccact

SEQ ID NO: 224226 - DNA, 481 bp, Homo sapiens
agttcatactaaaagatattttgcaaatacactaaatgggaaaaataagcaaaatcccatttaagtaaacaatggaggatttgaaggagaaaggaatagagcacggacacgttcagaaatgacactgaatccctgtgttgagtctacagagacatctagacttaaaatagatcatttatatttaagtttaaaaggaggatgagactgagtttttgtagagttataattacattcaaaatatacttttttgcattgaaaaaatgttaaatttttgaaaagcgaatattgatgtcattctattctcaaatcagtagatgctgtgtcttcatttctagtgctgatgtgaaaacacatggtcagttgttgctgcgtcagagatatgagaaattcttttctcttaggtgtgcatcactgatatacttgtccgtgaaaggtgaaagacactgaaatgtaagatgcgtgagtaaaatcttggtagaga

SEQ ID NO: 224227 - DNA, 940 bp, Homo sapiens
agttcatactaaaagatattttgcaaatacactaaatgggaaaaataagcaaaatcccatttaagtaaacaatggaggatttgaaggagaaaggaatagagcacggacacgttcagaaatgacactgaatccctgtgttgagtctacagagacatctagacttaaaatagatcatttatatttaagtttaaaaggaggatgagactgagtttttgtagagttataattacattcaaaatatacttttttgcattgaaaaaatgttaaatttttgaaaagcgaatattgatgtcattctattctcaaatcagtagatgctgtgtcttcatttctagtgctgatgtgaaaacacatggtcagttgttgctgcgtcagagatatgagaaattcttttctcttaggtgtgcatcactgatatacttgtccgtgaaaggtgaaagacactgaaatgtaagatgcgtgagtaaaatcttggtagagaggctctttgtggttgttttatatacttgtaagtgatttatgagataggtgtttagaataatactcttctgttagggtcaccctgatcagaccgttcccttcccctcccacaggacttacaatacggtcccttgtgctctctgcacagctaccccagggcaaaaaacaaaccccccttcactgatccctccagtaactgtgcagacagttacaggatgcggttaacatgtctgttcacctcgcataacaaagctggcaaaaaacatctccaggatgcagacaagacacctgcaccctcgactaagctcccccaccccaacccagttctcctgcacccccaactcagctcccgcaccccgacctagttctggccctataaaaacctgctatagtctgtaagcagggctgcctcctctaactgtggtggagcagccaagcagctcaataaagcttgcttgcc

SEQ ID NO: 224228 - DNA, 590 bp, Homo sapiens
cacaaaaattctatgagcctgaattgcaaactaatccttacaaacaaacccactttgttaatctgatattccccaaaagcataatcaaatcacaattattcaaaaatgaattgtctatattttgttaagactttgcttccaaattcccaatggcattaatagacatatttgtttactgtagctcagcaagtattagaaagaacttttcaaccaaaagaaatagagctctctcctgtggaatcgcatatgcgctgcaagtttgttgagagaattaaatgcaataatgaacgtagtaaagtgctaagcttcatacctggcatatggtgagctcaataaatgttagctatgatattattatcagttatgtaaatcagttaaaaacaacaacagttcttcactgtttggtgcactgcatcattccagagaggtatgaggtccattcccaacaagtatggagaggagaagagagacaggaacaggccaggaaacagaaaacttcccagctagagccaagccatgccttcacagaagtgtccgcttcactcagctatgtgtaaccacagctcccaatgaccaattactcagaagga

SEQ ID NO: 224229 - DNA, 526 bp, Homo sapiens
ggtccacacatctcatttcaagatccaggtaatttttctggattagatggttttcacggtagagggcagaaactcaagggaggacagagccaaatttagccaatgcacttaaagcttctgtgtagctgtgacacaccctgtgagcccatattccataggtcaagacaaattgcatgggaaatatgatgaggaaagaaaaaataatgagtaattcaacctactacaccccagatatccacgagacttactccttacttccttcaaatctttgttctaatatcaccatctctgtgatgccctccctaattccaccctatttaaagttttattactcttctattttctgtttcccttccctgatttatttttgttcctaacacttcatactatctgacatattatctaatttacatatatatatatttttattttatttactgcctttcccaactagaatatttgtaagcaccacaagcccagagatgttggtttttgtttattactgtgtactcagtacccagaatag

SEQ ID NO: 224230 - DNA, 456 bp, Homo sapiens
ttttttggagacagggtctcactctgtcacccaggctggaatgcagtggcgcgatcttggctcactacaacctccacctcccaggttcaagcaattctcccacctcaacctcgagtagctgggagtacaggcacgcgccaccacgcccagctaatttttttatttttagtagagacagggtttcaccatgttggccaggctggtctcgaatcctggcctcaagtgatccacctgccttggcctcccaaagtgttgggattacaggtgtgatacaggtgtgagccactgcacccggccagaagatagggtcaaacatcaaaaacagcaaggtctgatctgatgcgaaaaatctctgaagcattccggttgtttgttaatatataaatgaagcacctataaaatgatggatgttgtcaagaatgtatcgggccctaatcttaggtggtttaagccaag

SEQ ID NO: 224231 - DNA, 755 bp, Homo sapiens
aaacaggattgagtgaaccggacgctaccgtgagtttattctcccagggcatacataatctcatgtgattaccacatagccctgttagataatctgttatcctgtcctcattttacccatgaggaaatgaaggcccagagaggttaaatgacctattcaaattcactcagaaggtggcagagatgagttactatcattgtattttggatctctggaaagaaagaaaactagtgatggtattaaaaaatgttattaatagtttcttttaatcaaccaggaacttgagtcactagcttctctgggtgaaggactatacttcaacagtatgaaaaacggaaaagaaaatgaggaattttggctgggcacagtggctcacacctgtaattctagcactttgggaagccaagggaggagggtcgcttgagctcaggaattcgagatcagcctgggcgacatggtgaggccccatctctacaaaaataaattagctgggcatggtggtgcatgcgtatggtctcagctacttgggaggctgactcaggagggtcactgcaacctccgcctcctgtgttcgggtgattcagcctcccaagtacctgagactgcaggcgtgccactaccgtgcctgactaatttttgtatttttagtagaaatggggtttcaccgtgttggtcagcctggtctcgaactcctattctcaagtgatccgcctacctcgaccttcccaactggccgggacctctagaacaccaca

SEQ ID NO: 224232 - DNA, 406 bp, Homo sapiens
aaacaggattgagtgaaccggacgctaccgtgagtttattctcccagggcatacataatctcatgtgattaccacatagccctgttagataatctgttatcctgtcctcattttacccatgaggaaatgaaggcccagagaggttaaatgacctattcaaattcactcagaaggtggcagagatgagttactatcattgtattttggatctctggaaagaaagaaaactagtgatggtattaaaaaatgttattaatagtttcttttaatcaaccaggaacttgagtcactagcttctctgggtgaaggactatacttcaacagtatgaaaaacggaaaagaaaatgaggaattttggctgagccgaggggcccggccagactattggtttgggttgatttggccg

SEQ ID NO: 224233 - DNA, 556 bp, Homo sapiens
gagaatacctccctccaaattttatccaagaaccagccaatggccaaaccccactcaaaagagaaaacatgaacactaaaatattccatgtactgaatatttttaaagcaaagttaggattttctaggtttgtttccatgggggaagagggtggtaattaaatgatttacagaagaattttacaacctcttcattttacagataaagcaagcaagacataaagaagcaaatggttttttcaaagtaaccctgatagtcaatagcagaaccaaaaccagaatgcaagtgaaaaaatccagatttgccaaaaccttcctattggctctatgagagactaacttctgagtccgggctatcctgatgatactgacagggtccccaaaagctatcatgcctctctgagtatgttctcttggcaacctgaaatcactctcttccttagctcctctaccatctgtaattaattattctataacttttattgaagactttctcccctgcaatagtagaagctctactattatgctgggaacataataaatgtttgaaaatattt

SEQ ID NO: 224234 - DNA, 276 bp, Homo sapiens
agtaactgaaaatcactttattccagctggcctatttccgaatggaaaatattagtggtctttgatagtttagagaaacatgagggccatttaatgtcattgctacaaccaggctgctcttcaccgtgtttgggctgctgtggctctactggttgataaaatattgaaacactttcttatcagttgatgaataatacaacagtaaccgtgagaagtggtaaaactaacaatataattttcaacataaactcattcaccctagctgattttgtagga

SEQ ID NO: 224235 - DNA, 274 bp, Homo sapiens
gagcacgaggcgtgagtcactgtgcccagcctgttgtatttatttttctagattacagttaattttgttttcatttcttgaaacctagtagaatatgtatctgcctataattcaagggcaattgaaagaaagaaaaataactcaaggccaggcatggtggctcacatctgttatcccagaactttgggaggctgaggcaggaggatcatttgagcccaggagttcaagaccagcgtgggcaacataatgagactctgatgctacaaaaaactta

SEQ ID NO: 224236 - DNA, 640 bp, Homo sapiens
tcttatctttctgaaggatgcccagatcaaaattgttgtgagcaattaaaaaaataatttaagacctgtaatttcaatatttttgatatctgttagattaaaaaatgttatttttaatgtgccatttataattttaaagaacataactttgatctaaaagtaaagtcattgtaatttactagctgcctataaaagtatttttaaatgtgttttcccatatgaagatagtaatatttattaagaagaaccgcttcttaaggttttaacagacctaaaacgagtcctacagttgagaatattgtaatatacatcatacttctaaaactttatgtcatcattacacatgagaatatcacagataaatatataatatgtatacaataaatatatatgatataaatatgtaattatgctactatatttatacaaaatgactgaactctgtgtgtgtaatatcccataggagacagacagacagatatcattaacttaaaatcacattaagaacatgaaatttgtaataacttgctaagggttgatacagactatcaatgtcatatatagaacaaaaaagtgtttttcaaaaatagtagctattatatttaatgttctcaataaattaatattagtcagggttctc

SEQ ID NO: 224237 - DNA, 441 bp, Homo sapiens
tgtcaggtaagattgcaggtggcagatgtcacctaatatttggatgaatattttcaaaatcagttttttcctataaacccctaatggattatagaacaacttccaagcctgtgctttcatgagtaacttaagttcttaactgcagtatcactgaatgtgagaagagttgcaagtaatatgctaaaaagctttcagatcttttcttttctttcacagcaaaaggattatagccaatgacatggctagttacatttcccagcctccttcccagttaattacaaccacatgagtagtttttctccagtgtgagttggcaggatgtgtaccacttctgggctggtcttttgagaaatcaggtgtgccttctccatactttttccttcccctggctagagagaaatcatgttcttgtgtttttctgcattagtgacagtaaaaaaa

SEQ ID NO: 224238 - DNA, 473 bp, Homo sapiens
ggagacaattattcatctaccagctttatacaggaagtggtccaactagacttccgatgttgatggaagctttatgtcaccacaactgggctttacgtcaccagaattgagcattcatgaaagcagaaactcagagtcactgggggtgggtgggaaatggaggggtctgaatgtgtcctcaggcaaatgctggctttgttttttggttacttcttagatttcccacttttactttgatttttttggcttttatggctacctcagtttccttgccatgccagagcaacattaaatatgtgttatacttccttttttaaggcttaagttatttttattgattgaaacatttaagagagcaatgttccattgtgccacagattttacaattgttcttagaaaatacaagttcagtcttatctaatataatttacctctattccctgcagttgtaacatcaaaactgaaattcttac

SEQ ID NO: 224239 - DNA, 314 bp, Homo sapiens
attatgttgctttaaaaataaaataatatagggaaatgcatgtgtcataaaactattgaaagaaagataccaaggtgtatatacagaatgctttcatgtatcaaaagcagggcacagcctgggcaacacggcaagacctcatctctttacagaaggtaaaaaattagcaaggtgcagtggtccatgcctgttactcgagaggttgaggcaggagaatcgtttgagcccaggagttggaggctgcagtgagctatgatggcaccaccgcactatagcagcctgggtgacagagtgagaccctcatctctttaaaa

SEQ ID NO: 224240 - DNA, 425 bp, Homo sapiens
aagtggttagaacacagggcttctaatccctaatcctcatgtatgttttagccatcagaatcggatattaagttgagccttgattctggccacaaaatcatttcctaactgtagtcaagtctgagtcctggccctggtcacagattaagccccagtgtggccacagatggcaccctaagtccaggcagctaatacacaaatgatcattatcagatggattaagtcaaatacattctcacctctggcgacacagttcaaggcctgcgctttactagaggtgggtcagtagctgtgccttttgtctgtgaaggacagtgcattattgatatagcaatatgcttgtcagtgtttcttcttcaattgtctggctgcagagagcacaaatactttattgccgtggtagacagtcttttcctgaagaagat

SEQ ID NO: 224241 - DNA, 492 bp, Homo sapiens
gttttaaactgatatcattgttttctattatataccagttttgatatataatttatgactggtgtattgctgctgggtttggggtagttgagagagttgatcagtaacttgtgtctggtattctctgaagggaacataaatgttctgtctttatgcaatgagtttttttttttttttttttttgagacagttttgttcttgtttcccaggctggagtgtaatggtgcgatctcagctcactgcagcctcagcctctcgagtagctgggattacaggcacctgccaccacacccggccaggtttttttttatttttagtagagatggggtttcaccatgttggccaggctggtctcgaactcctgacctcaggtgatccaccttccacggcctcccaaagtcctgggattacaggcgtgagccactgcaccaggccgagattttctttttcttttttctttttttttttttttttttttttttaactaacagt

SEQ ID NO: 224242 - DNA, 256 bp, Homo sapiens
caggtcttttcatacttcaaaaccagcattccccaaccccatccctccccatcccatgattctgttgggaatgagtgtggcatgtttatgacatagtaattttaaaacttcacccatacaacaactgacataagtcaagaagatagaaattttatttaaaaggctgtcaaatgtattttcatcttttttgctttgatgatgggttacaaatagcgtatcgtttgacaaatgcttatactctgtttcttggatttgt

SEQ ID NO: 224243 - DNA, 594 bp, Homo sapiens
aaccccatctctactaaaaatacaaaaattagccgggtgttgtggcaggcacctgtaatcccagttactcccgaggctgaggcaggagaatcacttgaacctgggaggcagaggttgcagtgagccaagatagtgccactgtactccagcctaggtgcagagctagactatctcaaaaaaaaattagttttagagcagatagcatcatagttactcctgttagtctttttgttctgttttgttcatttaatttctctgaaactgccagtgtcattatcttttaccacccagttcatgatcagcttggatccagtcaagcaactgatgtatttgagactgtttgagtacattttcttttttttttttcttgtggtatcacacttgtcatcgttaaaaacagtagatcttctggtgtcactcttgtcaccattgaaaacaatgcttctttttcaataaactttgaattggaatattttcatttcactgagatatctaatatgtataaaataaatagtaattaatcaaaaagtactgatatgaataaattatttgtatatacaccgaagacttagtaggtactaaaaggaagctaca

SEQ ID NO: 224244 - DNA, 146 bp, Homo sapiens
tggaaattgcttgtgaaattatttgcttgtctgtctcctacacccccaagtcagtgtccttgggttggggactacgtgtctgtcttattcactgttgtattaccagggccagaagggtcagagagatctctcttgagctccctggg

SEQ ID NO: 224245 - DNA, 648 bp, Homo sapiens
tctaacctaacactatttctggtgagaaatctgctgtcatcctttcttttgcccctctgtatgtaaagtgtacttcctccccctaccccgactgcttttaagattttctctttactactagttttaggcaattcaatttttcatgtgccttggtatcattttcttcctgattttcgtgcctggaatttcctaggcttcttaagcctgaatttatagttttcttcaaatttgcaaaagttttggccattacttctgcaaatattttttctgttcctactcattcttcttcaggggctccagttacatatatattaggctgcttgaagttgttccatagctcactgatcgctttgctcgttttggggcgtcatttttctctctgtttcactttggatagtttcaattgctgtctttaagtttattagcatttttctgcaatgtttaatctgttgttaatcctgtgcagtgtatttttattgcagacattatctttttcatctctagttgttttatttggttcttgttttaatgttttctgtgtctctcttcagcatgctcatgcttttgcccaccttcttgagcatatggaaaacaattataataactggcttaatgtccttttctactaattatattatctgtgtcatg

SEQ ID NO: 224246 - DNA, 427 bp, Homo sapiens
caacttagagttttataaatgtaaatattaaagttttgtgactgtaaatgtgaattttataacacctgaagattttgattctttctagaacaaatgtgtaccctcaaatacttcagaatgaatgaagaaagttcaaatgtcttctgcccagcctcttttgatacacactaaaaacttcagaatcgtttttgtaggttttagaaaaatgcgtgtttgcacttgtgaaaaaagaaaatcattggattcgcatttcactgctggccttgtgcgggcctttgagtgaaccagaaggttctccccatgagtcagctgggaattgcttcaaatgccttccaaagcaaccaagtggcttaacgaatgcagtcctccgtaggcacggggaacactggtgtacagcacaccctttaaaatggctaaatgagaacca

SEQ ID NO: 224247 - DNA, 905 bp, Homo sapiens
ttatttctctggttttagtattctgtaatatccactcaaccccatctaccagtggtttatgtcaattagtatgttttcaaaaatctcttggatttcctaatcaacatgttcattagaggtattgtttagaagtcactgatcaaattctgagaacaaaaggcgcctgggatgctgattaggattacattatatggatatatatgatgaggtaggattgccacttttatggggttattgggaaatgtttacctttcaagttctgatttccatgagtgggattttccctatacccattcctagcttctctgccacattatgcattctgccccaggcatgaggaagtgggcttatctagttggtaagatagtgatgggtaactgggtttgctcagctgaactccctcttcattgtgggctgacctgcaagtataatttcttgtcacagatattgcctgtgattggtaaattggtctaattctgtcattcagctaattggcccattagctgaatggtcacactaagttgcatcctccaactcaatttgatcagtaataaaagtttcatcctgccccctgtctgctacttaattttttatcgtttagatggggggaaattgtgctatttatttggggcccttcagagaacccaatatgaacatgatttatctatttattcagtttttatgtccttcaggacagataaatgtatgtatacacacatatacatgtgttaatatatgtaagtatatacatatgtttaaatgtatgtgtatgtgtatactgatcttgctcttttcctgtgaaatgtattaatagtcacttcaaagatttggttgctattgtgaaagaaattaagttacctttcactttgaaactaatagagtaaagaaaaacaaaaatacctaag

SEQ ID NO: 224248 - DNA, 971 bp, Homo sapiens
ttatttctctggttttagtattctgtaatatccactcaaccccatctaccagtggtttatgtcaattagtatgttttcaaaaatctcttggatttcctaatcaacatgttcattagaggtattgtttagaagtcactgatcaaattctgagaacaaaaggcgcctgggatgctgattaggattacattatatggatatatatgatgaggtaggattgccacttttatggggttattgggaaatgtttacctttcaagttctgatttccatgagtgggattttccctatacccattcctagcttctctgccacattatgcattctgccccaggcatgaggaagtgggcttatctagttggtaagatagtgatgggtaactgggtttgctcagctgaactccctcttcattgtgggctgacctgcaagtataatttcttgtcacagatattgcctgtgattggtaaattggtctaattctgtcattcagctaattggcccattagctgaatggtcacactaagttgcatcctccaactcaatttgatcagtaataaaagtttcatcttgccccctgtctgctacttaattttttatcgtttagatggggggaaattaagtagcagacatggcctgccccctgtctgctacttaattttttatcgtttagatggggggaaattgtgctatttatttggggcccttcagagaacccaatatgaacatgatttatctatttattcagtttttatgtccttcaggacagataaatgtatgtatacacacatatacatgtgttaatatatgtaagtatatacatatgtttaaatgtatgtgtatgtgtatactgatcttgctcttttcctgtgaaatgtattaatagtcacttcaaagatttggttgctattgtgaaagaaattaagttacctttcactttgaaactaatagagtaaagaaaaacaaaaatacctaag

SEQ ID NO: 224249 - DNA, 632 bp, Homo sapiens
caactttactggtgactaggtgcagctattagaatgaatacatctgtaaaatgaagtcagcgtttcacttctgttcccttctgtctcacttggggactgtggcacagaagctgtgatgtgctgtaacgtgaaacctgagtgtctttaccggatgatccagcggtgggcgttgtccactctgacggtcagcatcctgctcatcccctggagaacaagctggatgtgtgtccaagcctgtggctcctgtggcaggtctgtgcccacaggaaggctgatgagggagctttgggcccatcattgctgtgggcatgtggacacttgacactggccctgccattgatcggcccagggcgtggtcaccctcctttcctggcccctcacagacatgccttcactggcttagggaggcagtggaatgagaggctcccagcccccaaaaccagtgctgtgtgctcgacacacgcagtttcatctgaactgtatcattggccccagcagggtattgtttgcctcatacgatggacaaacgcgctgaggctgaagcatgtgaaacttgcaaatgtggagctgggatttgagtccaggttgttagaatctaagccctgtgtattaaccaaattgctgacttttaa

SEQ ID NO: 224250 - DNA, 341 bp, Homo sapiens
ctcttttaaaattaatgttttacacctattctgccccccaaaatttaatgttttaaaagactgagttcttcgcattatactattaacaaaaaatagttttgtatatgtatcttgcattgaaatgcctgagttacgtacttagtaaaggtaaatacagtcatgtgccacataacgacatttcagttaacaatggaccacatatatgatggtggtcctgtaacattacaatggtgctgaaaaatccctatcatctagtaatgccttgatgttcctgaccctgtgtaggcataggctagtgcgtgtcttggtttttaacaaaaaagtttaaaagtaaaaaaaga

SEQ ID NO: 224251 - DNA, 494 bp, Homo sapiens
ttgaactcgggaggtggaggttgcagtgagccaagatcgcgccattgcattccagcttgggcgacagagcgaaactccatctcaaaaaaataaaaggaagctaacacagagtataaatggtgcaggcagtttgacaatatcaaaatagaaaatacacatgccctttgatttctccctcttatgcaggtggatctatagattcaactctacatgttggaacactatagtattatttgtaattaaagcatttggaaacaacctaaatgctcatggtaggggactattaataaaatacggtaaggctgagtgcagtggctcacgcctgtcatcccagtactttgggaggccaacgcaggaggatcacttgaggccaggagttcaagaccaacctgggcaacatagggcaacatagcaaggccccatctctacaaaaaattaaaaattagctgggcatggtggcacacgcctgtagtctcagctattaatatttggga

SEQ ID NO: 224252 - DNA, 566 bp, Homo sapiens
ctagagctggagcctcaaaataggagggataataaatatagggttttactttgtgcctgactttttgaaaatgggatggggggcaaaacctagtattgaagcaggtaagtgggttctttccgtgttacagcagatgagggtgatgaggagctcttggagtcctggaagagagagcagcctgtgctgacagagttaatgagaggacagatctaggagtaacagggtctgaggagaggagatggcctcccagaccatgagaactaacagttgtgataaatttaatcatagtctgtccaaaccagagagtcctcaagtgtggtatgagaatcctgggtgtggggcagtgagctcatttctgctcttgagaagtgtaggagatgcagcaaggttcctgctatcaggagacctgcaaagatggaaggaaacgttcctctaagttattacttgtctcacctcctccctcccccaaaggaaggggaaagatagacacctcggggatttgaattagaaatagccctttggagggtttttttgtttgtttgttgttgttattgttgttttccatt

SEQ ID NO: 224253 - DNA, 364 bp, Homo sapiens
cccaggtctgtccacatggattttaggccttccataacaagttactgctaaacagtcctaatagtcctattacccacagcgggtggggaaaccctaacaagaatgcagggctcttgtttgatgcccatgctcagctcttgggggccctgaacatgtctttggaactgctagtggggaacgttcccagaaatcgagcaaccaaaccacaagcaatgaaggcagggttccccctgggagctgtctttcaggacctagcagacaggacattttaaagtgcagaaagaaattcctttgaaactttcacatgccatctataaagtgcattctcaatactggatttaattttaactaagtaaatttatgt

SEQ ID NO: 224254 - DNA, 510 bp, Homo sapiens
cattttcacaatattgattcttcctatccatgagcatggaatatttttccatttgttttcgttatctctgatttctttgagcagtagtttgtagttctccttgaagaggttcttcacttcgttagctgtatttctaggtatttgattctttttgtggcaactgtgaatgggagttcattcatgatttggctcttggcttgcctattgttggtgtatagaaatgctaacaatttttgcacactgattttgtatcctgagactttgctgaagttgtatactaacttaagaagcttttggtctgagacaatggggttttctagatataggatcatgtcatctgcaaacaaagatagtttgacttgaaatggagcatttaagaaaataaaaaataaagtattcattaatgttagtacagttaccatggattttaaaaataaaagttgactcttacttcaaaccacacacaatacattttagataaaagaactaaatgtaaaacataaacaaacc

SEQ ID NO: 224255 - DNA, 492 bp, Homo sapiens
ctgaaagagtaggttaattaaaattagtgcattttctgaactggaaaaggaaataccgtggtgagctagtctatcagagtctggcagtgatttcagccaaagtaatcaaagcagatgggcattcagaaatgaccccaaaagactttatttttatggtcatatactgagtcacagagcttaccatattatctttattcaaaacattattatcacatgaatatttgtgcagactaaatataattgcataacttcttgagaattaggcaagttatctattatacctttctttcaactcatttgcctcacttatgaaataaagataataataatactcatctcctatgatttttttaaagattgaatcaaataatatataagatagaacattggcacagactaaagctttcaataaatgaaaactagtacgttttaaaatattagctgtgctttgacgtttttggtatagcccccattaaagacgtttacaattta

SEQ ID NO: 224256 - DNA, 399 bp, Homo sapiens
gccaagaaacttcttcaagctcttcattgccatcttctatcccccaactgactgaaaagcactggttaaaagaaaagcacattaattttttttcagcaaaaccaaatatctccttttctagtatgtctcatctttgtttcatatctctcaatagctttctcctttatcttgagtttctttccaactgtccaaactccaaagacttcaagtttcaaaaccacattcacttatattcagcaatagagcatcaatctacttgctttcttctaatgataggtttttcataatttattttattttattttattttttattttttgagatggagtctcactctgtcacccaggctggagtgcagtggtgccatctcggctcactgcaacatctgcctccccagtt

SEQ ID NO: 224257 - DNA, 325 bp, Homo sapiens
gcacgagctgctaagaggttgttaaaaaagaaatggctactttttccagaaataattgattttggtaataataactactactaataactacaattcataaagtgcttatactatacccgacattgagttgtgttccttcgtctacactctaacttaatattcacaataattcttcaaggagctattgttatacctattttagaaatcaggaaattgaaacttagagaattaagtaaccccaaatcaggagtcaataatgattaggcagatgggactgagaattcagatcttctctgtgccagggaacttcccagccataaagaaa

SEQ ID NO: 224258 - DNA, 408 bp, Homo sapiens
ggggaatttctcagcagaaaccttactggctaggagaaaaggggatgtatattacaagtacaaaaaaaaaaaataataaaaaaatgtaagccaaaaatactctacccagcaaagctatccttcacaaatgaaggagcctggcacagtggctcacatctgcaattccagagactcaaggctgaggcaggaggaccatttgatcccaggagttcaaggctgcagtgagctatgatcatgccactgtactccagcctgggtgacagagtgagactccattgctaaaaaaaaaaatagtaataataaaagggaaaaaagtatttcccagataagcaaaagactgtttgtttgtgtcttgtttgttgtggtcctataagaaatgtttaagggagtcctacattgggaagtgaa

SEQ ID NO: 224259 - DNA, 706 bp, Homo sapiens
aggttagggtctaaatgtgccagcacagtccctggcacaaaacaggcccccgagtacagtagccattattactaaataataaacacgatgatgaggataatgatttttgttcctcagcccttgcttttacttttctgactctaacactcaggactaaacttggtcaaagggttaaaacaaatagagaagggaaaagatttcatctatgagccaccaaggtcatgggtatttggccgaaacacttacctcttcaaggctttgcatctgggtctttcatccccttgcttttttgaacactgtataccctctgtgaatgtaaaaacatttgaagagtatcaagcactccacgggtagtggcagttgcaagaagtctggtccatttttctacctttcacactgtcagagcacgagaccttgggatttttataatccaaattgatactctctaggaaatctcttccactccagctccctgccctggaaagattcattttcttgtgggcatttctccagccctggtgggtaacggtgactgagggtgaattcctaaccttcccttgataaggttcaagtcttgctaatttgaatctctcctattttgctcccatccacctggtgctgtttgatttatctgtgcttgtttgtggattcactgatcactttcttattactcttccacctccatccatttcagtttgcggtgcct

SEQ ID NO: 224260 - DNA, 225 bp, Homo sapiens
tatgaagctggcccgggaatggggagttgtagggaagctggggggttttattttgtttttgttttagtaaatcaaaatattccctcctggaattgtcagagtctggaaaagagaatctttataaaatgtaaattacctcctggatgttaatttttagtagcagtgggtgatttttagtggcaacacaagtctgatacgatgtacctacatcgttttattttagag

SEQ ID NO: 224261 - DNA, 710 bp, Homo sapiens
actcctctgggggttgaaatgaggaacttctgaatcagggagctcatgctcaaccctggctgaatccttgagaggactcagggcaagcagaacatcaactcctccttcaaggggaacaaaccataggctgaagggaactttagagctgcactagcctggctttcttattttaccaaggcataagcacatccaatgggagaaaatgtcttcactcagtggcataaaacacttcctgatgcccaaagtccacctgggcaaagtggccaggtggatgaagttagtgtcttgaagcttcttgttggctctttcactggcccttcctatgccatcgcctctccccccaggatcagggatgtcatccctcaaccctgacatggctcatgcccaggtctgcctactcccacagtaaaatgctgtccaacctccctttcaaaattacctccgctggggaaaatgcttatcatatatttgtgcaaagttttagcaaggcagccccatggtatctagggaggtctgaaggatggttatctttgggggcgcagttatggatcattgctattttcttctctatacttgaagtattttcatgttttattttaaattttaacaataataatgcatttatttatatgcttctttttaggcctcttctcagcacactgttccaaccaaaattgatctaataaacgtatttattttaaagcagcaaa

SEQ ID NO: 224262 - DNA, 644 bp, Homo sapiens
cggtaagccaagatcgtaccacagcactctagcctgggcaacagagtgagactgcatcacccccaccccccaaaaaaataaatacacaaagtatacagtaacaacttttaacaaaataagattgaaaattagctttagaggctgggcacggtggttcatgcctgtaatcccagcactttgggaggctgaggtgggcggatcacctgaggttggaagttcgagactagcctgaccaacatagagaaacccagtctctactaaatatacagaaattagctgggcatggtggcacatggtaatcccagctactctggaggctgaggcaggagaatcgcttgaacccgggaagtggaggttgtggtgagccaagatcacaccattgcactccagcctgggcaacaagagctaaactccatctcaaaaaaaaaaaaaaaaagctttaaatatttgaagaagtttaaatgtttgttactttgctttatcttgagaagcctagttttaaccactgcttaaaactagtggtctccatccttttgtagttcataagtgtgatggttgagttttcacatgcatgtgtgagatgtgcctccctcaaaccttgttatgttggcacattacctgtctgacatggggaaaaaaaaaaa

SEQ ID NO: 224263 - DNA, 380 bp, Homo sapiens
aggtccccaaatttctgcttaaggaagaaagtctttataaggtgttgggcatatagtcccatgaatgaagggtcaggggggcctcatttggtgaattatatatttatatatggaatctcactccagcctgggcaacaagagctaaactccatctcaaaaaaaaaaaaaaaaagctttaaatatttgaagaagtttaaatgtttgttactttgctttatcttgagaagcctagttttaaccactgcttaaaactagtggtctccatccttttgtagttcataagtgtgatggttgagttttcacatgcatgtgtgagatgtgcctccctcaaaccttgttatgttggcacattacctgtctgacatggggaaaaaaaaaaa

SEQ ID NO: 224264 - DNA, 520 bp, Homo sapiens
  misc_feature (300)..(300): n is a, c, g, or t
gcaataacttatgcatacctgaagaatgaccctatggtctaagaagaatgtgtgttcagagctccaagctaaggaatctgggagtggccaacccagatatttcatttcttatctatgacgaacttttgaactgctcccacccccagcccatcctgtagaatgcaggccctacgaggcgatcaaagccctttgttttaggttaaatgaaggttgcctggtggaggttgctaggggaaaggtgttaagtaaaaatgttatataaactgcactccagcctgggcagcagagtaagactccgtntcaaaaaaaaaaaaaaagaaagaaagaaaagagtagaaggcccaagcttagtccaatattatagcttcagcatcagagtagagaatgattcagagcgtctgtccagtgtctgctgtagatccctcaaatccgtgtttggacgcttctggtaaggggtgtatggcagatgcacccgacagatgcacttggcagcagagtaagactccgtctcaaaaaaaaa

SEQ ID NO: 224265 - DNA, 453 bp, Homo sapiens
ccagaaatggagcagaactagctcaatggagcacataccgtccatgggattagttagtataatcattgctgaatgtagccttctctgttaaggtacagataattcctttcttaactctgtgcaagatacgctggtgagcatggttatcattcgacaatttgattgactctttgtagataaaaagaaatatgctccttctctctgagccaattctttctgagctgacctggcctttttaatgataaacctgttcgaggtttctgtttccagatattcactagaatttagggcaaagacacctactttggaagggggagactgtcacaacattcccattagataatgcacagtcatttcctaaaagtcttcaaaggaagaaagggatgcactaatgctgtgatcttttgaatttgtaagcagtaggatgcaaattgataattgacctacaggaaa

SEQ ID NO: 224266 - DNA, 602 bp, Homo sapiens
ctgataaaatcgagcaacccaaaatgtgagggctgggccattgatgtggccccatgagcagcagctgaagtgatagtcattgtagtctagtggaaccatcactgcactaggagtccagagatgtgtgttgtgggccactaactagggctttccctacccaacacccgcaccgtgctgacgacctccatgttggatagggaaacagttaagccctcttagctttcgtattctgtttctccaagtaaaagagcactagaagaaaataagatgggcagttgtgcatacggacattgattagggataggtgagagcaaggatgcatggtgggctggagtgaggctctccagaggtgctatagaacagccacgtgagttggctcttaggctcaggtccccagtattggcagttctgaatctgtttgcaaagcgatgcaagagaggtggtggagtaggaacaaattaaagcatgcctctgccttatatgtggcactgaggttgggcttgggtgtttttaggcaggcctaggttcagccttgaatctttaccctctgggggatcgtggtccacggtgctttattgcttatgcttcatttccacatccac

SEQ ID NO: 224267 - DNA, 308 bp, Homo sapiens
atatactagattaattcccctgttgccttttcagggacattgattcattcattacgttcctctggagtatcttcatcctcttaaaagattccacaaatccatgtttccctgtaataattctctttcttgaactttctagaaatgatatgcagtattccacttacatgctttgggtttttgttttgttttgtttttttggtcagacataatcttgcactgtcacccaggctggagtgcaggagtatagtggcatgatcttggctcactgcagcttccgcctcccgggttcaagtgattctcctgcctca

SEQ ID NO: 224268 - DNA, 436 bp, Homo sapiens
tcccaacagaatggaatatctcccttgacccagtgtgtttgattctttttggcaggacactgaaattctgaacaccgccgtactcacaggaaagacagttgccatgcctatcaaggtggtctctgtggaggagaacagtgccgtgatggacatctcagagtcggtggagtgcaagtccacagacgaggacgttatcaaagtaagtcattccacagccagctggatggaaccggtgggaacttcacttggacatcccgtttgctagggacatttagactgaaatacatgacgttcaactatacagaggcttatgtgcaacacacttccagctgatccactcaacgtgtccattgccatctctttgttttcacatcatgccaacctggttagggtttttggttcattcctgtctttcttcctttatttgacaattaaa

SEQ ID NO: 224269 - DNA, 152 bp, Homo sapiens
gtctttcttttctttcctctctcccttctttccttccttcctcccctccctccctccttttcttttctttcctttccttttcttttgttttcttttctctttcttcctttcttttctttactttccttctttctttcttttctttcctccct

SEQ ID NO: 224270 - DNA, 578 bp, Homo sapiens
tattataatacattattgtaaaacaaacaataaataaacagtcataaacctgccagtaatttcagcaaatgaaacgtggaacacgtcaaggccagaggatggaaaaggctccagttttgataaaaggaggcctgcttggcttggaatcctctctcctgctggttgggagatgcaaagatgtttccagagaggggctgatgaattgaggggaaagaaatgagcccagtatgagtcccctttcagggctgagcgtgtataaaaccaaacaacttggaaccgctccaagagaggggattaaagcaacatgttattctgagtgattgcttaatttattgagctgcggctggatctgtaatgaaatacagcccttgtaactgataacctcctgctgccattgaacttctacaattaaggaatattttctgagtttctctggaacggctctgaatttttagcctctgtggtagggtgcttctgaacatttgttttccaggcaattttttttgagtattaggctgatgttaataaataagcagcattttattgagaaaaaaaaaaatcggccctcgttgttctca

SEQ ID NO: 224271 - DNA, 368 bp, Homo sapiens
aaatgtcagctccaggcgggcacgcatctttgttgtgttctctgctgactatatcctcagcacctagaactgtgtctgtcacctaatagatgctcaataaacctgccagtaatttcagcaaatgaaacgtggaacacgtcaaggccagaggatggaaaaggctccagttttgataaaaggaggcctgcttggcttggaatcctctctcctgctggttgggagatgcaaagatgtttccagagaggggctgatgaattgaggggaaagaaatgagcccagtatgagtcccctttcagggctgagcgtgtataaaaccaaacaacttggaaccgctccaagagaggggattaaagcaacatgttattctg

SEQ ID NO: 224272 - DNA, 723 bp, Homo sapiens
ggctccaatcgaggcggaggctgcagggcccgcggggcgccccccgcccggcgcacgcctgcccggagcccgggaaggcgcagccctgggtgggggggcccgtgcacccccggaggcggcagcggcggtgagccctccccttcttcccgcctggcaccttccgccagccagggcagggatcgcggcagataaacctgccagtaatttcagcaaatgaaacgtggaacacgtcaaggccagaggatggaaaaggctccagttttgataaaaggaggcctgcttggcttggaatcctctctcctgctggttgggagatgcaaagatgtttccagagaggggctgatgaattgaggggaaagaaatgagcccagtatgagtcccctttcagggctgagcgtgtataaaaccaaacaacttggaaccgctccaagagaggggattaaagcaacatgttattctgagtgattgcttaatttattgagctgcggctggatctgtaatgaaatacagcccttgtaactgataacctcctgctgccattgaacttctacaattaaggaatattttctgagtttctctggaacggctctgaatttttagcctctgtggtagggtgcttctgaacatttgttttccaggcaattttttttgagtattaggctgatgttaataaataagcagcattttattgagaaaaaaaaaaatcggccctcgttgttctca

SEQ ID NO: 224273 - DNA, 684 bp, Homo sapiens
gacgtgcatgatgtgcggccggggaggcgaagaaactttttttccgacacgcaacccccccccctttccgcgcgcctggaaacgtggaacacgtcaaggccagaggatggaaaaggctccagttttgataaaaggaggcctgcttggcttggaatcctctctcctgctggttgggagatgcaaagatgtttccagagaggggctgatgaattgaggggaaagaaatgagcccagtatgagtcccctttcagggctgagcgtgtataaaaccaaacaacttggaaccgctccaagagaggggattaaagcaacatgttattctgagtgattgcttaatttattgagctgcggctggatctgtaatgaaatacagcccttgtaactgataacctcctgctgccattgaacttctacaattaaggaatattttctgagtttctctggaacggctctgaatttttagcctctgtggtagggtgcttctgaacatttgttttccaggcaattttttttgagtattaggctgatgttaataaataagcagcattttattgagtgttttgtgggaaccaggaactttatatacattgtttctaatcctgacactaatcctgtcaatatccagtgaaataacccctattattccctattttacagatgtgaagccacgagacgttaggtcat

SEQ ID NO: 224274 - DNA, 821 bp, Homo sapiens
ggctccaatcgaggcggaggctgcagggcccgcggggcgccccccgcccggcgcacgcctgcccggagcccgggaaggcgcagccctgggtgggggggcccgtgcacccccggaggcggcagcggcggtgagccctccccttcttcccgcctggcaccttccgccagccagggcagggatcgcggcagataaacctgccagtaatttcagcaaatgaaacgtggaacacgtcaaggccagaggatggaaaaggctccagttttgataaaaggaggcctgcttggcttggaatcctctctcctgctggttgggagatgcaaagatgtttccagagaggggctgatgaattgaggggaaagaaatgagcccagtatgagtcccctttcagggctgagcgtgtataaaaccaaacaacttggaaccgctccaagagaggggattaaagcaacatgttattctgagtgattgcttaatttattgagctgcggctggatctgtaatgaaatacagcccttgtaactgataacctcctgctgccattgaacttctacaattaaggaatattttctgagtttctctggaacggctctgaatttttagcctctgtggtagggtgcttctgaacatttgttttccaggcaattttttttgagtattaggctgatgttaataaataagcagcattttattgagtgttttgtgggaaccaggaactttatatacattgtttctaatcctgacactaatcctgtcaatatccagtgaaataacccctattattccctattttacagatgtgaagccacgagacgttaggtcat

SEQ ID NO: 224275 - DNA, 662 bp, Homo sapiens
ggctccaatcgaggcggaggctgcagggcccgcggggcgccccccgcccggcgcacgcctgcccggagcccgggaaggcgcagccctgggtgggggggcccgtgcacccccggaggcggcagcggcgataaacctgccagtaatttcagcaaatgaaacgtggaacacgtcaaggccagaggatggaaaaggctccagttttgataaaaggaggcctgcttggcttggaatcctctctcctgctggttgggagatgcaaagatgtttccagagaggggctgatgaattgaggggaaagaaatgagcccagtatgagtcccctttcagggctgagcgtgtataaaaccaaacaacttggaaccgctccaagagaggggattaaagcaacatgttattctgagtgattgcttaatttattgagctgcggctggatctgtaatgaaatacagcccttgtaactgataacctcctgctgccattgaacttctacaattaaggaatattttctgagtttctctggaacggctctgaatttttagcctctgtggtagggtgcttctgaacatttgttttccaggcaattttttttgagtattaggctgatgttaataaataagcagcattttattgagaaaaaaaaaaatcggccctcgttgttctca

SEQ ID NO: 224276 - DNA, 511 bp, Homo sapiens
catgtctctttttggggtgcctctatgataggtggtagaaatgaaaatggaattaaaagttttgtgaagctatagcactactttttcattgtgttcccccctgactttctgccttaggtgtttactttggtgagatatcctgggagaaattgaggtgaaaagaagcccgagttaggattagggaagagatgaagtagtcaataaaattcaaattcttgtattctgaaacgcaactattctttctccaacttggttttggacagaatgtcttagtgtagctgttaacaaagaaattgatgacaattaactcccatttctcagaatttcatcattctttgaaagtgtttatcatactcaatcttctaaaaatccttaaggcatactacagtgtagaggttggcaaactttttctatagaggtcctgatagtagcttgtttcgcttttgagggccatcgagtttctgtcacaactactcatctctgctgttgtaataaagactcacccatagac

SEQ ID NO: 224277 - DNA, 508 bp, Homo sapiens
tgctgcaggaattcttcctgtcctgggacctcaaactgagcagtggctgcttgctgcttagctcctgcttgctgagttcctacagagaaatggttcagagcataaatctcgctggaagggtaggaaagggggcttatcttgaagtcgaattttcatggaaaatgcactgttttttgcttacttgtatgttcactggggatggcttagggaagcctatagaagttcttttggaggggagcacctcctcttcccccaccaagtaccccttgaagctgacattgtcttcttgggcggggaagcaccaacagtcatagttactctaaggcataatttgaaatttgctcttcacaaatataaaaggccttaataactaggtcaaagcgtaacaatcattgctgtatgtctttgcatgacaaatgaacaaagatgcaaaaatttcaatagcacccatatatacaaaaactcattacaaaaatggagacttgtcatgtttggaacaagaattaaa

SEQ ID NO: 224278 - DNA, 653 bp, Homo sapiens
ccaagggctaggtcttcccttgtgaaatggagtggtacctgcctgctaaggaacagacccacctgcctgctgtggttgtattgccagaagtgttggattcacatcttggctgcgctttgtactgatggtgtaaccttgggcaaatagtctcccctctttgaacctctgtttactctggaaaatgcccaagtctgcagattttggatagaactaaatgaactagtagtccagcaacatgatacctgccccggggcaagctcagtaatgactgtctacctgctggcctgccttctttcaaaccatgaccctgcctgtcctcggccataccctgacccagatgtgttctttggagggtctgctgctttggagttgtcctggacggggaggatctcatggtgcatctggctctgatgtttgtcttctggggcttcacctcccctggtgggtgagcactgaagggtaccggaaagtgggttccatggagttttgtgcctgagcagctcagatgggggccaggtgctgtggctcacgcctgtaatcttactactttgggaggctgaggtgggaggatcacttgagcccaggagttcaagaccagcctgggcaacatagtgagacaccatattcacaaaaaataaaaaattagctaggga

SEQ ID NO: 224279 - DNA, 481 bp, Homo sapiens
tgcatcgggactgaaagcggagatgaatatggtaccgtttttagtcaacatctctaaatacggttcactttgggattgttctttctacatttttttttaaaaaaggaagaaagaaaaaagcacataagtaagcaagctcaaatatttgcgctctttgtccaaaaactgtttttcttcctctgtgggtcaggccaagtgccaatcaaagttgtttttcaagcctcttttccctgcagtagggctgctgcttttttttttcttcctattttatttgagagcgtgagagcaaagggattgcagatttgaggttaattgaacagttaaatatgccttaaattgtgtttattggatatgtttctcttgaaacagatttttattaaatgtgcatgttgagtatgtgcagttatttttttccataaactctaggatcaaattacagttgatacttgctcagctcattgtagggtagcttgtgagaaat

SEQ ID NO: 224280 - DNA, 427 bp, Homo sapiens
aagactgagaattccacgagaccacctgctggagagggtgggagagccatagtagctgtggagcagtacagccacactgggaaaagaatctggtattttcttaggaggttttgagtaaagtttgacctcagcattcccattcttacgggtggattacaagagaaatattcacacatgacaaccaggaaccaggcacaggaatgtcatccagtgccattcgcaagaacagaggactggggatcgttccaagtgtccgtgaacaaagaatgtgttatgacttgcggtgtagtcacaccatggaatattacacaggtgtccgactgagtggagtgcagctgctgagaagagggagagtcttgacatgaaagagcaagacctagaggacagcgcacagcccggggctctgggttatgaagcttgaatccaa

SEQ ID NO: 224281 - DNA, 489 bp, Homo sapiens
cccctaagaaacatttatgctcagtaagaacaacgtgcttgtagtgctgaaggagcctctagaaaatatctcttggcctgcctgtccttcagccagagttcagagtcctccccaccgaggacttccgggtccctccctgcagggggtgtgggctctcctcttgcaggtgagaagaccaaagcttagagaagccggacaacttcctcaaggccatagtgagtgggtgagaccaggactggggaccagaaaacccaggccttgctctgaggctcaagacaaatgcccacttaccaccccttcctggagtagtggatgcaggagtagaaggcagagcccagagggcctgatcagcacatggggttaatggggtggaggctgaggtcctggcagtgggggtcaccaggctgtgactgaatggtgggaacgaagaggaatcctgaatccttcagggtgtctggcctgcccgagcaggcgctgccctaataggag

SEQ ID NO: 224282 - DNA, 408 bp, Homo sapiens
taaatcatgaaagagtgttgaattttgtcaaatgctttcttctgcatcaactgagatgatcatggtttgcttttttctcattattttgttaatgttacgatcaattttcatatgttgaacgtcctttcattccagaaataaatcccatttggttatgatgtctatttagattttgaagactgtttttgatttttaaactttataagagctctctatagaatatgtgtgtgtgtgtgtgtgtgtgtataaggtaacaactttaaacatttggtacatttgataaaaatatttccctcattctcttcctcttttagtttggtacttttgtatattacagaaagttttaatttatattttttaacctgaccttttcccttactgcttttgttactatatagctgaaaatgg

SEQ ID NO: 224283 - DNA, 619 bp, Homo sapiens
tattgtgggactttgtcttgtaatcctgtgagccaattctccctaataaactcccttatatatgtagtcatatatcctactagttctgttcctctggagaaccatgactaatacaaaatccttgtcagttttgctagatgtttatcaattttatacattcttttagaagactttattttattttattttattttggatacaaggggtacatatgcagttttgttacctgggtatattgcatgatgctgaggtttggaatatggatagtcccataacccatttagtgagcatagtacccaatcagtagtttttcagcccacgtccccctccctctctcccctctctagtagtccccagagtctactgttgccatctttatgtctgtgagtaccccatgtttagctgccacttataagtgagaacatgcagtatttggtttcctgttcctgtgttaatttgcttaggataatggcctccagctgcatccatgttgctgcaaaagatataatctcattctttttatggctgcatagcattccatgtgtatatgtaccacattgtatttatccagtccactgttgatgggcacctcggttgatttcatgtctttgctattgtg

SEQ ID NO: 224284 - DNA, 311 bp, Homo sapiens
cgcaaggggtcgcaagggggtaggagatctctgagtggccaaatcaagctaggcttggcaacccaagtgcgtgctgctgggtttacttgctgccttagggcatgggcagctgtcctgcctgtggtcagctctggctaatcccggcctctatccactggagggcagtagcaagcccccagtgatgacgtcaaaatgtcaaaatgccgtgggggcaaaattacccccaagtggttctttgttgagagccactgcctgcttgagaatgtaagcccatgtgtcgccacattttacagctttttaagaaaaactag

SEQ ID NO: 224285 - DNA, 229 bp, Homo sapiens
cagccagattacaaaatagccctttttttgttaaccaacctgagaatttacatatattactttgaccactagagggagtctgcattgtcaggaatgccaagcccaagagaacatgaaacaggctgttttcgggtgctgatgacacatccattgtctgtccacaatatcatatgcgtacaaattgccatagtaatcacattaactgtcactgggttcattattttcctta

SEQ ID NO: 224286 - DNA, 579 bp, Homo sapiens
tttctcctttccaggtcttttcccctcaaatcaagctttcattccaaatgctgcaccagagtgtccccttcagaggtcgttgcattgctaagtcccatagcccctcccagttcttatcctacttggcctgttggaggcacccagcgcagcttcttgtttccttcttcactgacttcactttcttcactggctccaggctgctgcattctctcttttccttctacatgggtagtagaaggaaactaccaagtgggactgttgctgagccctgaagctcagtctttgagaccctctcctctccagctgcgtttcacttccgagtatggggattttatccagtctcatgggtagaaacctcagatgcattttgaatccgtctccatgctggcattgcccacctctcgtttccaatggagacctgtcttccgaactgtaggctcgtatgccacctatctgctcagcagctccacttggatgccaggtgagcatcttacacttggcatgaccaacacagagcgctgagctgtcccatgagatgtgaccctcccacaatcaaacccaactcaataaatggacacc

SEQ ID NO: 224287 - DNA, 561 bp, Homo sapiens
tcacacgcctgtccgcattgtcgtgcatcagagctgttactctacagagagtcagtacgcatgtggtacgtccataacctcctctccatcttttactctctactttgcctgtttgaagttgtctatcccaacttcttgtttccttcttcactgacttcactttcttcactggctccaggctgctgcattctctcttttccttctacatgggtagtagaaggaaactaccaagtgggactgttgctgagccctgaagctcagtctttgagaccctctcctctccagctgcgtttcacttccgagtatggggattttatccagtctcatgggtagaaacctcagatgcattttgaatccgtctccatgctggcattgcccacctctcgtttccaatggagacctgtcttccgaactgtaggctcgtatgccacctatctgctcagcagctccacttggatgccaggtgagcatcttacacttggcatgaccaacacagagcgctgagctgtcccatgagatgtgaccctcccacaatcaaacccaactcaataaatggacacc

SEQ ID NO: 224288 - DNA, 303 bp, Homo sapiens
gaggtgacaggatgaattcctgtgtgcagagggatctgagcccccgcctgtgaccaaaagtgtactcatctcaactggtacaagtctggtccttcagcttccaaaacaaacattgctcactcatgcagaaagattacaggaagacaccaggagaggggcatttggggagcaaagtacactgcctgcaaaaccaaagcccagacacacccaagagggtctgtctctaccctcagctcaccttcagcctgggtcacttcctatttctttcccattcatgataagaaccgcatctcactagttgca

SEQ ID NO: 224289 - DNA, 555 bp, Homo sapiens
agcatcatggccctctcattagggtgcaggcttatggaaatcagatgataagcagaattcccaacccgagtcctgtggttacttctctggtctcaatgcatacttgggatgtttttacctagcagagggcggagcgtatacattgatcccaggcctttggtaccatatgtaaggaagcgcaaagtagaaacctttgaaactcctcaccctactgaaacctttccaagatagtaagtcagaaacaatgctgcattccaggtgtaattgcagaggtatttcgccctcaaagacttataaagcagtggttaccgtttcatcccttcaattaacctgaatggctcctgctaaatcttggtggattcaagtaaatgatgatgccctgcacaaacttagccaagtcgtgtccccgatcacacagctgtgctaggtgtggtatctttactggaaccgataaatgcacctctggctcttgataatgcaattattgacttggtgaacattcttttcaattgccagtggtaaagaggattaaaagcagttcacatttatatggga

SEQ ID NO: 224290 - DNA, 473 bp, Homo sapiens
gctgacccttgaacaaaggtggtggttacaggtgccaatgccccacacagtcaaaaatctgcataacttttgcctctccagaaacttagctactaatagcctactgttgaccagaagccttactaataacatcagtagtggattaacacataaatagactagtatctatccctattttatgtatgcatgacatacctaacttcttaatttttttgatatttctaggctacacagttcatctgtgagtgttcgcaaattgttacaaacctccaaaattttaaaaaatatatgtattgaaaaaatctgcatataagtggactcacacagctcaaccccatgttgttcaaggattgactgtgctcacatataaatgcacctctacatgtgctcatacatattcacatgtgtaccccacatgcagacacatggagctgtttgtttttaattaaatcaatccatttgtttacattcat

SEQ ID NO: 224291 - DNA, 309 bp, Homo sapiens
gtcaaatacatgtatctctttttcttaattaggttttgttacttgaggatcttgaacttttttgtctctcacttgctacctttcagaataaatatttgttgttaactttacggattaatatttgttctgccttgttcactggatattgtgagactgaaatgagaaaaagatgctttgaaaagtaatgtcacagctgggtgttgtggcacacgcctgtaatcccagcagtttgggaggccaaggtaggaagattgcctgagcctaggagttagcgaccagcctggacaacatggggagatcccatctcta

SEQ ID NO: 224292 - DNA, 391 bp, Homo sapiens
  misc_feature (23)..(23): n is a, c, g, or t
agtttgtaaaggaaagaggtttnatttgactcagttcacatggctggggaggcctcaggaaacttaacaatcatggtagaaggtaaaggggaaacaaacacgtttttcataaggcagcaggagagagagagtgcatggggaagtgccacactttaaaaccattagctctcaattggcgaggcatggtggctcatgctgtaatcccagcactttgggaggccgagcaggtggatcacgaggtcaggagtttgagaccagcctggccaacatggtgaaacctgcccccactaaaaaaatacaaaaattaggcaggcatggtggcatgtgcctgtagtcccagcttctctgggaggctgaggcaggagaatcgcttgaacctaggaggcggagg

SEQ ID NO: 224293 - DNA, 756 bp, Homo sapiens
cagggttattgcaagtagcaaggagaaaatatatatttaccatttgccacaatccctggggaagtgcagtcaatacattggaaagggtcctcataagagtttgatgatcattctcagaaagctagccagagaaagtctaaatggtaaaggttccagctcattatcttcttcccttttctcaagttttctctccatctgacatgtgagctcagtatttaccattgccctttctacaaatttaaccaagtttatttaaaaacataatgaccttctatcccaatttacattttctttggtgtagaggacgcctttaccttgatgtgtggagacaagccgttgatttgtaagaaacaccaattatcagcttccacttgtgcttcacaatctgctgagtcgctttaacacttttgatgaaattgagcaaggccttgtgatctctcctgtgccagccgtgaagtgtccactgcacgcagcttggcagaactattttcagggccataggatgttatggctgtgtgggcagggagcattttattcgtctgtttgattcctatgtttttattagtggtgcaattgcaaaggtaatgctattgacactttttgtgtagccttgagagaagagtatgaattgttttagtagcagcacagcgtgtccctaaatataaatcatgctgtactgatagttactttagcagccactgatcagcaataaatgttaaaaattaacaagaagtttctttttttcgaaaccaccaa

SEQ ID NO: 224294 - DNA, 520 bp, Homo sapiens
cttgaacacatggtagaatgccctaggtgaatccctccagtcttccagtaccatccttgactcctctctctgatgacacatgaactttatgcttttgcacacttcaggcaacaccaaaagaaaggaaaagaacagcttagcttcttaatgtgtgtaagaaaccacagtgaaaaaaaatcaggtgtgttgttgaggctgctaaaagctttccttttttttctgtgccagttctcgctgcctcattggttgagatgggatgtcttttttgatgtcctctttagagagtgttatcctcacctttttgcatagtcctaccaaaagacacctcacatgcaaagtgtaacagaaaattacagtcatgactttagttttaaaaacaggacgtatattcatgaagaatgtttgctgttttcccagtgggttaatcatatgaatataaaacagactaaaaatatcaagttgtttttgcatttatttattgtagaaataaaatggattgctacctctgagcttctgagaa

SEQ ID NO: 224295 - DNA, 475 bp, Homo sapiens
aaaatatttattgaatgcagtctgccttttaatatctttatggaatgttttataatgaaatttgataaatgtttatataaaaatgttttcaattatcaaatagctgacttaggttgaataataagaggtattgttttacaacaaacaaaagtcacttgtttcttgtaggaggcaactaaatggatttttaatcaacatttaatagacatgaaaaaaacaaataatttatttgattaattgttaccgaatgtggaagttaaaacatattctgtcatctcatggtagagagctttggtaattatttagtctcaggaaagaaagtttgctaactcatagttgataatacaagcaaagctaagagagaagtttcacacatgtataactttaacagaagcaccatttgttccccaaaaggaaaacagctttattattgcttttctatcataaaaataataaaatatattgagatgtttaa

SEQ ID NO: 224296 - DNA, 459 bp, Homo sapiens
cagacgttacgatgaaactctctaggttttaggttctggttaaaaaagaaccttcacatttatgtatatacatatgtttttgtgtgcatgtatcattcaaaatcccattgcaatcacattttagaaatagcagtaccaaggctgggcacacctgtaatcccagcactttgggaggccaaggaaggcagatcgcttcagctcaggagctcaagaccagcctgggcaacatggcaaaaccttatctctaccagaaatacaaaaaagttagctgggagtggtggcacacgcctgtagtctcagcttactcagaaggctaaggtgggagaatcacttgagcctaggtggccagaggttgcagtgagccgagatcacgccactgcactccaacctgggtggcagagcgcaactccatctcaaaaaaaagaaaaacgccaggtgcggtggctcatgcctgtaatc

SEQ ID NO: 224297 - DNA, 457 bp, Homo sapiens
ccttttcagtgttgtgcttaaaatgcaaaaacatccttctcaggaaaaatttgtacatatttatgatttttttctttggaattaattcctacaagaggaatttctatgtcaaaggatatgcacaaatttaaagatttggaatactagatcaaacattatgctgggcgcagtggctcacatttataatcttactcagcactttgggaggttgaggtaggaggatcccttgaacccaggagttcaagaccagcctaggcaatatacagagaccccacctctaaaaaaattttttaaaaaattaactggatatgatgacatgcacctgtagtcctagctactcgggaggctgaggcaggaggatcacttgagcccaggaggtcaaggctgtagtgagtgacgattgcaccactgcacaccagcccaggcaacagaggaagaccctatctcaaaaaaaaaa

SEQ ID NO: 224298 - DNA, 467 bp, Homo sapiens
agagcaggggaggaagccctcaaggactccaacatctaagtgataaagtatacaacaaactttccaaaaacaagactaagaaggggccaccagagatgcaagcgaataacccaagagagagagaattgtcatggaaaccaaatgaagaaagaatctcaagagatggggagtggctaactgagtcaaattctacagagaagccatgtaaggtgagaaccaaacatcactggctctggtcacaaagaggttgtttgtggtatttgctgagcagtttagtggagctacagagacagagatgaagcctatttctaattgtttgaggaattaatgcaaagtgagaagtggagttatttattgtagatcgttatttcaaaaaatgtttctaggaaggtaaggggaaatataggtttctagctcaagaaaaatgcaaggtaaaattaaggtttttcttttataataggagaaac

SEQ ID NO: 224299 - DNA, 498 bp, Homo sapiens
ttaacctgtgataaatatatacctaacatagaatttgccattttaaccatttaaaaatgtacaattcagtggcattcattaaattcacaacatcctacaaccattaccactccttccaaaacctgttcatcactcggctgtagctattaagcattaaccattccccctctccagcgctacaaattggatttttatttatagtatgatacctatagagtaggttaatttgggggatgcacagtgtgtcccagctcacctgagggataggtacattccttctcactctggcagggattcttacctgattggggcaacgggtggcaggctgggcagggacaggtttctatatcagaatctctggattcaggggatttgagcacagctgtcttcatggttctaacctgatatgtgcactcccttgggggaagtagtctctcatctctatatactagtttaacagtcacggttctaacataacacatccccccactgtaatta

SEQ ID NO: 224300 - DNA, 468 bp, Homo sapiens
catttcatatcggcttagtcttcaagcatacttccctcattggggtgaaatggttgtattagtttcaggtccaacaaacatacaccacactgtccatgaggtgagaatgcacagatatatcagaattcccagcaaatgtcttgagcttctgacaaattgagccacccctgacccaatctctgaggttaggggaaggttatatgctgactgagaaagccctgggttacctgaactatgacaaggaggatgagtttaatgcaaaccacctgactattacacatacctccctgggggtcctttccaggaagcttaggctttagaagacaaaagcaataaaaaggatttgccatcaagtgatggatactttccattgccaactcttcctgaggcaaaaggaaaaaaagacctggcttctttttttgtcatggtgggtggagaataaataaaatagaaataactatctcaata

SEQ ID NO: 224301 - DNA, 106 bp, Homo sapiens
tgatgtttctgatttttaaaaaattgttagtgctacataaactgtaagtataataattacaactaaggttcatctgaccttaactcatggaaatagtctagattca

SEQ ID NO: 224302 - DNA, 390 bp, Homo sapiens
tgcctggcctcatttctacttcaaaagtatctggctatgttttgaggcaacagccagacccgtgaagctattcaattcatcaatacaggaatggctgaaagggggtgtgtgtgggactaagctgaatacagggtgaatataaagaggcctgattccagagtgggaacaggcaccccctggtggtagcatgccacaattgcgggcaaaattctcgggagaaaatgcagccaccttaattgtaaaatataattttcaaaccaccactggaggtttggaaaacatcatctcaaaactcaaactagattacataaagcaagaagcagggaagcagcaagagaaaggtagatgacagatcgacaggcagatggatgatagagactgggccaagga

SEQ ID NO: 224303 - DNA, 447 bp, Homo sapiens
gcactggcttaatggtggttttgtttgcatggcacctttaggtatgtggtctgagtttatgcaaaagtaatgacaaaagccgcagtgacttttgcacccacctaatataagtaaacaggaaataagttgagggcaaggactgtgtctcccaaacacgtttctttgataagcagcctttctttgccttgtataggcattgacccaaataagtgttcagtttgtgtgactgcccaacccattcactgcctccagtgtgtgcatccaagcccaaccttgtcaaatacaccgcctgttgcctgagctgggacggcctgccgactcttctccctgcccctcctggatacctacaatgcatcctccacctgaccaaccctgtgatattttatgaatgtaaatcagatcgagacttctctgctgaaaccttggaataaaacccagattcccaac

SEQ ID NO: 224304 - DNA, 745 bp, Homo sapiens
agtgcctcgagggcgccgttcgggcggggaggatcccgcgggtcccactgacccacgcggggtggggccaggggtggacgctcgcccgtacgcggtcgctactgatcatgcttgggccagggtccaatcgcaggcgccccacgcagggggagcgaggcccagggtcccccggagagcccatggagaagtaccaggttttgtaccagctgaatcctggggccttgggggtgaacctggtggtggaggaaatggaaaccaaagtcaagcatgtgataaagcaggtggaatgcatggatgaccattacgccagtcaggccctggaggagctgatgccactgctgaagctgcggcacgcccacatctctgtgtaccaggagctgttcatcacgtggaatggggagatctcttctctgtacctctgcctggtgatggagttcaatgagctcagcttccaggaggtcattgaggataagaggaaggcaaagaaaatcattgactctgagtggatgcagaatgtgctgggccaggtgctggacgcgctggaatacctgcaccatttggacatcatccacaggaatctcaaaccctccaacatcatcctcatcagcagtgaccactgcaaactgcaggacctgagttccaatgtgctaatgacagacaaagccaaatggaatattcgtgcggaggaagaacctttcgtaagtcctgggatggccctgaagcctcaattctccttcagcagaaa

SEQ ID NO: 224305 - DNA, 486 bp, Homo sapiens
agtgcctcgagggcgccgttcgggcggggaggatcccgcgggtcccactgacccacgcggggtggggccaggggtggacgctcgcccgtacgcggtcgctactgatcatgcttgggccagggtccaatcgcaggcgccccacgcagggggagcgaggcccagggtcccccggagagcccatggagaagtaccaggttttgtaccagctgaatcctggggccttgggggtgaacctggtggtggaggaaatggaaaccaaagtcaagcatgtgataaagcaggtggaatgcatggatgaccattacgccagtcaggccctggaggagcaatggggtctcaccattttgcccaggctagtctgaatttctgggctcaagcaatcgtcccacctcggcctccaaagtgctggggtacaggcatgtaccaccacacccataccagaactgtttaacaaaacaaatataaattacccttaattctaccatt

SEQ ID NO: 224306 - DNA, 1052 bp, Homo sapiens
aagttacatgtgtgaggaatttgaaatatgatccaaagactatgttctagagtcactggactcttaccaacaataagagttcaagttgtaaaaaatagtcactatgggccaggcacagtggttcatgcctgtaattctagcactttgggaggccaaggcaggtggatcacctgaggttaggagatcaagatcagcctggccaacatggtgaaagcccatctctattaaaaatacaaaaaaattagccgggtgtggcggcgggcacctgtaatcccagctacttgggaggctgaggcaggagaattgcctgaaccccggaggtggaggttgcagtgagtggagattgtgccattgcactccagcctgggtgacaagagtgaatctctgtctcaaaaaaaacaaaaaaagaaagaaagaaaaaaagaaaattataaaaatagtcactatgattttcaaagaacagtggataataggtgataacagttattttgttccttttttgaggtatttacataaagtgtacaagtcataagtatacagctggcaagcttttgcatatgcatgtacctgtgttactaccacccagatcaagatacagaaccttctcagcaccccaggaaactcacttttgctaccccaattaatatttcatccaaaagttaactactgtcacaacttgtaaaccagattagttttgtctaattttgaacttcatataaatggcattatacagtatatactcttttgtgttttgtttctttcactcaacattatgtctatgagagtcatcaaagttgcatgtagtgatagttggtttatttccattgctgagtaataatctattgtatgagtatactttaatttatccactcttctgttgataaacatttgggttgtctgcagttttgttgacttttatgaataatattgctatgaaccttcttgcatatgtctcttggtgggcataagccctcatttctgttggacatataatattcatgtatttagctttattagaaactgtcaaacaattttccaaaatgattgtacca

SEQ ID NO: 224307 - DNA, 159 bp, Homo sapiens
agttttaaacactccccaggcgattctaaactgcagccatgtttgggaatgaccaggtcttcatgttctgacatccagtgcctgttagtcaaaggcacctcagacccacagcatacttgctgtgtggcctggatggagggaccatattcaggggtcatc

SEQ ID NO: 224308 - DNA, 660 bp, Homo sapiens
cacagatccacgtccaagcagaagtcacagctgttcagaaaagaaaggcaaaaggaagaaagacatctctgtttgaaaagtgtaaaccaaaaacaaaactctgaggccctccagtcatctgaatggacttcctcctcagccagggctcttaaaatgtaacctgagaggtgggttcaggccatgacgggaagcgggggtcacacacgtctcattgtacccctcactaacagcagcacagactttgacaacaacattttgcaccctattctgtctgcagcctcctagctaaagcttcatctgcatgacaaaaccttgctctccacaccgttatcttaacccagacgttcctttctgctgcatctcaggtctttggacaaactcaacccattgtcaaccagaaaacctttaaatttacctgacacctggaagcctcccctccctgccagctttgcgttgtccacctttctggaccaagccactcaccaatgtacttctcaaatgtcttggattggtgtcttatggctccctaaagtgtataaatccaagctgtcccccgaccaccttggcacatgttctcaggacctccagagggctgtgtcacaggccatggtcactcatatctggctcagaataaatctcttcaaatattttctagcgttt

SEQ ID NO: 224309 - DNA, 365 bp, Homo sapiens
aatgaacattacagtcctcatggtcccaccgaggtccactttaaggccatgtgtgtatgatgcagcagtaacatgagtcccagtgtgtgagcgctcatctactcctgtggccttggctttgaactctgatatgcttgtgatttctaagaagcatatatgccatcctgagctttcaaataaattccagcctttacttctgcatctgtctgctcaacatttctgcctactggatatatgctggatatatccacatcaagtcaagaaattaatgttaaactcatttataaactgccagaaatttgcttctcattctgtgttctgcatttcagagaactgcattgtcattcgcaagattgccaaagtta

SEQ ID NO: 224310 - DNA, 495 bp, Homo sapiens
ccattgtgttgcagctagtgtggggagtgtggtggtgtgaaggggctgtgctggtgtgtggggttgtgtcgagagtgggatactgtgagtagggtgcgtgagatgtgtgtatgtggtggagggtatgtgtttggtggcgggatgtgtaagtggtgggatgtgaaatggggtgtgtgtatctctgtgtgtggtgggttgtggggtggaatgggggggtgcacggtatgtgtgtgtgtgtgtgtaggtgtgagagtatatgaaatacatgaaaagataaaaagttagatgctgctaaagggacagacatgtaggaattttacattagggttgttctgattttcattttcttgccttttaaaatttaatgataaacaagtctccagagatttttacagcctgggagaccactggtaagacaacaatataggtggtcctccagcaggatctaaatcagagccttcatagtggactgtcgggccaggtgcagctgtagac

SEQ ID NO: 224311 - DNA, 417 bp, Homo sapiens
tgtctgtgtgtaggggagtctgtagttcattgtttttttattactgatattgttaatttgtgtcttccctttttgtcagtcttgctagagatttgtaaattgtattggtcttttcaacaaacaagcttttgttttcaacatttttttctgttttcaatctcatggatttctgctttttattatttttgtgttgctttctttaggtttatttagttcttcaagtttcttaagatagatttgcaactgtttttctttgctgatataatagtatcagtttaagagcagggcttggtggcacatgcctgtaattccagctatttgggaggctgaggtggtagcatcacttgagcctaggagtttgaaactagattgcgcaacatgcaagacccacccccccccccatctcttaaaaaaact

SEQ ID NO: 224312 - DNA, 416 bp, Homo sapiens
ctttctcaatctacattttcttttaactagttcctgttctcttttgccaaaatttttgaaaaagtagtctagactgtcttcacttctacttatttagtccactccatccaaaattccattggctctgctcttgccaacattatcagcaaccttctattcatggaacacaatccttaattacatggtacctttgcgggagaacacttcattcattctcatctccttgacttccataacaccacattcctggttttcctcctctttggtcttcctccttcatccatccatgttgctcttcccaaggttttgcctattcatctagttactctacaaaccctttctaggttatcatatatatctccatggcttcaattatcaattaagtattaataactctggataatccagatttgttt

SEQ ID NO: 224313 - DNA, 461 bp, Homo sapiens
tttcccacattgtccacactcataagatctttttccagtgtgaattcactgatgattactgaaggtattacatttgctaaaggatttcccacattcactgcacacgtaacatccttctctagtgaaaagcttctggtggaacaagtgagtgagtagtgccgaaaggttttgtgggccagacacggtggctcatgcctgtaatcccagcaactttgggaggctgaggtgggcggatcacctgaggtcaggatttcaagagcagcctggccaacgtggtgaaaccccatctctactaaaaatgcaaaaattagccaggcctggtggcaggcgcctgtgatcccagccactcaggaggctgaggcaggagaatcgcttcaacccgggaggcggagtttgcagtgagctgaaatggtgccactgcactccagcctgggcaacagagtgagactctgtctccaaaa

SEQ ID NO: 224314 - DNA, 512 bp, Homo sapiens
cactcaggaggctgaggcaggagaatcgcttgaacgtgggaggtgcaggttgcagtgagctgagatcgtaccactgcactccagcctgggcgatagagcgagattctgcctcaaaaaaaaaaaaaaaaaaaagaaaaaaaaacttatttgagggcaggtttggggggcatgtctcccaaaatcttgggcttaacctgcacatctgtgttttcatggtgccagatttgagcctgtttccatgcattttgttttattccaccctttcagaggttcctcgtgaatatgaataaaatcttactttaatagatacacacattttatgaagtgccaatattaaatcaactttggaaaaaaaatcagccagagagtacattgtgtagacagcttaaacacaccgaataaaatgcttttaacatcatgaactgaagaggccatttaacttaatcattgagggctcactttattcaacagcaatgacctatttagaaccatgactcagacagcttcccttg

SEQ ID NO: 224315 - DNA, 388 bp, Homo sapiens
gggctaggcgtggtggcttacacttgtaatcccagcagtttgggagactgaggtgagtagactgcttgaggccaggagtttacgaaaagcctgtgcaaacacagcagggccctatttctacaaaaattttttaaaaaattagctgggtgtggtggtacaagcgtagagtcctagctacttgggaggctgaggtgggatgaatgcttcaacccaggagatccaggctgcagtgaggtatgatcacgcagctacactccagcctgggtgacagagaaaagtccctacccctattaaaaataaaaaagatgtccaagatatgcatgctaaaaactataaaacactgatgaaacaaataaaagaatatataaataaatgaatttcagggatt

SEQ ID NO: 224316 - DNA, 416 bp, Homo sapiens
ccagtaattcctcttttcaaacatgaaatcaaaatcgggatcttgaagagatatttgtacacccctgatcataataggattattcacaatagccaataaagggaaaccacctaaatgtccatcaatggattaatgaatacatatgatgaaatattattcaaccatttaaaaaattctgccatttgcaacaatgtgatgaaactggagaacattatggtaagtgaaatagttcagacacagaaaggcaaatactacatgataccacttccatgtgctttattttagtaccaacacaaaccaaaccatgcggtatctagaaactgcttgttggaaacttggcttctgggttaagacttctgctgagagcacacaatctgtacaatgagctctgaataaagaaataaatctcaaagtga

SEQ ID NO: 224317 - DNA, 330 bp, Homo sapiens
acttcccagccctctttctcgctgtcttttctgtgtagccagaaaagctgagtctgtctaccttctgtactttctctcactccccttgctgggatgcacttctctccttatttacatgggtaagcagttattattccaagactgttcaaagcttttttgaaacttttcttagcctccctgtctcccactagaactggccatttccttatgttccaatgtatcttgttgagatatctatcacagtatctctggtattgtattgcactgaaactttacatgtgtatttctttctactgggcaataagcccttttgcaaatgttctttgaata

SEQ ID NO: 224318 - DNA, 677 bp, Homo sapiens
  misc_feature (1)..(2): n is a, c, g, or t
  misc_feature (21)..(21): n is a, c, g, or t
  misc_feature (30)..(30): n is a, c, g, or t
nntttggatcgtgagcatctngtgcagaanctatgggcaacacctttatgggatgaacggtcatcatcaccatcgtcactgtcatcatcatcatcatcaccaccagtgatttcctgaatgccaaccaagcaccagtcatcaagcgtgagccacggtgcaaagatggaggcaggctctccattctaagggaacctctcaggccagtagggaaggcaagattcagacaccagggacaggcagcctgggatgacaggtggaacaaggaggagacacaagaacccccaccccaacccaggaacccacatcacaggccagacctgcatgatcgccaggcacccgactcgggttatgaaggtgtctctcctaagagagtggcagaggcaaactttagccttggcagtgcgcctcaagctgctcaggggagaagtcacggccaaagccctggagtgcatgggttctttagccatggttctcctgcagcttcctctgatattatgaagcgcctgccgccaccaggcttgttctgactcccttccatgatccacccttctgagtggggtttggcttctgtacagctctcctgtgggcactgagcccactagtcagagcaagagggctccagtctctggacagtcacagtgcttggtggcaaaacataaattgtcattcattcaaaa

SEQ ID NO: 224319 - DNA, 656 bp, Homo sapiens
actagctccaaccatctcagctccttcatgattgtttcgtcatcatcaccatcgtcactgtcatcatcatcatcatcaccaccagtgatttcctgaatgccaaccaagcaccagtcatcaagcgtgagccacggtgcaaagatggaggcaggctctccattctaagggaacctctcaggccagtagggaaggcaagattcagacaccagggacaggcagcctgggatgacaggtggaacaaggaggagacacaagaacccccaccccaacccaggaacccacatcacaggccagacctgcatgatcgccaggcacccgactcgggttatgaaggtgtctctcctaagagagtggcagaggcaaactttagccttggcagtgcgcctcaagctgctcaggggagaagtcacggccaaagccctggagtgcatgggttctttagccatggttctcctgcagcttcctctgatattatgaagcgcctgccgccaccaggcttgttctgactcccttccatgatccacccttctgagtggggtttggcttctgtacagctctcctgtgggcactgagcccactagtcagagcaagagggctccagtctctggacagtcacagtgcttggtggcaaaacataaattgtcattcattcaaaa

SEQ ID NO: 224320 - DNA, 447 bp, Homo sapiens
cggctctcccgcgtcgtcggccgcgggcgccagggtgacggcgccgtccctccagacgcggatctgcgcggccgagcgcacacggtggcggggctggcggcggcgggcggcggcgcgcagggaaccgcagcactggtagcacacggcccacgcctgctcctcgttgatgggctggttgtacagccgcaggatctcctccaggctcagcgcgtcccgggagcccccggccgcgccgccggctgccccgggctcccgcggcccctcgccgcccactgcctcagtccgcggctccccgccgcccgccgggccagccgcctgagccatcccgcgggtgggcgctgcgctcggcagtcgcgccgtgtgccggcgtctcctcagctccggagcatcgtcgtcgcgcgccgccgcctcaccatccccggaaccgccgccgcccaacgcggccgc

SEQ ID NO: 224321 - DNA, 566 bp, Homo sapiens
atgatctttcaattgttcagcaaaggataaagaaggcattcaagcgtggtttcaagaactgtcagcaataagaaaatgcaaggtactttgtagggccttcaagacctttctggaaaatagatttaattaaaaagtaaaatagacttttcaaagaaatcttaaaaatgttataaaacttcatgttaatatattaataggggtattgtcttcttatcctagatgagaaaaagtcatccatgaagctattatatttgattcatacaacagtggagcttataaatatttttctttaggtttgatttaagagtgagaattataatgcattgaagtatataacagtgttaaaaggcctactctttttgattcacagatggtgattcaatctcacccgtaaagtaggaacatctatagtagtcttccccctcctaaaaggagtccttttacccaaattaaagtttaaaatgatcagaaatatcagtgcatatgctgtttgttttaattaacatgttcatgtacactttgttcatccttagaacaatactaatactatgtagtcgggtataaga

SEQ ID NO: 224322 - DNA, 293 bp, Homo sapiens
gttcaccaaagtggaacataatgaagaaaggttatttaatgaaatcggcatctgccaacacaaactcatcttgagtaataggcattcctcactttggaatatatgatttaaggacaaggcatccctgcttgaaccccatggggtttgtctcttgatatttttccaggaataaaatgttctctgccttttaagtggcatatttgcagttggggctcatagtggccttcagcagttacaaagctggccttggccaagtggaatgaaaattcctcaggggcatgaggattgttctg

SEQ ID NO: 224323 - DNA, 791 bp, Homo sapiens
agccacctccacaaaaatgaaccacaaacatgcagtcgtatttattttaattcataaatacattaacatagcagattaggcaatttgttaggtaaattacaaatacattagaaatcatacaaagtgggcggggcagggtggctccattgcactccctctggaggacagagtgagattagatctcaaaaaaaaaaaagctgggcatggtggctgacgcctgtaaacccagcactttgggaggaaatttatagcactaaatgcctacattagaaaaaaagaaaggtctccaatcaatgagctcagctactagcttaagaaactaggaatagatgagcaaactaaccccaaaataagcaaagaaaataataaagataaaaacaaatcaataaaaaagaacacagaaaaattaaatcagccagtgcttgctatatggcaggcacagtacaagaataagtactgagtttacatatgcagtctcttgaggatcctccaagtaggttagatggacataaaatggaaaataaccagatcagaatactaatgaccaggaagaatgatcaaggtgccagcctgccttcaagagccagtgaggccattgtggatccttagggaaaggggaggtgaggatagtggttaagagatcaaggctctgccgggcgtggtggctgtaatcccagctacttgggaggctgaggtgggagaattgctggaacccgggaggtggaggttgcagcaagccaagatggctccattgcactccctcctggagacagagtgagattcgatctcaa

SEQ ID NO: 224324 - DNA, 101 bp, Homo sapiens
ggtgttttcagatcatgaggacaagctggatcctttcattagagaagcaattctgaaacagaatgagaattttaaaatgtgtatgtctttgagtttctttt

SEQ ID NO: 224325 - DNA, 443 bp, Homo sapiens
ggcactcaacacatagtgttaataaatgagagaccaaatgaatagctaagtcgaaaaacaatgaacatgacaacacagtttccaggtcttaaagcataaccgctgaatgtgaatttttaaggaagagagctgataatctgtatatttaacacgcagcttctgtgtgagtcttttcaggcaattttggggcatactgccttacccagcagttccaggctaattatcagaccaattatcagaatcacctggcatgttttatgactcatagatttttggaccctaccttggacttcctgaatcagggcccagatgcaggaatttcttttgcaagaacttctcaggtggttcaaaatatggggaccactacagcaggatatgttggactgaatttgctcacacatggaattaagggcagacgtgataggtaatcagcttgttctctt

SEQ ID NO: 224326 - DNA, 147 bp, Homo sapiens
gtcttgcttttttatccatgctgacagtctctgttttcaaattagcatatttaagtcactcacttttaaggtgattactgagatagttggattaatgtctaccatatttgtaactcttttctataagtctcccttctgtgtttcatt

SEQ ID NO: 224327 - DNA, 368 bp, Homo sapiens
agatccataaccttaaaatcatcttaacttagaagcacacagactaccaaaatcgaatctagaaaacaatagaaaatcagacctgtaggctgggtgtggtggctcacacctgtaatcccagcactttgggaggctgaggcgggcagatcacctgaggtcaggctgttctcaaactcctgagttcacacagtcttcccaaagtgcttggattacagacatgagctaccatgcccagccaaagacttagtatcagcgtgaccatttctgtaaaaaaggcagttggattacatctgtagatcaatttggggagcgctgccaccttaacactaagtaaataacttgtactatgtggtacaatgaaatattaa

SEQ ID NO: 224328 - DNA, 279 bp, Homo sapiens
tagttttcgtcacagaggtgctcacttcctgctattttttagttcattaccgccattctccccctactcccacctaactgtaagcttcatgagaggaggggccttgtttgttccctgccgggtagcatgccccatacctagagctgcatatcagggttcaataaatgtttatgaatggaaagaacaaatccaacaaaatggagacaaagttaagagctagagaaaagaccgggcgcagtggctcatgcctataatcccagcactttgggaggctgaact

SEQ ID NO: 224329 - DNA, 448 bp, Homo sapiens
tttactgactggcttactgataaggatgcataaacctattggtggtactcaatatgactgggagaaaacaatatatgaaacttgcaggtggcattttatatttggaaggatcaggcactaagagaaaatgctctttcaaccaggagaatggcgtgaacccgggaggcggaggtagcagtgagccacgattgcaccactgcagtccagcctgggcgaaagagcgagactctgtctcaaaaaaaaaaaaaaaaaaaaggaaaaagaaaaaaaaaaacctgtcaaccaagaatactatctcttgcaaacctgtgcttcaaaaactaaggagaagctgggcatggtggctcacatctgtgaccccagcactttgggaggctatggcagggggatcacttgaagccaggagttggaaaccagcctggataacagtgagatcccatcgctagcc

SEQ ID NO: 224330 - DNA, 575 bp, Homo sapiens
gaaaagtgtcatcattcttctaaaaataatttcaataccacagattagcagtttgtaatgttctgaaaaattgtttaagacaattttgatagcacagcagtaatcaatacgattctaagaaaggcacccctctcagttcaatccggcaaatgaataaatgcaaaacgcatataaaatactgtgttggaggctaaaggtaataacagttcaagagcatgtggcccttgtctttagagggtgaacagtgttttggtgaagcaaaccctacatgggaacttataagtcattcaataagtgctttattggatgtataaatgaaatattatgagaatacagaaagggagaaatatttgcttgaggaaattgaaaaaacttgatcaagtgtgacatttgaactctacatatatggagtttgaaaagttttcaacattatgtttcagcagagtgaacactataagctgagaagtatgatatgtttgggggtctgcagattaattggctgctatctctgatatatattgggttcataacaagatagtgtcaaagtgttgattgccccagactaagaaatagct

SEQ ID NO: 224331 - DNA, 381 bp, Homo sapiens
ccaagtaacatatcttaaagaaaaaaaaaggtaaaaggagaaataccagagaggacattttaggggcccacaaacactgtcaggaaggaagcaattttattatttgttttttatttatcttttgagacagggtctcgctctgtcgcccaggcaggagtgcagtgaggtaatctaggctcacggcagcctcgaactcctgggctcacgcaattatcccggcctcagcctcccaagtggctgggattacaggtgtaagccaccgtgcctggctgtatctttgtcaaagtatgtcatttatgtgtaaatgtgtctccttcatagcaccccagggagatggggtgaggaccttccccatcccttgtgattggtgtttgtctccct

SEQ ID NO: 224332 - DNA, 411 bp, Homo sapiens
ttatatcctttgtaaaaactttccctttcagaaaattttaataattgttcccaggaaatcctcttaaggatttcattttgtgaaaaatacttctggtttgctcagatgttataaaacctaaagattaagctgggcacggtggctcatgcctataatcccagcactttgggaggctgaggtggacggatgacctgaggtcaggagttcgagaccagcctggccaacatggtgaaaccccatctctactaataacacaaaaattagccgggcgtggtggcagacgcctgtaatcccagctactcgggaggctgaggcaggagaatcgcttgaaccccggaggcggaagttgcagtgagccgagatctcgccgttgcactccagcctgggagacaagagcaaaactctgtctca

SEQ ID NO: 224333 - DNA, 265 bp, Homo sapiens
tagtatattacaaaatctctgccttgtgcaggctttattgacctttatcatatggctgttttatttttaaaataactttccatgaaattataaaaatagtacattcaaatcccaaatattacaactgtatttctatatccactcctttctgtgaaagtaaccactgctaatactttagtttgtgttttttcaaacatttttcctatgtatgtataagagtgtatgtatatacatgtatctattaaacttacatagattatgtgat

SEQ ID NO: 224334 - DNA, 247 bp, Homo sapiens
taggcaataccattcaggacataggcatgggcaaagatttcatgacaaaaacatcaaaagcaattgcaacaaaagcaaaaatttacaaatgggacctaattaaactaaagagcttctgcacagcaaaataaactatcattagagtgatgatagtgtttggaatagtttcagaaggaatggtaccagatccttcagaaggaatgccagctggttatttgtacctctggtagaattcagctgtaaatcc

SEQ ID NO: 224335 - DNA, 297 bp, Homo sapiens
tagcagggtggcactcacagggtggtgctgggaaggcaggtcggccttgactgtccaagcagtcaacatgcagagccatcctagtctcctccctgggccctgcactgggaggcctggtcagatctttatctgtcactacatctggtgcttttaacttgaaccagctctatagatgttagtgcaggtccaaaagagacttagctgaaatgagttttaaaaggattatgaaatagtgcttagaagaacatgtgaagaagttgagcctatttagattgaaaagaaggctgaagaaggact

SEQ ID NO: 224336 - DNA, 479 bp, Homo sapiens
gaaaacagaaactgtgatgatgacagactttgtcttgtcattttgaattctgtatcaatcttgatttctgattacctatgtagtgttttttttgagacggagtcttgcactgtcatccaagctggagtgcagtggcacagtcttggctcactgcctccacctcctgggttcaagcgattctcctgcctcagcctcctgagtagctgggattacaggtgcctgccaccacacccagctaattttttgtaattttagtagagatggggtttcaccatgttggccaggctggtctcaaactcctgacctcaagtgatccacctgcctcggcctctcaaagtacagggattacaggcgtgagctcctgtgcctggcctgcctgtgtagttttgatcaccatttgtttcccgtctatggaacctctgactcctctgtctgctttgactgaggattctattctgggtgttctctcatgtctgaag

SEQ ID NO: 224337 - DNA, 875 bp, Homo sapiens
tgacttgtgtgccagtttattggagcagtatttctgtcagctacaatagaatatcagctgtgacatttggctgagtcaggctgtgaaccaggctgcgtttaacagaaaacttagttaacagtgactgttgtattttttgcataaaaatgaaaaagcttctttttagtgtgtatcagctctgatagggactcctatgtttttccatgtacccatcacctaatgcatttgtctgtattccaggccgaaaggaggaggggcaagggcagaaggtgcaggccagctgaggtatcccccagggagctccccccacccatcccccagctgacaactgctcctgttggccagagtctagccaaatgtcaccctccttataagtttggaatatgtagtttttagctgggcagtgttgtcctgaataaaattagggctctgttactaaggaataagtgagaatttgtgctaggtaagcagttagcagtctttcccatgtggctgacatgtttgtcagaatttaagttgtgtaattagagggaaagagaaaagtgccacttgtgtgcaaaacaaaacaggaaaagtgacactgtgcgcttcatgagacctgctatttgtcaaacctctgtttcaaaaaagcaatattgttaacagtcagtgagcagcttttgggatcttaaagcttaaacgttaaaaaaattatttaaatatttaaactctcaagttctattagagcagtggcaagccacatatctgcccaggtgagctctcccttctgtccaatagcatctgacattgccaaaaaggtaaccgcccatccccgctttttttctgagacagggttcactttgtagcccaggctggagtgcagtggtgtgatcgca

SEQ ID NO: 224338 - DNA, 819 bp, Homo sapiens
ttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaaga

SEQ ID NO: 224339 - DNA, 242 bp, Homo sapiens
gtgttttttctattttatctaagaaatccttgccaaaaccaaggtaactaagattttctcttacattttcttcaagaagttttataattttagctcttacatttaagtctgtgactcatttgtatatatacgaggtaagggtatagttcattttttacatatactatcaattgttccagcactgtttgttacaagatactctttccccattgaaatccctgggcatctttgtcaaaaaaaaa

SEQ ID NO: 224340 - DNA, 197 bp, Homo sapiens
gtgttttttctattttatctaagaaatccttgccaaaaccaaggtaactaagattttctcttacattttcttcaagaagttttataattttagctcttacatttaagtctgtgactcatttgtatatatacgagagatagtcattttacaatgactagcatgtcagcactgtgtacagataccttgcatgatctgac

SEQ ID NO: 224341 - DNA, 496 bp, Homo sapiens
gtgagagaccctgtcccaaaaaaaaaaaaattttaagtttttaggtatcagttgctgaactatttgttatacagtgtacaccaataacagtccaatagtatttaacaaaatgatataaaatagagccctcatagaccttaggagccataattcaactacgtttccagtgtgtgaacccccctctataatagtcacaaaaagtggttgtctagtctgtgcttaattacttccagactattcagtttgtcttagatcactccacctcttagatgattattattattatattattttatttatttttagaggcagagtttcgctgttgttacccaggctagagtgcaatagagccatgttggctcactgcaacctccgcctcctgagttcaagtgattctcctgcctcagcctcctgagtagctgggattacaggcatgtgccaccacgcctggctgattttgtatttttagtagagacaggtttctccatgttggtca

SEQ ID NO: 224342 - DNA, 918 bp, Homo sapiens
ttttttgagattaggtctcactctgttgaccaggctggagtgcagtggcacaatcttggctcactgcagcctcaacctcctgggctcaagtgatcctcttgcctcagcctcccaaagtgctgggattataggtgtgagtcactgcagttggcctactgattcttaaaatgtgagtcagctcacattacttctctgcccaaagaccttccaataattcctcgtttcattcagagtacaagttgaaaccctcataatggcatacaggtcctgcatgatctgctccccattacacctcagctctcatttcctactactctctctcccttacttcgttccaccacagggccctagtactgctcagagaacatgccagtcatgctcttgtcttagggcttctgccttggctgtgctctgcttgggacaactgtccccagataacatgctaactcccttctctccttcaagtctttgcccagatatctacttcaggagatcctaccttaaccacttgatttaaaagtgtaatctaccttgaaatgcctaaaaaaaacaagatgtaggttttggtagcagggtagggggtaagagtggcaagaaccaagtcttgccttgaaggtggcaagaagcagctcaagaagcaggcaaggccaggcgcggtggctcatgcctgcaatcccagaactttgggaggccgaggtgggtggatcattcgaggtcaggaatttgagaccagcctggccaacatggtaaaaccctgactctactaaaaatacaaaaattagccaggcatggtggtgggcgcctgtagtcccagctccttgggaggctgaggcaggagaatcgcttgaacccacgaggcagaggttgcagtgagccgagatcgcgccactgtactccagcctgggtgatagagcgaga

SEQ ID NO: 224343 - DNA, 329 bp, Homo sapiens
ttttttgagattaggtctcactctgttgaccaggctggagtgcagtggcacaatcttggctcactgcagcctcaacctcctgggctcaagtgatcctcttgcctcagcctcccaaagtgctgggattataggtgtgagtcactgcagttggcctactgattcttaaaatgtgagtcagctcacattacttctctgcccaaagaccttccaataattcctcgtttcattcagagtacaagttgaaaccctcataatggcatacaggtcctgcatgatctgctccccattacacctcagctctcatcttgggaggggatcctctaggtcag

SEQ ID NO: 224344 - DNA, 832 bp, Homo sapiens
gccccagaatccctattccttctcagaattcccacctgaggccaggtgggcccttcccggggccttcagcgggaattctgagaccttcaggcgctgcatggtctgtgtccttcccgagaaccacggccccagttacagttggcacagccacggccaccaagaccagccgggccccaacagtgattccagggtgctcctcctgagggaggtggcccagagccaggtgcccagcatggctgctgactgccaggaacagtggttgggagccgcagccccacctaacccagcatgcagaacagggaccactgagagctgatgacgaccaaaaacaaagaagaaagcggcaactgcttcagcaagtgggacgccctgattttatggcccaccacacagctgctggaaccaagctgatccagacataccgatgtggagcgagtcacagagtatttgcaggttaaagaaaacaagttaacacactgcaagatcattttctgaggggtcaccgcacgcactgagatgtgcgcaacacaaattgtgaatacacagagaatgttctggaaggacacgcccacaaggctgccagggaaattggtgcagagcagacgaggggtggagcaaagcctatgtggtggttttaaatcaaaagaaagaaagaacacctgcagtacagtgagcccaggatgccttccctgattacctgggccttgaacatagccccaccacattgaaatacacaaagtctttaaaggtgaattttccacacagcctacggggcggggccaggggccacaaggcaccccgtgcctcagggcacggtggtctccggatgctg

SEQ ID NO: 224345 - DNA, 408 bp, Homo sapiens
gctcactgcaacctccgcctcccaggttcagttgattctccttcctcagcctccctagtagctgggattacaggcatgtgccaccacacctggctaattttgtatttttagtagagatggggtttctccatgttggtcaggctggtctcgaactcccgacctcaggtgatccgcccgccttggcctcccaaagtgctaggattacaggcgtgagccaccgcgcccagcaacatggccctttaaaaagtaaaaaatattcttagcttgtattctgtacaaaaacaggctttgggccagatttgactaacctgtaatctagactaatactaacctaaatatcaactatggttatttctgtttttaaatttctttgtatagtttctgcattacttaagcttttaaaaacag

SEQ ID NO: 224346 - DNA, 424 bp, Homo sapiens
attaggatagacttgtacatcatatgttcagaagtgagatcagattcccctgtgtctttgtgtttgtttgagctagaactcaaccacatcaccacctgagagttgacagttgaaaatatttctaaacctccagaatcttctatcttctgccctgactttggtataccaaagataacagaactcttctttgatgactaaggacttctcaaggtctcaaatcatcttttctgataccaaatctcacgtgccttgtggctaaggttgtagaaggggcaagacattacttggaagaggcttttgcgaaactcctggaataggcgtgtccttttaacttcccgctttctgaagagggtaaaaccaaaaactgccagtaaacctagagaatcctatgaagtgaggtttatggttaatctgaatctaactg

SEQ ID NO: 224347 - DNA, 203 bp, Homo sapiens
gttaagaacatagtctctggaatgagactgcctagtgagaagcactatgattagcactgtgtgttatctgtcaccatcaccatcatcatcatccatcaccatcactatcaacaccatcatcattaacatcaccatcactatcaccaccattatcaccatcactgtcaccaccatcaccatcaccatcaccatcatcatcatca

SEQ ID NO: 224348 - DNA, 485 bp, Homo sapiens
tcaataaatactaaaaaaaaaaaaagagaaactcacagtcttaaaagaaatcgctctttgtaagggtgtctccctctctgtaccaggaagagaaagttgactctaaatcaccagagacccttatcaatggagaaggcagcaacttgttttgtgtgcttctccgggtctttttcccaaaactggccttcctcactcccttctttgtttttagctgaagatggtacttaaacctgaattctaagccactcctttgagaattactcattttcttgggcatctcacatgtatatgcaaagtatacatgttaatatagctccatttgtttttctcctgttaatcttttgagctgggcatggtggctcccgcctataatcccaacatcttgggaggccaaggcaagaggattgcttgaacccaggagctggagatcagcctgggcaacatgacaggagcccatctctacgaaataaaaaattaaaaaatta

SEQ ID NO: 224349 - DNA, 498 bp, Homo sapiens
tagccttaaatattaataacaatatttaattctaaattctgctccaagacgaggatttttataatcctaatatttatcctcaaattcaaaagtatattatacaccaaatataggcagctaggaaaaaggaccaatcagagaaaaagaaaatgaacaaaaactttcaaatatgattgttgaaattaaaaaattaactggaaatcctaaataataaaatgagtggggataaatatcaagtttgagagctcaaagataaagtcaaggaagagcaataaaagaagaaagtttgcatggacacaaagagggaacaatcgacacgggggcctatttagggtggagggtgggaggagggagaggatcagaaaaaataacaattggtccttaccaagcttagtgcctgggtgaccaaataattcatacaacaaacccccataacatgagttcacctatataacaaacctgcatgtgtacccctgaacctaaaataaaagtttaaca

SEQ ID NO: 224350 - DNA, 136 bp, Homo sapiens
cttgcttgagttcagaaaatgttaatttccttttccttaaaggaaaggtcatcgtttaaggtcatctagttaattcatgggaacaattcaggcctcatctaatcatatttttaataaaaatattaactttgtaatt

SEQ ID NO: 224351 - DNA, 449 bp, Homo sapiens
cataggtgtttgcagctggtggcatcctcacaccacagttccatgctactctaaccctcagtcccgtatgggcaggttctctggtctggtcacaaactgaccttttaagtcgtagcctccatccagttgttcaaacttccatagctcccctcacctgcagactgcagacagagggactgtcagctgtcctcatccagccaaacacctcagctccaccttctaggcacaggctccctaggacgtctggccttatcatgcccagccaagaccttggagtcttgattgacgtctgacaggttgcttaacatctcaggattgttgaggggatagaatgagagattagatccgcagaactctgcacatgtttagacacagactacactgaggctttgtggctttgggcaatccaccactctctaagcctcagtttccacatttgtaaaatggga

SEQ ID NO: 224352 - DNA, 460 bp, Homo sapiens
aaaatgctcaacttttctcaattttaagaggtatgaattaaagccatgatataccatttttcatttatcagaagaacaaaagtcaaagacactgatcatattatgataataagtgtatgtgtagataggcactgattatcatagataggactgaacctgaaaaccaatttttagagtaatttggcaattgtgacccacatgtataaggatgcttagtggagcactgttcttacagcaaaaatatcagaaataaccttaaaaatgttcactgatcaggcaattattaaatagagcctagtggagtcttcagtgtaatattatgtaaccattaagaacatgctatagactgggtgcggtggctcatgcctgtaatcccagcacggaaagccgaggtggtgggattgcttgagcccacaaattcgagaccagcctaggcaacatagtgagatccccatctcta

SEQ ID NO: 224353 - DNA, 483 bp, Homo sapiens
aaagagactgactgtcatgttgtgaaatatacacttggttttcatctccatttcctggcacacaactcctaaaatccttggaatctccaaagtgatgtctttttggatgctcatgattgacagaccagctggcagcttcaggatggttcccagggaagaccaggtagaatcacaaggttcagcaccaccccgcaacctccaggtaggggagaggggctgaaggttaagcagatcatcagcggccaatgattgaatcaatcatgccttcgtaatgaggcctccgtgaacactcagaaggatggggttccgggagcttctggatggatgagcatgtggaggctcctggagggtggagcgcctggggagcacatggaagctctgcgtccctcccccataccttgccctacacatctcttcccctgtatcctttgtaatatcctttataataaactagtaaattccatgagccccaggaacatgtgt

SEQ ID NO: 224354 - DNA, 752 bp, Homo sapiens
aatgactctctaatgatagagtttcagatactacaacaactatgtaaaagagataaaaatgccagcatagtataaacatcaaaaactgccagaggagtaagagtctgccctgacagtgtttcagctacaccccattgtcagaatgtggatcgtaccattcgaattcccatgtgtccacatgaatgtgagcattcttgataatctcttatgtttagataccacaatggggcaccctcagggattttcctctcccttaatcatttcatcagtttgagattctagtgtggttggggaccaagaattgtttggtatgttagagaagcacataacattttaattgtgcttggagacagcgagactgaatgagggagagtaattaagaaacataaataaactaggaactctgctttgcctcacatcatatcattatggctcagaatgaactgctgagctttactatgagtgaaagaagcagccaaggccactgattttggaacaagagtaaggactatatggaatatgtaaggtgaagaatagaggcaactacagtgttattgtaattattttttattgtacatttacttcgtttatcatagaaaaacacactaattatgtgcggggtatatggcatgtgctctggccttaatccatgaacatcattatatcattttttattatttatttattcatttatttttgagacagtgtctcactctgtcgcccagtctggagtgcagtggtgctatctcggc

SEQ ID NO: 224355 - DNA, 316 bp, Homo sapiens
tttggagagctaagcaaatgtagtcggcacagtgctagaatttgaagagcatgatttcatgagaacgaaatccagaactttaactacgacagtgctgaagcaataaatgacttcaaaatatgaagccaagattgccagggtattactggatttctagctttggcaaaagaaaagacacaggaaaataacaaaagtcttagatccgtgtttgaaaaatattcaagcctgttggatgtcttttttttttttaatcttattcattgtggtatattagaaatggcttaatgcttaataaaattgtgatttgtagaatgta

SEQ ID NO: 224356 - DNA, 318 bp, Homo sapiens
tagatagcaggtggagagacataggtagtaatgtatggtgaattttcaatcattaatctgtttctttgttggtcacaaactcaagaatatattgcacgtataattctactcaaattatctaaaaaatacattatggttaacagacacttttacaagtagtatttaatcatactgtgaggattcaacattttttaaagggtaagcattttttataaaggggtttttgcttatctacattaattctttctactcaaccaaataatttacatgtcaaaacttaaaattgtatcttagtgattctcaaaattctcaagccag

SEQ ID NO: 224357 - DNA, 347 bp, Homo sapiens
gccctgccctagtggaattctttgggttcagtttttcatgttaaactcctcttcacccctaccctactttgtaagctctttaaaaagaaacttcctcctagggcaagcttatttttaaaaatactccatatacaaaaagttatttccaagccagcagattttggatagatataataggctcttctaggagtgctttttattgtgtgaatcctactttaattaccaaatatccaggttgcgcattctagttttgcacacctttccctctcctcgcatgtcctggagctgtgtaaccttcgtgtgcactttcacattttctcaccaacttgccgaggccccaagcccag

SEQ ID NO: 224358 - DNA, 412 bp, Homo sapiens
ctcagagagtgtggtgaggaggctttttgaacagacctaggggacacagagaggacaggggaatgcagactgtgggctgcccacggcagcaggggccagtggggaggcaaagaatcctctctgaccaccctccattccctgcagcttcctcaggcctctaggaccccgtcttatctttgtcctccccccctcctttgctccccctcgtctcccattcttctcttcttggtcatctccccccacccccacccctatcgcactggaaacagttgggctgtggtggctgagaatggggagggcggggtgggggagagggaggcccgagctgtttataggaactggagcagctccatccatcagctctgtttggaactggagaccaagcataataaataccttggctcctccccag

SEQ ID NO: 224359 - DNA, 301 bp, Homo sapiens
gggtgaggaacggcgtctgcgaatctcattacacagggtcccacgcctccctctgctgttctccggctcccgtttcttggctgccgccagtgggagtcgcacgggggtcacctgcccccacttttaatcaggacggggaaaaatgcaccaaaggagtgccgcgggttacctgagcagacccgggagcccgtctcctgagtcctgggggaggatcatttatttgtctgcagatcggcaagcgggcaggtttgcagagtccctgggggctagtagttcttataaaggagaatgcaccaccaag

SEQ ID NO: 224360 - DNA, 289 bp, Homo sapiens
ctgttgtgttggctgcatcctaagactggatgggaaaccaggaatgaagaacatgggtttagccaagggtgtggtagaagctgtgtcctagcaaggactgtctcttctaaattgttttttttctgaggcaatatttttcttttgacacacctttggacctacctattatagcttcttcactctgggcatggaccttggccactctatccatcacctttgttgacagaacagcaccagcttcttctaacaagagcatggtattgctttctccttcctacctggctggggc

SEQ ID NO: 224361 - DNA, 335 bp, Homo sapiens
tttgtagaatacacaccaaaaagttcttttgattccaggagattgaattctctcatcattcacctctctgtggacagacaagctagacatctatttgtatttagtaggtgataatgaccccttggcaagtgttacatctagttaccatcccgtgtgagacactcaagtgagtggggtatggggagaagcatggaagcaggaccttcctagggagaagcaaatcacagctgtaaggagggtagagaccagaggttttccagcccatccccatccttctgaggtcattgtcctgtgtcttcaggcagcaactctcagatatttgctgtgttcttcat

SEQ ID NO: 224362 - DNA, 427 bp, Homo sapiens
gtcaatttgcatttattttttgttattctacatttaaaaagcaaaataacatcaaatcaccactctctggatatgttatgcatggtaaaggaaatgttctgatctcattattttattatacattttcatatatatgttagacttttcttgaatagccataatttattatctatgagtatattaaaagttttcactttgcgttcagtaaaccatcacaattttttaaaaaattatgaaaagctgtaggaatcaaaaagtgaaataaaataagtatttatttcccaattttcagaggtatgaaatgaaggaagttaaaaagccaaaatctatctcaacatttctcaggtgaaaactaactcagaaatatttgagttgtgttaattttcactaagactgttaagggaaactgattttcttgtcaggaagg

SEQ ID NO: 224363 - DNA, 422 bp, Homo sapiens
ctcataaatggattaaactacacatggatgaatggattaatgggttatcatgggagtggaactggtggcttcattagaagaggatgagagaccggagcaagcatgttagcatgctcggcaccccccgcccaccatgtgatgccctgcactgcactctttagagagttccccttcccctgagcagaaaggatctcaccagatgtggctcctccaccttgaacttctcagcctctagaactgtagaaaatgtatgaattacccagtttcaagtattctggtatacaccaacagaatacagactaacacaactgaacccaactttgggcacatttctcaacctcctagagacttatctgctacatgggaatgtcacaatgcttattacaaagggctactgtgatcattcaataagaaagcaaaaa

SEQ ID NO: 224364 - DNA, 505 bp, Homo sapiens
acatcgaattggggaaaaaaaggttgtcattatttttccaaacatcttttttaatgcactaccctcattcctcatgttttcttctctcctttggggacttcaattaaacatatattaagccacttgaagttgtcccacagatcacagataatttggcttaaatttttttaaatcctctttgcttttggtttcattttggatagtttatattgccatggtttcacaatgaataatcttttcttctttaatatctaatctgccattaatcccatgcagtgcagttctcattttatacgttctagctttcacctctagaacagtgatccagagtgttgttatatcttccgtgcctcaaattagcttttacaatatgtggaatacagttttgatattgtttaatgccactgtgcccgttctgcatcagttttaatagactaatttgtctccttatggctattttcccacttgtttgtgtgcctaatatttctgattggatttcaaaaat

SEQ ID NO: 224365 - DNA, 466 bp, Homo sapiens
tcgaaatgtgaggacttctccaggagagagtctgaggagtagcaccactggatcctggagttattttattttactttaaaaaagttgttttattattttatttcactatttttgttgcccaggctggagttcaatagcacaatcatagctcactgtagccttgacctcctgggctcaagcaattttccctccttagcctgtggagtagctgggaccacaggctcaagctcccacacccagctaaatatgtgtgtatcaggagtttgagaccagcctggcacgtaccaagaccccgttcctacaaaaaaaaaaaattagccgggcatggtggcgggcacctgtagtcccagctacttgggaggctgaggcaggagaatggcatgaacccgggaggtggaggttgcagtgagccgagatcgcgccactgcactccagcctgggcaacagagcgagactccgtctcaaa

SEQ ID NO: 224366 - DNA, 452 bp, Homo sapiens
atttttttcttcattcctgtatcccctagagtactgcctaattcagccaaagcacccaataaatgtttatgaatgaataaattaatccaaagttctattataaatcccttttctaattcacccataatcttctttaacttcagctaaaaagcatctagaaaagtttgtcataaaaatctcttccttggttcacaaaggccaaggcctctcccaccaagagaaggatcagtcgatccaattaggacctgtctttccctgtcagtgcagaatacatagtgaagctttctagctttcaagtggagatttgaggaatctgcttgcatttcgtgtcccctactatccctaggttttttctggcgttcagaggcagacttcctcccactcccaggttgggtgaagccaagatctacttcatattagtgcttttccttatttccggagcaaggagtaac

SEQ ID NO: 224367 - DNA, 504 bp, Homo sapiens
cagaaacttgtacacaaatgttcatagaagcactattcacaatagacaaaagaaagaaacacccaaatgtctattgccaaattactgaataaggaaaatgtggcatatcatactatggaatattattcagccataaaaaggaagaaagcactggattatgatacaaatggatgaatcttgaaaacattatgataagtgaaagaagccagacacacaaggccacacattatatgattctatttatagaaaatatccagaatgagcaaatccatggatactgaaagcagattggtagttgtcagactgcgggtaggagagaatgaggagtgactgcttaatgggtataggatttccttttggagtgataaaatgtttttgaaagcagattgtgattagggttgcacaacactgtgaatatactattgttgaatttatactttaaaatgggaaattttgttgtgtgtattttaccaaaataataaatgaaactttcaaagttcagct

SEQ ID NO: 224368 - DNA, 143 bp, Homo sapiens
tctaacaattatggctcttaattgagcacttactttttgacaggctctgtgcctggcactgtacaaggggaccccgggaaaaggttcctctttcttttgttctcttccactctcatactcatgtgtgtgtgtgtgtgtgtgtg

SEQ ID NO: 224369 - DNA, 122 bp, Homo sapiens
aattgtgtatacataaggtatatagcatgatgttttgatatacatagtgaaatggttactggagtccagcccattaatatagccatcatttcatatagttttacccttcttttgtgttagta

SEQ ID NO: 224370 - DNA, 527 bp, Homo sapiens
agcctgggcaactgagcgaggctccatctcaaaaaaagcagtttgaggccactaagtatggtactctccagggctttaacatattagtatccaaaggcagattataggagtgttcattaattctcctgtgtacctttggacaacttaaactccctgttcctccattgcctcatctttaaaattagaaactatactaaattgtttataaagggaatattctgagatcctatgttcctagtaaaaccctgagtcattaagaaaagttcaggccgggcgcggtgctcacacctataatcccagcacttcgggaggctgaagcgggtggatcacctgaggtcgggagtttgagaccagcctgaccaacatggagaaacccagtctctgctaaaaaatacaaaattagccaggcgtggtggcacatgcctataatcccagctacttgggacgctgaggcaggagaattgcttgaacccaggaggcagaggttgcggtgagctgagatcgtgccattgcactccagcctgggc

SEQ ID NO: 224371 - DNA, 477 bp, Homo sapiens
gaggactacggccagaatacactcaaattttcccaggctagtaatacaacaagcatctttaatttaaaacaatgcaagatctctttctgctttattcttgcagattcttcatgattacaacataaacctgcgcccccttaacctgccactctctacttcgctggtgttgaacccaccagcagttttctttcttttttgagacagagtctcgctctgtcgcccaggctggagtgcagtggtgtgatctcggctcactgcaacctctacctcctggctgggttcaagcaattctcttgcctcagcctcctgaacagctggaattacaggcgcgtgccaccatgctcggctaatttttgtatttttagtagagacagggtttcaccatattggccaggctggtctcgaactcctgacatcgagatccacctaccttggcctcccaaagtgctgggattacaggcatgagtcaccgcgccc

SEQ ID NO: 224372 - DNA, 559 bp, Homo sapiens
ggtgctccttacctgggaggtctcccggcttagtttcggcctcgttgggtcggaatctccaaagacagtgggtttcagccagaaacgcgaagacgaacgcctagccggcgcgggcagaaccgaggacacaatgagatttgtgggaccgggcgcccagaggctggcgcgggggagaccccacagctaaaatgctcggtacccccgggcagtcgtgggttagttagaaccgcagagcctttcccgacccctcggaagcgcagaagtatccgaaatctacccgtttcttgggtccagcaaaacttttaagccaggtaaaccggtggttctgtttgtgtaaaggtgaccaggcatgattcctgtgacactttgctggggcagccatttctcctgccattgccgcggctttccaagatgagtgtccaagagtggagtaagggtccggggcctgagcaggacaaagacacacgctgccgcgacctgcgggaccagaacgaactctcagtgacatcttgaaagacattaggggtatccagatatttaagatgtaatgaaatacagc

SEQ ID NO: 224373 - DNA, 1121 bp, Homo sapiens
gcggagcgggtgcctcgggggaggaatgtgtgactcagtagccagttctcaggtccagtgttagtgatcctcaaacatatgccaaattccgggaagggggatggatgttctactcccagaagctcgtttactgcctggcagctgaacatcatgatctgggaatattctctgtattttggtcaatcaggtggtctaaaccttaccggctccagaaaacatttgggtaattagagtggtcacggatgacttaactggaatctgccctttcatgtgggcacctcatcctccctgcccctatttcgctgctcccttttctcctctctcagcctccaaaggacatgacagtttgcccaagatctgacctggaccttggctgatgcgatctctcgagcagagccagcgcatctggggctggtgcgtcatggctctgataggtttactcacagagtcccagggaaaggcctgcgggaggcagagactcgctatgggagaaaagtgagtgtctgatgaactgccttgcctaattacctaaattttgttatggaggaattaaaaatgcaacttcagaagcctttgaaggtttatctcaggcacccagcttgcggtggtgaaagcattttgtttggccataggggagtggtgggcaaggcttatattagagcagaagtatgttaatgccagcctcgtgttcttgtgggggaaggtggtttgcagcctaagagtcacagggcctgtttggcaggctgtggtccaagtgtgtttgtcagtcctggggagtaaacacacaaatattaattcgtctcttctccctggaacatctttgcttctgcttgctctgttctctgagaaatcccctctagatggtaaatttaattcagtataaagagataacactgttagaccgggcgcagtggcccacacctgtaatcccagcactttgggaggccgacgtaggtggatcacctgaggtcaggagttcgagaccagcctgaccagcgtgatgaaaccatgtgtctactaaaaatacaaaattagctgggcgtggtggtacatgcctgtaatcccagctacttgggaggctgaggcaggagaatcacttgaacccggtaggcgggggttgc

SEQ ID NO: 224374 - DNA, 411 bp, Homo sapiens
ggctggtctcgaactcctgaattcaggcaatccacctgcctcagcctcccaaagtgctaggattacaggagtaatccctcatatgaaattttctaatgcttgtaagctcagttattggtatgggagacctgtagcagttacatcaatttataggaaaaatagtgaaggtatcttaaaaagataagaaatgaggtaatgcttttcttgtcactccaagtcttaaatttattgtgacatgtttgctgttctgcagatgtgatcatctgtgtggcacttcctgtcagatgcacttggatcattgttcttgattatcagttttgaaggagaatcgcttgaaccagggaattggaggttgcaatgagccaagattgcgccactgcactccagcctggcgacagggcgagactatct

SEQ ID NO: 224375 - DNA, 393 bp, Homo sapiens
catactgattattattagctgaaagcacttgagaaacagcagactgtacaggaagggctttccaacctcctcttttctacctaaaaacaggctagaaaatttcccatgataaaggtgccctccctctactagaaagagaaaaacatccttatcaccagagatagggaatcaatgccaaaatggatctgaacaaacttattggaataacccttgtcttccactacttatccccaatatagctcttagtaatttccccaagcccctttgtcttgtcatttcttcacaaatttatcatttctttgtctaaaacatatataaacttgtctgctatggtgacttcttcgggtctacatttgcttgtgaggactcccaggtacatgtaaaattgtaata

SEQ ID NO: 224376 - DNA, 479 bp, Homo sapiens
gcaatgcagttgagtgagttggctagcagttttattgattcattgactgattcctttttgctactattcatttacttattcagtgcctactctgcaccagggtcttaacatacattatttctcatccttacaataggcctacaaggtgttggtattgttaatcctttacccccacactgtaccccaccttcccccaccgtgagccccagcctttctcagtttcacagatgagaaaatagaaatgtcaactgactgccaagctcctgcagtttgtaaattgtataatcagatttcaaacccagtttcctgtagctccaaagccaattggcccataatgccttttccttgccagggttgggatttgtgtttgagacagtgagctggggggaattgagagtgctaaaaagaggttgaagtgacagctcatgattaagtagacagggaagagaggaagccaaagatgaaggctggtggatggg

SEQ ID NO: 224377 - DNA, 156 bp, Homo sapiens
aaagccccattcttttcctcccaatcaaaaaacaagtaactgccttggtttcatctgttagaaatacccctgtggggtctatctttctgaattcttttgattactataaatgcattatagatcacgggaatttttttttctttttttttttttttt

SEQ ID NO: 224378 - DNA, 333 bp, Homo sapiens
aaacctctaacatagaagaaggagataaaatgaacaaacaataaaaagcaacttaaaaatggacaccatataaagaaaggaaaacagtttaaaaaaaaaaaaaacccaaaaccctattcttaagctacagagaaagcctggccaacatggtgaaaccctatctctactaaaaatacgaagtattttagccaggcatggtggcacatacctgtagtcccagctgctcaggaggctgaggcaggagaatcacctgcacccgggaggctgaggctgcagtgttctgagatcacaccacagcactccagcctgggtgacagagtgagaccttgtctc

SEQ ID NO: 224379 - DNA, 878 bp, Homo sapiens
aaatgttatacaagtgcagagcacttggctgccatccccctctcagaccatcaacagaacttgaccttggccaagattttgcctcatcctctcggcatttcagcatagagttgcgtttcagccatggaatgcttaaccaaaagcacatgctgtagtggtggtttccaaagagtaagtttttgcaaaaagtccacataatgtttcctcataacagcagctttctctgaaccaccaacccaacaaacctctaagtggtgattttttggcttatttgtccacaaggactgtgattttttgttttgtttttagcaatactttattaaagtgcagtataagtaacatatgataaagtgcacacatctaagaatacaactcaatgaattttgacaaatgcatatatccatataaccaccaggggctggtgtttttaatattttgtgaagcacctattctaatgatgtacgttttgggattggaaggttgtgcattcttctagctgagaaaattactataaaacagtaaatccagatcaaaatgtgatgaagatccacctgccacagagaaagtattaatagaatataaggctagggtgtaggagaagtggcccaggaaagccatccatgcaaattttgtttccttcctacttgagagggttggggatgagaggtccgtccttccctggctcataagcccatgagttgtgtaaaacactgttcagtaaggcagaatataagtcctcttatatattgagtccagacagttttcccttttgtcacatctagtggatttggttattgcaaagcttcatgtttgtttttagtaagttaatttttaaaaataggtaaaatgtgcacatagtataaaatttttaaaaaaca

SEQ ID NO: 224380 - DNA, 415 bp, Homo sapiens
cccacaaatttcagtttcctcttttaaaaatccagacgagtgtcttatataagttaagacaaaaaacacatagaagagtgtctgatgcatagtaagcgctcaataaatactagccatcacaatagtaccatattgttattggttttttcatgcagattaactgaaataacattatctggcatattccaggctttcagtgattttctttttgttttgagatggagtcttgctctgttgcccaggctggagtgcagctgcgccatctcagctcaccgcaacctctgcctcctgggctcaagcgattctcctgcctcagcatcccaagtagctgggactacaggcgagcaccaccacgcctgactaattttttgtatttttagtagagatggggtctcaccatgttggccaggctggt

SEQ ID NO: 224381 - DNA, 495 bp, Homo sapiens
gagaccgagattccctcttgttcctcaggctggagtgcaatggcgcgatctcagctcactgcaacctctgcctcccgggttcaagcaattcttctgcctcagcctcccaagtaactgggattacaggcaagcaccacccgtgcctggctaatttttgtatttttagtagagagggagtttcacctgtgttggtcaggctggtcttgaactcctgagctcaaagtgatctgcccaccttggcctcccaaagtgctgggattacaggcatgagctactgtgcctggccctcagtgattattttcaagttattgattataggaggtataccagcatactctatgtgggcttctgcttttgtcagcaaaataacttttcatttagtaagtatcaaagggaaataaaaacttagcattttgtataatagtgtgttaatctgtagtgaatcaggtaaaaacaacaaatctgagttatgtagcactgtggggcctggaggct

SEQ ID NO: 224382 - DNA, 437 bp, Homo sapiens
tcatcctcaacaagaaatgtatgacctcaacaagaaatcagcctgggctggaagagaagttgtcagagaacctgaggaagcttgaggttattctcaacactttgtaaagtgttctataatttgggtatctaggtggggagtccccagaaggccctgcttgaggtggtatccaatgtgtactcctacaaagacatgaaaagatttatccccattctttcctgtaatgtgacaagacactggatgacagctaaattactgctgatcatatttttgagagtatggggagagcatttgagaaaaagctttgtgaaacctcttgatctgcagaacctctttatcatgttttaacctctcagcttaatagttatattttatgatacttcacaacaaagtccaatctttcagaattaccatattaaactcatacctctgtatat

SEQ ID NO: 224383 - DNA, 148 bp, Homo sapiens
tttcataaagattcaagaagatactgcatcaataaagtaacaataagatgccttccagttttaaaataggggcatagaggcaggctggctttactccctctcacagaaaaccaaaaccaaacatacagcaccaatatctacaccaaca

SEQ ID NO: 224384 - DNA, 407 bp, Homo sapiens
tttttttggagacagagtctcgctctgttgcccaggctggagcacagtggtgcgatctctgctcacggcaacctccacctcccagcagagattctcctgcttcagccttatgagtagctgaggcaggagaattgcatgaacctaggaggtggaggttgcagtgagctgagattgcgccattgcactccagccagggtgacagtgtgagactccatctcaaaaaaaaaaaaagaaattgagaaacagaaaggttaaattactagcgttgaagcatagaacttccagaagagtaaaatgggatttgaatactggactccagctgcaaagccctacatagtggcctccctctatcccattgttaactaagaagtactggtgcctccattctgcaggtaagtagaggctga

SEQ ID NO: 224385 - DNA, 488 bp, Homo sapiens
cttctacctgctctgttccagcttcactggcagccgattggatagtgcccacccacattgagggtaggtctttctgtcccagtccactgactaagatgtcaacctcctctggcagcacactcccagacacacccagaaacaatactttaccagccatctagtcatccttcaatccaatcaagttgacacctaatattaaccatcccaagtaatgttccacaaaggcccctctgagagcacaaaggtacagagcttgtcacgtgattgtctggcagaagaacgttccaaaccatgaaactgcaattgcaccagtccaagcgcagatctgagcttgcatgctgaaaagacagaataaagatgctccgtggttggctgtacagtacagcctagagtatggcagggagtcaagttggaaatgtaactggaagccaaatgtcttaagtatcttacagaccaggatcagctatttggatttcattctaattgca

SEQ ID NO: 224386 - DNA, 507 bp, Homo sapiens
aatcccaccctgggcctccagctccttctgaagttggaagcttagcttacaggcagtagtactgtcttgggattctctggggtggttgccaggagggaagaggcagggataagggcttgggtgtttcttttatttaaaaaaagtattttttaatttaaaattttggaaaacttattgactaggtaggaacggttcaaaactcagaaagtaccaagactatgaaatcttcctctggcagccatcctggtgtgggatcctattatttcatgcttggcctatattctactctctaatgttttgcatttcatgttatttgtggtaattttaaaacttttgaaagcagtttttgtatacaatctcacttcataattggtctactgtggttctgctaatccccttcagctgcctcatgatccacctgttgatttctcactttttaaaattagaacaagagttgcatccaaagctcacagtaaagaataaaataaaattatttggctcattata

SEQ ID NO: 224387 - DNA, 332 bp, Homo sapiens
gttatctcctaatcaaggaaaggctaattagctgattcatggcataaatctacagacatttactaattccttttatggaatcttcaaatatgtccaggccattctagtctccataaaatgtgactgtgttttaaagatgaaaatgtttattctaagaaggggtgtctggtttgttcagaactccgcaaactactgaaatgatgttttcaggaccaaaacagcatttggtgattatataaatcaggcatgaacatacccacacacatgcatgcacagtttacagctaagaggacatgtgaaaattcccctacagaaagcagagctacggaata

SEQ ID NO: 224388 - DNA, 2089 bp, Homo sapiens
  misc_feature (519)..(519): n is a, c, g, or t
  misc_feature (608)..(608): n is a, c, g, or t
  misc_feature (684)..(684): n is a, c, g, or t
  misc_feature (739)..(739): n is a, c, g, or t
  misc_feature (1162)..(1162): n is a, c, g, or t
taaaatctaggtgtgatgcagttcagaataaataaattcaaatgacataggttgccttgctttgttgtagttttcaaaaatggacacaacagagttcatatttgataatacaaatagcccttgtcggtggcatgatagctttatccatcatttatagtttatgacttgtggttattttaaaacattgaaagaattttgaaaaaagtcataaatgtctgtaacactagcacttttaaggcagataatagacatctaaaatcttcagggcatggctatggctttagaatcatctgaataagttgaaaatatttaagaaatataggtctgttcatccaaagaattaaataatttgcctttgtcacgatggaataaataaaatatcacaggttatttttgttgtggtagatgccttttaacaaaaggcaatccctggagactgttgtagaaaaggacaaagcaaaacgggtgttttggttttgctttattttgattgattgttgtttgttgtcattactttcnttgtacaatcacttttccatggtcaccctcttttctgctttatactaattgccctgttgaggtgtttccatgtcaaatgcagctcttgncggaactgaaaatggcagtgccaagggagctgtgcaagtataatcaaagctggaagatttcctccatccacccgcnaccccaaggcttaagcattcccttaggaaccaaagctgactctttgggaaagttntcacagccttattaggttacaaccctgaaggtgttttgttgttttgaccttaaaattttgcgaactgttttgtgaactgtgtgtgtgtgcacacacatgtgcaaaggagttgcttgcaccttgagagagtcaatttttctgcctaagtgaaaggtcaggaactgcagttaacccagagtaaaatattggttgggtgaagggctcacttctagtatagtcagaatgggctcaagatcttaggaggatgataggtgatgaactgcttaaggtaggtactgttgtgtttgtgctttgtctcatgtggacaaattaccttgttgcatatgtgagttatgtggacataaacatatacagcagttactccctgactggctggctttcttaaagtgatagtcagaatatagcctgtactgtcagatatgnaagatcaatataattgaatgaaaaagaaagctgaaggacaatccaagaataatataaacataagctattttaaaacattagagggagtgctttatgcaaaagagaaactgaatttattgtttcattctctcttctctcccttcacccctttcaagaaaacgcaaagccacaagtgagtggttgtatgtgtctgatggcttatgtaaacatagaagaagtcttcagatggctaaaataaacatgcgcgtgttaccaaaggatatgtttacacaaaccatttgctcagcctctgaaataatgaataaatgaagattttactaaaataattgggaggatttttgtgtttctgcggatgccataattgaatggcaccaaagagacttttatcagctattttccgtgttacatgtgttagcagttcctttctgtgggttgaatacttcattctgtagttactttacacatgtttttctaagaaattgtcgtttattactgcaattctagagagttgcttgatttctcaagagaaatttagcagccagtaaaggttatttggatctggttggtcaggagagggagggcaaaaaaaaaaaaaaaaaagaaaaaagaaagaaagaaaaaaaaagtgtgggggggtaatagctctcattttatccatgtaacttaatttgcataacactcacctcagccattttccttgctttgttcataacattttctttgtaaaatgtatgctctcaaaagaatgaatatttaaacaaaaaataactttcaataatgggttgcaaaccatatgtttgtattacatatatgtgtttgtgtgtgtatgcatctatatgtgtgtgtgtatgtagtgtgtgtgtatatctccacatatatgtggcatacgtatgataagggcagtatgtccttaggtaatataaagag

SEQ ID NO: 224389 - DNA, 408 bp, Homo sapiens
ttctactttcacaggaaaagaatccatgttattttatatatgatcccaaaatcagttccatttctaattttgttactagtattgtactctgtctttttactaggaagattatgtagtgaaacctcacaatttatattttcctacaatttcttttcatattgagagaccttataatgtatcactgacagcatagtgtagtggttaggagcctgaactttggagcctgatgaaatgagtttaatttcctacttcttctgctcatctgttaatttaaactttttgttaatgtaatttttgagagcgcctcactctgttgttgaaaggtttctgtgatacactatatataaatttcttagcctggggcctgactcatggtaagcattcagtaagttataatattggttatgt

SEQ ID NO: 224390 - DNA, 1319 bp, Homo sapiens
ctgctgggccttggaagtatttcagttcggaaccccaattctaaccttagcttctcaggccattaaatgaaatctcatttctatgatgcttcctgtcacatcactgtgctgctgagaacatgaagtctgtgggtgaattggtggacgggatccagaatcattacttggcagtggattatagtgtgatgactcatttccggtggtctccaggagacttggctgggagcttctcttggagtctagggttagccagaggctacatgttttaggcatcttaattcatattttatctaaaggcatataaatccttaaaaaaaatcatttgacttcatccttgctccctacatccagccagtaaccattgctttgttttacatcgcgtgcttcaggctttactacagcctacctggattttgcagtagcttcttaaactgcttaaactttggatattgccccagccaacacattctgccacagagatctctctgagttaaatgggattgtatcatgccccacacccaagcagatagaaactgtcaatagatacacttagaatgaatatgcatggaatcaaattacattcagaatctaccactataggtagtgaatacaacaggatagcagaggctgggaagggtaatgggggttggggggtgggaggataaaggggttgggtaatgggtgtaaaaatctatagaaggaatatgatctgttgtttggtagcacaatagggtaaatacagttaataatttattgtatatttcacaataaaggagtggatttggaatgttctcaacacaaatgataaatgtttgaggtgatggataccccaattaccctgatttgatcattatacgttgtatgtttgtatcaaaatatcatatgtaccccataaatatgtacaactattatgtatccataaaaattggaaataaactaccaccatctttcttcagcctattttcctatctcctctcgcaccatactaggcacacaatctctgtacctgtgctgtcttccaagccattgctcatgttttaagaaatatacttattgtttaatatatcctgtaccactgtaggatgactgtagttaacaataatgtgtagtttcaaatagctaatagctggaaggaagttgttgaatgtttccaacataaagaaatgataagtgtttgagatgatggatatgctaattaccctgatctgatcactacacattatatgtatggaaatatcattgtgtaccccatgaatatgggcaattattatttgttaattaaaaaaataaaaaaaagacccacccactgtttaaaaaaa

SEQ ID NO: 224391 - DNA, 403 bp, Homo sapiens
gcacgaggttttgcaatttgcagtttgatgattcttttaacttgtgttagtgaactcagagattaaactagttatgaaatctccggatacatgaagtgtatgtttgtttagtaataggctaaagtaaaatgactcaatttggtctagacttggtctctaagctggagttccaacgagtttaggatctcttctttctgtaaattcagagtttttatagtcaggaaaaacagaagacatattttattggttctagtagaaaactcttaaatagcatactcatagccatgttcaaatcctttgctgtcagaataaaccaatgttgtattagttttgctgtatttcatcattgtgttttatgatcttgtatctctacctggcgctatggaataaataaaatgcctta

SEQ ID NO: 224392 - DNA, 1521 bp, Homo sapiens
gagaaatcttggcatgaccagtgtgcacgtttccatcctgaagtgttttctcttcactagaaatgtgattttctataaattccccttgaatttatagtgtgatgccaaataaaattttctcaggatcttattaggttgaaccatatgtaattgccaagattttactattttaacttagaaaaaccatcgtttcatatgattcaccctaatagatacctccattattctctaaatgaaatagaagactttggagtatatgtttttaaagtaattttttaaaatatggtaatgtattaaacttatttttatagttatgaaattatgtgtaataatgctttatgttatacattaaatgtaaagacttgtgaatccatgtttgattgactttcatagtttcctgcattgaaataaaatcactatgaattctagtttatcagcatgatgttaaatgtcagtgccataccatgatgcagcaccatgacactaacgccatgaattcaaacagcacgttttacacctggaacttcatcagaccaatactttgcagttagagagaatttaatatctagaaaagcttgggaggttagtcaggacttagggagtatacataaatggttacttgttgtaatgagccctttattggtgaggttgcaatagcttccagctcttactgtgtcagatgaagcatctgtcattatcttaagcctgcagagttgaaaggttataggctctttcctaccctctcatcataatttttccaaagcaaagaggaacttggcttctggggttcgtgccttagtgagaaagaatcttttccaatagttccaatgggggaatttttggcttgctgattttatcaattgccttgacacctgacaaaccctaaatgaagtctatgtaggtgagtcatctctgttccacctgatttacagtattggaatttagacttgcaaaaacatcattctgcaaatatcttagataattacagaatcaggagcatttgagaactctagaggtctcagaaatcatcacataggggccatgcttcgtagatagggatgatagagaggagacctgcccaagttgaatttccatggccttcctcccttccttagttccatgataaagtatggacagtaaaccactacttgagctacctaaggtgaattaactctcagggaaccctcttccagttctttaccttgcacagtgaaagaatcaatggcacctagaaagttaaatccctttaggcccatacactagagacatgttttgtttgaacaatgtagtttaagtacttgaatgtcacactatataactgaggttagagaaaatgtttcttctagcccttacagggtgtgattcttaaacacaatgtccaaggtgtatacaaggatatgtattgtaacaactatgggtatgtatattttgcagagcgtagtttctatatcttgaaaaggaaaatattttcataaattgtttttataagtactaataaaataatatgaaagaaagctatat

SEQ ID NO: 224393 - DNA, 1011 bp, Homo sapiens
ggggaatggggagggatagcattacgagacatacctagtgtaaatgacgagttaatgggtgtagcacaccaacatggcacatgtatacatatgtaacaaacctgcaggttgtgcacatgtaccctagaacttaaagtataattaacaaaaaattaaaaaaataaataaatgcaagcggaatattgtcaaaaaaaagaaaaaaaagaaaaaaactggataaattaggcttcatcagaaacttaaaatttctcagctaacaaactgagagaaaaatatgtgaaaaatatgtgtttgatacaggactgttgtcacaagatatgtaaagaactacaaactggtaataaaagtcagcccctttgcctgcaaaaaaaaaaaaaaatgggcaaaggatttgaagagacacttctcagagtaagatacataaatggccaatcaatacattaaaaagtgctcaaccttatcagtcatcagagaaatacacacttaaactgttatcagaaaatatccactagaatggctaaaagtaaaaatgacaatgccaaatgttgatgaagctgtggagcaactggaactctaatacactgttggtggaagtataaaatggtacaacctgtttggaaaaaaagtctgtttctttaaaaaccaaacacatgcctaactctatgacccaacaatttcattcactgccatctacctaagaaaaacaaaagcatttgtccttccagacttgtacagtaatattcatagcaggtttattcataatacctcagaaactggtgacagtccagatactcaccaacatgagaatgcataaactgatatgttcaaggaagtctgttctttctttatggagaagtacttttaaatagttgaagacttatctttcatagcctcttctctttaatggtcaaacacctcaagttcatcccagcagttactacaagaaatgtttttcagtttcttcagacacctgccccctttcccattactctcctttagacatgctccact

SEQ ID NO: 224394 - DNA, 428 bp, Homo sapiens
aacaaaagctctctgagggcaggatttttttatggtgttcactgggccagggaccaggcgagccactcaaaactgcggggtgaacgagtgagtgactctccacccaggctgaagagcagcagcagagaacacccacatctggggcccagcaaccctctttaagcgcctgcaggagaaggggaatgtgcaggtcacttgagaggctcttttgagaaatggctgaatccaagatcggggcagaagaagtacaagacatgtctgaactatctttttgtgccacaaaagtaatgaaatgttcaaagaatcccgacaacatgtccaaaggacccaggagctcccactggccaaacctgggacaatctgagcaccaaaataaatcataagtgtaatggattcaaatctaataaataaaattattcataagtcca

SEQ ID NO: 224395 - DNA, 511 bp, Homo sapiens
taataggagacatggtggaggcttgccagcacactccctgacatcagagacctaagtcattatcacgaagcccattttgcagatgaagtagcagagattaaatgcaaagatgatatggagtggcgtaaagagtacttgaacaggagtcagatggccaaacctcaactctgcggctatcaacgggaccctgaagaagtcacttcacttctcagttctcatgttcctcaattataatatcaggctaatgggcttactttccagaataccagaggaagaggttgagaagttatcctgttggcagccagtgaaatgtaaaggttttcaaacttaggaatacaggaaaacctcatgtgttttgaggactactctggaaatagtgtggagagttaaattgagggactgagacaagtaagcagaccaatgccacataatatacaggaaggaggcccaagagcccgttctcagctgctggtgacgagggtaaaacagggcctcaccccagaatcagaag

SEQ ID NO: 224396 - DNA, 803 bp, Homo sapiens
tcagctctctgatttcttctcccttcgcccacagcacccacagttcaggggaaccccccaaatcctactccagcaccatgagtttggagacagactccataacccacctcagcccctcaagttcaggggcaacccctaccatccagccgagccccagctccacagattcaaggatgataccctcctccccacaaccagagacaatcacgcaccctagttctggctcccccagtgcagagctcaccccctcttcccattccaccctccccagttccgaatccctgaccccgcactggagccccacttcccacagccccggaacggagcccttgacctccactgaccagaccttggagccccctggcccagctccaggtgacactgggccccgtgagttacacaggaacccgagtgtggtggtggtcgtgtgtttgctggtgtctcttttgctcatcgggtctgtggtcatggctgtgagattctgtcaccggaatgagtccaagtttgagaacctggacgaggtgtccatggtaaggtagggctgggctgggggctcagccctggggccaaggcatggttgggggagctgctatcccaagcagggccaacctgggctgcagagccttttggtgtctgaatgcctccctgtgtgttccttcctcagggatccgtgaatgacagattgtcctttgcccaccacctccaggagtgagccctgaggagccaacagagatgggggcatggatggggctggggttcctggggaggagcagaacctgaggaaataaagcccctaccattca

SEQ ID NO: 224397 - DNA, 713 bp, Homo sapiens
tcagctctctgatttcttctcccttcgcccacagcacccacagttcaggggaaccccccaaatcctactccagcaccatgagtttggagacagactccataacccacctcagcccctcaagttcaggggcaacccctaccatccagccgagccccagctccacagattcaaggatgataccctcctccccacaaccagagacaatcacgcaccctagttctggctcccccagtgcagagctcaccccctcttcccattccaccctccccagttccgaatccctgaccccgcactggagccccacttcccacagccccggaacggagcccttgacctccactgaccagaccttggagccccctggcccagctccaggtgacactgggccccgtgagttacacaggaacccgagtgtggtggtggtcgtgtgtttgctggtgtctcttttgctcatcgggtctgtggtcatggctgtgagattctgtcaccggaatgagtccaagtttgagaacctggacgaggtgtccatgtagttctgggagttggtggattctggcttggcccctgtgagcccccttggtggtggtatcatccggagaggcttctcgggtaccccattgctgccatcgctgccgagccgccttgtgttgcctggagaggtcgagcccagtacccatgtggtgttcaccattgaggcttaagggacagagaaa

SEQ ID NO: 224398 - DNA, 669 bp, Homo sapiens
tcagctctctgatttcttctcccttcgcccacagcacccacagttcaggggaaccccccaaatcctactccagcaccatgagtttggagacagactccataacccacctcagcccctcaagttcaggggcaacccctaccatccagccgagccccagctccacagattcaaggatgataccctcctccccacaaccagagacaatcacgcaccctagttctggctcccccagtgcagagctcaccccctcttcccattccaccctccccagttccgaatccctgaccccgcactggagccccacttcccacagccccggaacggagcccttgacctccactgaccagaccttggagccccctggcccagctccaggtgacactgggccccgtgagttacacaggaacccgagtgtggtggtggtcgtgtgtttgctggtgtctcttttgctcatcgggtctgtggtcatggctgtgagattctgtcaccggaatgagtccaagtttgagaacctggacgaggtgtccatgggatccgtgaatgacagattgtcctttgcccaccacctccaggagtgagccctgaggagccaacagagatgggggcatggatggggctggggttcctggggaggagcagaacctgaggaaataaagcccctaccattca

SEQ ID NO: 224399 - DNA, 371 bp, Homo sapiens
agacagactccataacccacctcagcccctcaagttcaggggcaacccctaccatccagccgagccccagctccacagattcaaggatgataccctcctccccacaaccagagacaatcacgcaccctagttctggctcccccagtgcagagctcaccccctcttcccattccaccctccccagttccgaatccctgaccccgcactggagccccacttcccacagccccggaacggagcccttgacctccactgaccagaccttggagccccctggcccaggtgagtattaagagatttgggtgtttgtagggaggtggcgggtgtaacaggctgcagttttggaactgaccaccagggggaggtacagc

SEQ ID NO: 224400 - DNA, 234 bp, Homo sapiens
cagtaacagttctattactaccaacctaattaaacaaaggattataagagaatgctacgaacaattgtatgccaacaaactggataacctagatgaaatggataaaatcctagaaacacacaactcctcaaaagtgtatcatgaagaaaatcctggataatctggatagatctataactaataggagattgaaacaataaagaaaagaacaaagaaaagtctaggatcagatgg

SEQ ID NO: 224401 - DNA, 455 bp, Homo sapiens
gtgtctgagagtccaagggtcagatcctgggtgttaatctctgtacccacaactctcttcacaggtgatttatgcagtcctatcttcaaactccatctatatgctcctgactcccctatctgtatctctacccttaccccagaactctattcaaaaatccaacagcctagctgcatcttcatttggagccaggacatgtcattttcctgattatgacaagccaaagactctccgaacccttcctgtggtgtacagaacctcatgtgatctgacctctgcaaatctttctgacctcttttgataccacacctacccaggcaattggcctgttctctgtcccaaaaatacaccatcttttctcactgtaaggtccttgtacttgctgttccctctgcctgtaatgcttttcccttgatttctttgcatgactggttcctttttgttattcatagctc

SEQ ID NO: 224402 - DNA, 179 bp, Homo sapiens
actttcatcaaaggagtttagtaattacaagtggccacatgactttttagtggttcagtttaaataagcctaattagattacagagttctagtgttacattttaatttgcttttaaaattttttggtttggatttatcaaaatctccaaagcacacttctttaaaatccaagtcgacgc

SEQ ID NO: 224403 - DNA, 549 bp, Homo sapiens
caattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctcta

SEQ ID NO: 224404 - DNA, 357 bp, Homo sapiens
gacttctatgtcagtgtttactattattattaaaaaattatattattgagagtttattttttgagtcctattgagatatggattgtcatcaaacttttatagtttttatttaaagcttttcactgatgatttaggtcttgctgagcaaatttacctagtattatctttaattatcccaagctatatcacacaactcatacaactcttccccacaggttgaggagtccttttgtttaaaattgtttcactgtaatgctttcttactattaatgtcagtatttctacctcagatgttaggtagaactgtgtttaacttggagtggcatttagttactcagatgttaggtagaactgtgt

SEQ ID NO: 224405 - DNA, 420 bp, Homo sapiens
gacaccaacagactcagtaagctgcccatcctcatactaggaaaacccttcaaagtgctgggattgcaggcatgagccactgcacctggctgaatgtcttgtttttgattaggcacttaagaaaggcctaggtactaaccataaaatatatttttataccttttgttgatactatatatatagaaaactgcacttatcataaccttagacaccttgaagaatgttcacaagcagaactaacccatgtgacccagcatccagatcaaaaacagcattatcagcccctctagaagccctcttgggccccttccattcactgtccttcttgtcaccagggtagctactatcctgacttttgatggcatagattagcattacctgttcttgtcattttataaataaaaccatactgtgtattct

SEQ ID NO: 224406 - DNA, 422 bp, Homo sapiens
aacatggaaatttttccaaaattgcaagaatacaacgcctataggttagacttacaatatgagaatggaagaatgtaaaaaaccacttcttctgaggcctttccatcccactgagggagatgctaaggggcaagtcagaagctcccaaggcccccagaacccatagtaacctttctagtctacagaagactctcttttctctctgtttcttgaaggcattttcccttgacctcccctttctgagacacctaatactgtcctatcaatgagtttgggtctgaagttgacaaaatcaaatgtgtttaagacccataaggaaaaataatgtttgaagtatctgtttaaaagacaaaatgcaaaaggctgtgggaaactagaaaatttatgatttgcttaaaggcaacctaatttttttattaaaa

SEQ ID NO: 224407 - DNA, 567 bp, Homo sapiens
cactgggagtatggtaagggctagatgagtgttagctgctgcaccgcaggccagacctgctcttggagtttggtcattgatgaaaggctgctgggagtctcagaccctatctgagaaaagaagaacacatcctggttcacctgagctcagaaggcatcacttctcaccatcacctcctcaaatctcagcgtgtgtcttacagagcctgagccagaattgtgggggagtggttgctgttttgttttaaagcatgcagataaaattccaattatgatgacacattcagatctctgacccccaaggaggagtcaggtcataggaaattcctccagccacctattgtcacctgcttttcatgacctgcatgagggggaaggccttagggctaggctcagagtggagagcctggatccacaggttgagccttcacgcctcaaagggcctgtgcctaggctgtctctgaagaaaacgagttgacctaaaatgaataaaaaatgggaagaaaatggagttaatttgtcagttccaaactcaaagacaaaataaattttaactgaattgcaaatg

SEQ ID NO: 224408 - DNA, 498 bp, Homo sapiens
gcggagtcctcaaaagtaaacagcttagtatcagtgatgttcaaaagaaacataaatgtccacagcagaagggcttgttcttggcagactctggtatgcaggagtagccatatcccacgtggctgttctatgccaccgaggccccttctttctcagcagcgcatggtgctgtaggctcactggtctctgcctttccactccaagagcacatatattcccccttgggccaaactatttttgactgccagtggtccacgaggctcaaactcttgtctgttacttgctacctaagaaaggcattttagaagcagaactcagtccttgaatatcagccccagagcataaattcagctcattttcacactttgtgtatcatgtatggttccttccatgctacctttggttaatatatatcttttgtcagttggatattgcactgcctttcctttggcatactctatttttttaaagcatgatacttctaaggaaatcagtgta

SEQ ID NO: 224409 - DNA, 2295 bp, Homo sapiens
agtcgctgtacatctcatggttgctaagaaacggagcttccacaaaccagatagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagacctgatcaaaggcaccatgaagggcggcctgactgtggaggacctcatcatgacgggcatcaactacctggatactcacagcaacttctggaggcagcagaagccgatctacgccagggagcgggaccggaagctgatgcaagagaaatggctgcgggaccacaaacgccgtccctcacagacagcccattacatcctcaagagcctggaggacattgatatgttgctcacaagtggcagtgctgaagggagtcttcagaaagctgagaaagtgctgaagaaggtactggaatggaacaaggaagaggtacccaacaaggatgaactggttggaaacttgtatagctgcatagggaatgcccagattgagctggggcagatggaggcagccctgcagagccacagaaaggacctggagatcgccaaggaatatgaccttcctgatgcaaaatcgagagcccttgacaacattggcagagtttttgccagagttgggaaattccagcaagccattgacacgtgggaagaaaagatccctctggcaaaaaccaccctggagaagacctggctgttccacgagatcggccgctgctacttggagctggaccaggcctggcaggcccagaattatggcgagaagtcccagcagtgtgccgaggaggaaggggacattgagtggcaactgaatgccagtgttctggtggcccaggcacaagtgaagctgagagacttcgagtcagccgtgaacaattttgagaaggccctggagagagcaaagcttgtgcataacaacgaggcgcagcaggccatcatcagtgccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaataggtgtctttcactcttgc

SEQ ID NO: 224410 - DNA, 845 bp, Homo sapiens
agtcgctgtacatctcatggttgctaagaaacggagcttccacaaaccagatagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagtgaccttcctgatgcaaaatcgagagcccttgacaacattggcagagtttttgccagagttgggaaattccagcaagccattgacacgtgggaagaaaagatcctctgg

SEQ ID NO: 224411 - DNA, 1815 bp, Homo sapiens
aacccaggacccttctgttccaccacatgtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagacctgatcaaaggcaccatgaagggcggcctgactgtggaggacctcatcatgacgggcatcaactacctggatactcacagcaacttctggaggcagcagaagccgatctacgccagggagcgggaccggaagctgatgcaagagaaatggctgcgggaccacaaacgccgtccctcacagacagcccattacatcctcaagagcctggaggacattgatatgttgctcacaagtggcagtgctgaagggagtcttcagaaagctgagaaagtgctgaagaaggtactggaatggaacaaggaagaggtacccaacaaggatgaactggttggaaacttgtatagctgcatagggaatgcccagattgagctggggcagatggaggcagccctgcagagccacagaaaggacctggagatcgccaaggaatatgaccttcctgatgcaaaatcgagagcccttgacaacattggcagagtttttgccagagttgggaaattccagcaagccattgacacgtgggaagaaaagatccctctggcaaaaaccaccctggagaagacctggctgttccacgagatcggccgctgctacttggagctggaccaggcctggcaggcccagaattatggcgagaagtcccagcagtgtgccgaggaggaaggggacattgagtggcaactgaatgccagtgttctggtggcccaggcacaagtgaagctgagagacttcgagtcagccgtgaacaattttgagaaggccctggagagagcaaagcttgtgcataacaacgaggcgcagcaggccatcatcagtgccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaataggtgtctttcactcttgc

SEQ ID NO: 224412 - DNA, 1832 bp, Homo sapiens
gagccatccaccagctgccccttctggctagctcctcatatcttgccataaggggcccatagcatggaactccctgatagtggggctctggctgcctcctggcctggataaacccactcctgccactatgcgcactcacactcctctctgtttcaacaactccaagcagagcaagttcacagagggccctgcagcggccaccgggaggaaacaggaggcaaatcccttagaggcctgttctccttggcgcctcctcacaccccttccccacagacctgatcaaaggcaccatgaagggcggcctgactgtggaggacctcatcatgacgggcatcaactacctggatactcacagcaacttctggaggcagcagaagccgatctacgccagggagcgggaccggaagctgatgcaagagaaatggctgcgggaccacaaacgccgtccctcacagacagcccattacatcctcaagagcctggaggacattgatatgttgctcacaagtggcagtgctgaagggagtcttcagaaagctgagaaagtgctgaagaaggtactggaatggaacaaggaagaggtacccaacaaggatgaactggttggaaacttgtatagctgcatagggaatgcccagattgagctggggcagatggaggcagccctgcagagccacagaaaggacctggagatcgccaaggaatatgaccttcctgatgcaaaatcgagagcccttgacaacattggcagagtttttgccagagttgggaaattccagcaagccattgacacgtgggaagaaaagatccctctggcaaaaaccaccctggagaagacctggctgttccacgagatcggccgctgctacttggagctggaccaggcctggcaggcccagaattatggcgagaagtcccagcagtgtgccgaggaggaaggggacattgagtggcaactgaatgccagtgttctggtggcccaggcacaagtgaagctgagagacttcgagtcagccgtgaacaattttgagaaggccctggagagagcaaagcttgtgcataacaacgaggcgcagcaggccatcatcagtgccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaataggtgtctttcactcttgc

SEQ ID NO: 224413 - DNA, 850 bp, Homo sapiens
agtcgctgtacatctcatggttgctaagaaacggagcttccacaaaccagatagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaaggtttcggacactttgttggcacggggccttgggggaaaggaaatctgggtggatgcttcatgcatgagctgaaggcagaacctgtcatataatattagctgacgtgtacctgtg

SEQ ID NO: 224414 - DNA, 292 bp, Homo sapiens
ggtcttcacccttttctcttcctctttacattctacccattctttaaaggccttgtgaaggcctttaagtgacctcctcttttctattacctatgtgtctcatggccactccctcagctgtttcacagagctttatttatactcacttcctttaaagtatttattatagtctttctcttggtatagctgtctctcaactgtaaacttcttaagaacagggatattgtcttcttgggtttatatattctccatagcaactagcactgtctttaacattgttattgctcgataa

SEQ ID NO: 224415 - DNA, 369 bp, Homo sapiens
tggtttccagcaattctctgcctcagcctccccagcagctgggattacaggcacctgccaccgtgcctggctgatttttgtatttttagtagagatagggtttcaccatcttggccaggctggtcttgaacttgctgacctcgtgatccacccaccttagcctcccaaactgctaggattacagatttgagccaccacgcccagctttgatgactaaattttaagaaatgctttagcaattcttcatacacctttcacttatcttatagttacttaattcctctactcttatcatttgatattttcattttattgtgtatctctgtaaggccaaatcaatagattttgaacaatctcacacttaacctt

SEQ ID NO: 224416 - DNA, 721 bp, Homo sapiens
gaaaaaaggtttaattgactcacagttccgcatggctggagaggcctcaggaaacttacaatcatgacaggaggcaaagggggagcaagcaccttcttcacgtggtggcaggagagagagcaaagtggggcaagtgccacttttaaaccatcagatcttgtgaaaactcacataccattatgagaacagcgtgggggaaactgcccccatgatccagtcaccacccaccaggtccctccctccactcgtggggattacagttcgagatgagatttgggtggggatgcagagccaaaccctatcagcatggaagttctggcctcccaccagtgatcctcactcttctcccagctgcagggtgaagaagccagtcagcatggtccttctctaatgatattatatagttagaatacaagttaaaataatttctcttggccagatgcagtgactcacacctgtaaacccagtgatttgggaggccaaggtgggaggatcccttgaggccaggagtttcagactagcctgggtaacatagtgagaccccatctctacaaaaaatttaaaaattagccagatatggtggctcatgcctgtagtcccgggttctctggaggctgaggcaagaggatcacttgagcccaggagtttgaggatgcagtgagctgtgatcgcaccgctatactccagtctgtgtgacaaagcaagaccctgtctctttaac

SEQ ID NO: 224417 - DNA, 680 bp, Homo sapiens
ccccaggtcctccccagcacaccatggaggcccctaagggctgggccttggccaggcgactggggaggggctggtcccggaagaaaagctttgtggggccgtgggtgcgggggctttcggctcatcagaagccaccagcccttgagacaaaacctcccagacgctgtgggtcagacccacagagcctcagtcctacctggtcctgggagggcggagggcggtgtgggcctggtcccaggacggcggagggcagtgtgggccaggcgcggactcccccgggcgccctcatggtcttatctctgcccggccggcggaaggcggcgggaacctttgcctggtacaaccactactgctccacagcccaggaatttggcattgaataatttttaacttctgctctgagagaggagctggccttggatttagtgtccgtgcatgcaggaatgccggggctccattttcaagggacggcgagaaggacacgctcggttccgcactctcaggctcctgctcctcacaaggcaagcgcctccagggagctgcatttgggaaaatatccaccaagcactaaagaaacacaaccataaagaaccataaagcatccacgcggaaaagcttattcagatcaataaagctgcggcgggccgggcacagtggctcacacctgtcatcccagcact

SEQ ID NO: 224418 - DNA, 599 bp, Homo sapiens
agcagactcgtcctttaactgagtttcgctggggccggcttggggacccacctctcacgagagcactggcctgccggcatgccagagcccctgacaccacacaggagccgggtggggctgggcgtagcccgtggtatcggccccccagacctggccacctaggcccagggcagcacccggggaggacgggggtctgggtggccggtggcttcccgtggccgctgctcagccccactctgtccagccccctgggagtggctgtggagggcatcctgtgtgctggaggggcaagatggggagggctcttgtccagagacccaggggtgccgtttcagaaaacagagcatcatgtgctgggaccagacacagctcatcttttccaggggacggcgagaaggacacgctcggttccgcactctcaggctcctgctcctcacaaggcaagcgcctccagggagctgcatttgggaaaatatccaccaagcactaaagaaacacaaccataaagaaccataaagcatccacgcggaaaagcttattcagatcaataaagctgcggcgggccgggcacagtggctcacacctgtcatcccagcact

SEQ ID NO: 224419 - DNA, 625 bp, Homo sapiens
ttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatag

SEQ ID NO: 224420 - DNA, 489 bp, Homo sapiens
agctttccctgagcacccaagtctggaccaggtaccccagagcccagagtcctctgttcctctcctggggagcacccctatgctgctctgcaacaacaggtggactcatctgtctccatcacactgtggccacaggatacaggtacagatacatcactgcagatacaggtcagaggtcagtgtgtctcattgctctgctgatagggagactcaccaggaacctgctcagccctcttgaacccttcccttggcttttccagaacactggcccccccaccccgggcctggaccacacccttcaggtctgtctccggtacgctgggagcctgcaggcagggtgccagctctatacctactggttctgtaatgcacttggcgcgcatgatttgatggaccctgtaagagccccttccctctaaaattgttttcctgtcattcgtccatgcctaaaattctccgataaagcccattaaataaaaactcagtatt

SEQ ID NO: 224421 - DNA, 444 bp, Homo sapiens
catggatggagctgagctctatatacactgtggtttttctatacaactatatccatgataaagtttaatttataaattaggcacagtaagagactaacaataaccactaagatagaacaggtatagcagcaaacagtaataaaagttatgtgaatatagttttggtctctctctctcaaaatatactatcatactatattcacctattttcagaatgcaggcaactgcagataactgaaaccacagaaagcaaaaccgcagataagggtggactactgtactaaatttaacagatcaggtagaaattgtcacacctggcaaaaggttgctacccattttttttttcttaccatacaatttcaagatagtagtaaaaaactttaatggtcagctctgcttcctcacttctgataacaattccctgcttccaatagtctgaagatt

SEQ ID NO: 224422 - DNA, 414 bp, Homo sapiens
cggccagctctcgggtccaggttgggggaacagagcccactgccagccccggctcatgccctccagacaggtccacaacacacgccgggcagcagagccaggcgcaagcagcatcgggcagtggcgatgctggggccttgtgatgcgccaggccctcgggtgcccccacaacatggatccctgagggtgccaggcacagagctcagagagcaagcccatggtgtgggaacccacgccccggagccccctgagctccccaggcccgttagccaccccgccctctgaggtcattttccagccggcccacacccactggaaagagagcccagaaccaggagggcgcccgccttgccaagccggaggggagccacgggggggcggaggaggcagtgggaacccgaccaggtggcaatt

SEQ ID NO: 224423 - DNA, 421 bp, Homo sapiens
acaggagtcccatgggaaccacttggcactcagatatggacaatctggaaatgcaggacagttaaggcctgtaagcttgccctgaccactgagggacaggagctcatagaaaaaatgcttgtctcatttttagcccagggtggccaattctgagatgcatgttaaaaggttcctcagaagctcccacaggatcaagtagcagatattcataatggttgccaatttgaaagggacccttgggttggctttctctccttccggggggtcattcttctgtcttatcacagtctattccttggtgtcacattcccaaataaactccctacctacctccaagttgtttgtacaggctttgctttcgggagagcccagactaagacaatgtggtaacgtaaaagactggtggcttgggagccagaca

SEQ ID NO: 224424 - DNA, 489 bp, Homo sapiens
aggtatctgctctgtagcatgtctagtgaacaggttaaagttaagtcttttctatttggatacatgtgatcattggctgtacatactgcacctggccccctgtggtcaggtcttaaagatgacactttgcactaaagtggcacatacggcaaggccaaaagagaaatttatatatcagaatgtcatactttagagggaaacatctatttttaaaattaatattttattaccaatttttaggaaagttatttgtatgagcagaaaagtttgccattttccttgtgttataaactagaaaatgcaattacctgacatatacattatggtttaagaaattaatttttagttagtcatatttactgaacacctatggggaaagactttacaaggtagttgacagtagtaacctttagggtaacattctgttattggagtggaggctggttatcagattaaagacagaaataaactaaaaataaaatatatata

SEQ ID NO: 224425 - DNA, 176 bp, Homo sapiens
acactggggattccaaaagtagatagggaaggaggcaagggttgaaaaactacctgtttggtaacctggtcactatttgggagatgggttcaatagaagcccaaatgcctcagcatcatgcagcatatccatgaaacgaacgaacttggcacatgtaccctctgaatctaaaatta

SEQ ID NO: 224426 - DNA, 361 bp, Homo sapiens
tgctgagattacaggcgtgagccaacgcgtccagcctctaagtgcttttcatataactcacccaatcctcatcctttgagttggatgacttgattgttaaaccaggaaaatttctaataagttggacttaagtagaagttttcgggaaggggagacaatggattttattgagccttctgagagagactggcaggtcgcctggggcgggttgtgccctcatgccctttctcttttttttttttaaattgagacagggtcttgctctgtcgcccaggctggagtacagtggcatggtctaggctcactgcaacctccacctcccgggttcaagcgattctcctgcttcagcctcccaagtagc

SEQ ID NO: 224427 - DNA, 857 bp, Homo sapiens
attatgccaatcaaaaactatttgctttaaaatataaaaggcaaaaacttcctattagcataatgaagtagaatttttaaactttgttataatcttaaattttctttagtgttgaagataggtcaacttaactatcatacatttttattcacataaagtaaactctgcctcaaatgtaataaacttaatatgagttatgtaaactttggtcaatagaggtatattttttagcatttccttttgaaaatttcagccttttgagggagtcttgcaactgaatgtcaagttacatttattacaataaaatggacacttaatataatctgtaatgcattaacataatatgggaacttttaaagtattcagtctctgtattattgagtcctatttccacatttggccaggattctcaatatgatttaggcccaagacgtgggaagaaagaagtaaagaactaaaggatcttttttcttcatttttttaattgaatatggggaaagatggaataagcttatctgtccagtaaaggccattatgtgtacatagggattattatttttcccccccttgggctgtactgatttcccagatgtaccacagcactcttagtagtgaagcacttgacttctagtgagtggattttttgtgtgtgtgttttatattgcagagtgaatacactctgtctgatactatgtgactttctgattatgtgatttttatgcattttatgtgttttgtaaactagctgtatttttggtccatgtctaggttgtagaattgaattgtgcattttggcatctgagcacagctgagttttctaaatcaatctctctccttgcacctagtttttgctttag

SEQ ID NO: 224428 - DNA, 863 bp, Homo sapiens
tccagcacaatgagcacggtgtcaaaaaccgctttattttccgcactctgctcaatattccatgccttcgaggctccaaatatactcaacatgaccagtgctatcaacaaattatgcagactaagttgctttttcgtaattataaatcaatcatgctcacagtaaaatatctgcaacttagaaaggtctactataagtaaggtaagattttttccataattaaatatgccaagaaataccactgaagtatatccttccagggcatcgatgacattttaatttgtctgaagaaaccaagtaggttctgatgcctaaggaggggacccagggagatgcctccacccatttccagcgcaggaagaacttgcaggcaggagcatggaggccccacctactgcgagagcaagcgagggagcatgcagttcacttaacactgttggcagttcttggaaacagcaagtttaagtgacatgatgtttaacaaatccatttttttcctaatcaacatcataacaaaacaacattattcaagaacctgatgtactttgttttgcttaaaaacgcagtttccaaagaacctctccacagcattaaggactcactaaacattctccaaaagttgatgccttcagcacaatgtgaaaagaacagccaaactaagcctatacattctgacaaagttacacacaaagttatcatcttggcaaggcttggaagcgtagcaaattaaaaattctataattggctgggcgcggtggctcatgcctgtaatcccaacactttgggaggccgaggtgggcagatcacccgaggtcaggagttggagaccagcctgaccaacatggcaaaaccccgtctctact

SEQ ID NO: 224429 - DNA, 617 bp, Homo sapiens
ttccagctttggcgcattcagtatgatgttggttgtggctttatcagatggctcttattattttgaggtatgctccttcaatacctagtttattgagaacttttaacatgaaggggtgttagattttattgaaagctttttctgccctttagattatcatgtggaacccagtgctctttgtcctgatattaatttgcctctgcaattgtttaccagtgctatagataatccaggtagatcagaggtgagaagagaaccctgtgagatgaagctgtctagtatagatggaaaggccttcctggaagaagtacagttatcatttgcctgctcttagttgtaggctgatctgcattcttttttaaaaatttttttgagacaaagtctcgctctgttgcccaggttggagtgcagtggtgtgatctcggctcactgcaacctctaccttctgggttccagtgattctcataccccagcctcccaagtagcttgaactacaggtgtgcaccaccatgcccggataatttttgtatttttagtagagatggggttttgccatgttacccaggctggtctcgaactcctggcctcaagcaatccacccacctcggcctcccaaa

SEQ ID NO: 224430 - DNA, 500 bp, Homo sapiens
tgggaaacagcacgaggcttactcagggaagaatattgaagtgcagcattaaaaatacccatttatgtgtgagggaagagttctgtaggagatgcaaagtataagacaatacaggaatacatgagatgctaaataacagttccaggaagccactgaggcccaaggcaggtcaaggtgaggtgccaagtagcactgatggacattgtgtgtagaattcagaggaaaaggtcattttcatgaggatgcttaggaaagactttgatagcagaggtaggatttggatcaggttttgtaggatggataggatttagatagaagtgcctatgaatattctgtgattggaaggatggtgccaagacgtggagtaagaacctgacagttggccgggtgtggtgactcacacctgtaatcccagcattttgggaggctgaggcgggtggatcacttgaggccaggagttcaagaccagcctggccaagacggtgaaaccctgtgtctac

SEQ ID NO: 224431 - DNA, 516 bp, Homo sapiens
ttcaattggctaatgaccttagaatagatttcctggaattggaattactaaatcaaaaaggttgtgccaatttatactttaaccatttacctaccagcattgactgtaagtattttttaactgtactgatttaattggttaaaatggatgtcattatttattttcctgctgatacacttttgaacataggcaaaactgaaatatattctcagtatttaacttcttgtcctccaaactttagcttttgatattttgttcttgttttgtgctaccatacatatcctcccctttatctgaaatgcccactgctttctggttttcaccccatcttctagttatattactaagatggttactgtgttactaatagaatgaagagaatgaaacagtgtctttgtcttaggaaaatgggagaattgaaagttttacacagggtcctatacctggtctacacagaaatgtcaaattattttatttttttcttcttgtccgctaaaattacaagatacaaggcca

SEQ ID NO: 224432 - DNA, 500 bp, Homo sapiens
catcaaaatgtgtattacattaaattgcccatttcaaagggctaatacaactttagaaaattttgaaagaatctactttggaatttgaaaggatagtgtttaagaatagtgaacattattaaaggaattttatatcaaacaataaatttccattgaaatatggccatattcttaaatttaatattctaagtatttggtctgtcacttctaaatacctatttttatgtcttgctttctgctatttggatatttttctgctcttttctaagtcttaaatttaaaggttcatttggagtaaaggattttatcttttagaaagtaattgagatttgagaaatattaggtagctgacagttaaaaataaatttgacttatttttttaaatccagatcaaatctcttacatgtgtagtcttgttgtactgtggcagctcttctctaggctcttgactgggtaatccatttcagttctttctgctagtcacctccatgagagtaaag

SEQ ID NO: 224433 - DNA, 463 bp, Homo sapiens
gctttttatcttaaaacatgacagggtaatcttttggtaagatcagaagaacaatgctttcccattttaaggggaatcatcccacaacatgcaatttaataactaatcagagctggttaaatgaagtgtttgataattaggcatcagaaattttcttttcctacttgaagcattatgattactgattttaagattaaattagtgttgcttttaagtggtttatttgaacaatctgagattctaaattcttttgaaggaccttgcattaaaatattatccatgcatccacttattcagtaattcactaattccacaaatactccactactaataggtgccagacaccatcctctgtgttgctgtaaataattatgataagtaaacataccctactctcataaagctaaaagtctaatgagacagacatcatacaataaataataaataaatctcgattaatgca

SEQ ID NO: 224434 - DNA, 379 bp, Homo sapiens
tctcccacttcccatgtgtcctctgcaccacatgcatcaacttcctagcccagctgaacaagagccagactttctagatttgaatcctgactctactacttcctagttatgtggtcttgggcaagttccatcagtttcctcatctataaaatgggaattgtagtagtttgtatacttcatagggatgtgtggcatgttgtaagtgcttatgaattatctgggcttgatttcccagctctttaaagagaatattacttgcaaggttgttgtgagacttgaccctccataaatagcagttatcatgattccatttgataatactttctatgatctaatcacaactttatgaaatagggaaagcatccctattttgttaaaa

SEQ ID NO: 224435 - DNA, 440 bp, Homo sapiens
ggattaaagacttaaatgtaaaatctcgaactataaaaccctagaagaaaatctaggcaataccatacataggcacgggcaaagatttcatgacaaaaacgtcaaaagcagttgcaacaaaagcaaaaattgacaaatgggatctaattaaactaaagagcttttgcacagcaaaagatgttttctttaaaacaaatgatgctcaaattatttgtatatgtaaatgggtgcccagttttttgtgggttggtttgtttgttattgttattcttgagacaaggtcttactctgtctcccaggctggagtgcagtgatgcgatctcggttcactacagcctctgcctcccgggttcaagagattctcctgccttagcctccctagtaggtgggattacagatgggtacccagttttattttgattaataaaagcaatcttatt

SEQ ID NO: 224436 - DNA, 466 bp, Homo sapiens
caggtgcctttcatcccagctctttgggaggctgagggagggagaattgcttgaagttgggaggcagaggttacagtgagccgagatcttgccactgtattcagcctgggcaacagagtgagattccatcaaaaaaaaaaaggtctacaaagtctgaattatgtgcttatattgctatgcagttacaagagaaaggctgtgtagtactgaaattggcttttttttttaagcctctcccttgacttccatcctgacctcaggtgatccacccacctctgcctcccaaagtgctaggattacaggagtgagccaccgcacctggcctatcatatacttcttaaatgtatagaacttaactgttgtgttcattgacagcaattttgtatctcaggtcattcttcctgaaatatcctttgtaacaacctatgtttttatgatattgtgaattaaaactgcaatttttctt

SEQ ID NO: 224437 - DNA, 447 bp, Homo sapiens
ctgggtggggaaagcgacagtaggaaggaactttgggaagatgatgccgccgtttggcgcccggctctgctagtctctgcttgtctcccagaccccatggacagagttctttgagtctctacacctggcagtttacgttgaggctcctccacctccaccacccccctcccaaatcctttccagttcctttccaccgttgtcatagttttgttccacgggactcttcttcagggagaaaacccacctccagaacactggagttctagcctctcaccgtctctcacacatccccaaacggccatctcaggcaacaagagataccacaaatgatgttgattcttttttttggttgggggggggggggcggtttggagacagctgtgttttataaatgaaaggattatgagtctgtaatggaagtctgtttaaatacacgttgatttctaa

SEQ ID NO: 224438 - DNA, 106 bp, Homo sapiens
aattggctcagcccacccgcttctggccccagcccaacatgtgtacagcattttcacttttcttagcaggaaaaacaaagtgagataactctctgttcaggtggtg

SEQ ID NO: 224439 - DNA, 386 bp, Homo sapiens
aagtgcggcctcaacccgcgctcctgccgggagggtctccagtcaccgagtaaccccggccctgccccgcgccgccgccgggactccgccccgcaagcaagtggggtctcctttgtcccgcgcgccctggccgcgtcccgcccttcggcgtagcccatgggaggcgccctgagggcagggcccttctgattccccacctggcctcgagtgaggacgcgctcaacaacatctcgagtaaagcgggggaactcgcttcaacgcgcagacagcacagctctcgcccagcccggtctcgggtcagccgtctctccctggacctcagggacactagccctggaaggccgccggtcgggaggggactccctccccgtctgaggggcggccgc

SEQ ID NO: 224440 - DNA, 600 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncntccccgggaattcggcctttatggccgggggacatatttttaacatatatccatgagtcaacactaatatttaatatttgagatttgaaaaattatttctagggtaagaaattctgtcacaatataatatctctatattgtgcttttttaagagataaatttttgatgaatttaatgttaattaaattttatctcagcctatcaccatcagaccaaaagacaatacagtatttttctaacaaggaaaagaaaatacatatatatatatttatatatacaaatatatacgtatttatatatacaaatttgtatatatgtaatgtatgtgtgtgtgtatacatataatttctccttttttttttttgtaagaattgagacagggtgtcactatgttgtgtgggctggtctcaaaacacctgcctcaagtgatcctcccaccttggcctcccaaagtgctaggatttacaatgagccactgtgccagcttccaacaagaaaaatattaaatgtattggtttttcacagtgaaacttaattcagtttagttgaaccatatatgtgtgtgtatggcatatataagatgaaaaaa

SEQ ID NO: 224441 - DNA, 433 bp, Homo sapiens
cagatagggtttcaccatgttagcgaggatggtctcgagctcctgaccttgtgatccacctgcctcgtcctcccaaagtgctgggactacaggtgtgagccactgcacctggcctaccatctgtacttaattggaaacctattggtctttatattttttagatagctctttaaaatccatgatggagttctcatcaactgggcacggtaatacaggagaagtgattcacacagggacgttgcaaatacatgaaagtcatcacactggagatttttgcttcccagaaatcaagaaagatattcatcactttgagtttcagtggcaagaaatttaaagaaatggccatgaagcacccatgacagaaaccaaagagttgacaggtagtacagactgacgtgatcaaagacatgctggaaacaagcctattaaagat

SEQ ID NO: 224442 - DNA, 498 bp, Homo sapiens
aatttgcataaaattggtcatcttgatagcttaaggtatactgagcaaaatgttaactccttgggtagcatgtgtgactgtatgattgtcaagatgaaagttaatctaagcacatttggtttactgataatcatttctagaaatgagctgtagtatcatgtcagaatgtcagaaacatgtctgacaatttaccttttcatactagaaatggtggatgacatgtttcaaatcctggcagctgtgctgtatcaaatcctccctatgtgaatatcatgcttggtacttagatagtttaggagcagtactgtggcttgtgatttgttgtataattctgaaagaaaatatattaattttgtgcactttatattggctcttgctttattgtagcctttatccattaatctgctactgatggataatttctcaatcatttggtcctttttgtaatggctatgtggagttggcaattctttttattaaatattgcatgactgtata

SEQ ID NO: 224443 - DNA, 737 bp, Homo sapiens
atgagtattagccaggcagctgggatgcaagagccagggtacgtgtctcacagagctgcacagagccgggccgttccagaaacgccgagcacctcgcaaggcgattagtagcatgggaaacctagccaagccgttttcccaaggacaagttctcagtcacagtattcctcaggccttggtctttgctttgtgacatatggaacgttctcacaattgaactcaagtagatggcaacatttatcacgtccacagaggtttaaaaaaaactgcatataccgatcaaccttgggatggctcataacaaatcatcaggttggcaaacatttggctccgcagacattccctgtttccctgtcttcagccacgtgagctcgcagtcatgacctgggcgctttagagccacagtgaatgctttcagtttccccagccatcctgaagagcagaggctgcgcacacgcaagagggaatcttacagttttccttgagctccaagactcacgccactgcgttaagcatttgaggccagcattcctaaggctgtttatgcatttcatgctgattagtaattcctggaatccagctacttcacacaaggtgattaatggtgtgggaatgatggccctggggtgccaacagcttgttttccctgcttggattaactgatttgaaaagaagttactttttcattcagggatgtgacctaattatcatttagtaaacaactaagtaaaaaaaaa

SEQ ID NO: 224444 - DNA, 128 bp, Homo sapiens
aaaatgaacatctctcgctacacagaagtaacaaatatgatagtcagttttgtatttagaaatgtaatggtagcagggatgttttcataattttcagagattatgcattcttcatgaatacttttgta

SEQ ID NO: 224445 - DNA, 559 bp, Homo sapiens
tcgccgtttgcttcagtttttgggaggttcgtggggttggggtgtagtaatcctggctttgcagggaaggaagcccgccctgaagggcaagtatatctgctaaagattgcacatctagtcaggaagcaggacacaagctagacactcctaactcggaacccagagagggaagcctctctcggaagcctgagagggatgccctgaagtcgtctttcagccttctgtctagttccagactcatgggaaagctttcatatcctgttcaccaatctccccagtccctcaaaagagccagacttgtagacctctgctggcatctctctccaaggcctggataaatccccagagacagacagcttagagctgcttcccagcagagctgaggaggggaggtagagctgaggagtgggaacaggaaaaagtatccccgaaagtaaggatgaagttgtcatttggctcaggggagggcctgccttgacaagaagagtcactttgagcccacctaactctgcctcacctccaaatattccctgtacagcagccttaagagaaaccaggc

SEQ ID NO: 224446 - DNA, 418 bp, Homo sapiens
agatattgataataaaatagtctcttccttttctcttcccttacctgtcttcaactcttctggaacctcctctctgtcctttatctgttatgccctggtgatccagagccatcttaattttaaaattctccatcatattttttattatattgaattaacaattcattctagggtcatccagatacatcatttaccaggagaagcagttagcttgcctcttgagatatttggccgtttcattattgtgtcacatggttgaaaacctttctttttggatgttgtatatgaccattagtgcttttcagtcttttctgttcttacagttcatatttttacctttctttttgcaaacaaagatggagagaagagtaaattaaatactcttctgaatatgttaatacttagtttaataaaaaac

SEQ ID NO: 224447 - DNA, 647 bp, Homo sapiens
gggtccattcagaagtcttctattatcctttaaaaatacaaacctgatcatgtcacttctcagctaggtcctgttttacctaagacatagctagccaagaacccctggaggactctgtgattgggcctaaacaggaatgtggtgtctctgtctcatgagggcatgtgttattcaaggtccttcagaagattcactgggaagactgcattcacagctgaacattattaatcccactttgagatgaccagtctcactgtggcctctctctccccagatgggaacatggtatacccccaaaaatgaacatcggggtatcagaacaaatatcgccttttggccaaattctgaggagatttgcaaaataggaaattgctttttatagtgaattcacttctcacaggactagttcctggttttactctttgaggaaactctttatttttctctccaaccaaaaatatcccagtatcatacctatcttcatttatgtgataccaccaaatacagcatctaaaacaatgcttaaccaaaataagtactcatgtattgattaatcaattattgcttttcaagttctgcttggttgaaccttaaattctattccctagacattttttaaaatccctaatgattctttatctttactg

SEQ ID NO: 224448 - DNA, 694 bp, Homo sapiens
tcagagatggggtctcactatgttgcccaggttggtcttgaactcctagtcccaagaccctatacttatttcacttagtataattataatgtacatttctttattagattggattgttctcatagtttccttggaaaatgtctcttacatttaaattggatgcatcttatgatctgtaaaaagctcttatataattaggacagttggccctttgtaatgtgttacatatatatgttttcaatttagattttatggatttttatagtttcatgttttcaattaaaaaattgtattgtacacatttaaggtatataatatagatagtaaaatgattaatatggtgaagcatatgaacacatctattatcttgcatagttattcccccctttttggtgggggcaagagaagctacaatctactcatttagcaaaaatcccaaatataatgcactataattaactgtaggcctcatgttgtatattaggtctctagacttgctcatcctccctatctgctactttgtatccttgaacctacatctctccacttgctagcccctagttcatccttgataaccactgtttcattctccatatatatatttgacttttggtttttaaagattccacatataagtgatatcaagcaatatttttcttcctgtcgggcttatttcacttagtataatgtcctt

SEQ ID NO: 224449 - DNA, 327 bp, Homo sapiens
tggacccattggttgtttatcaatgtgttgttcaatatctacatatgtgtgaagttcccaaatttcctactgttattgattttgactttcagtgatttaaatccttttaaatgttttttttttttttttttttttttgagatggtgtttctttcttgttgcccaggctggaagtgagactccatctcaaaaaaaaaaagaaaaagaaagaaaaaaataaaagtccagtcttgcctttttttgtttgttttttttaatggcttgggttttgagcatatttaggctcctttttcactccaagctcctggtgtccctaggcacagttcct

SEQ ID NO: 224450 - DNA, 407 bp, Homo sapiens
gtttccgtgaggatggtgacgactccgaactatagcagcatactctacctacccctgatcagtttatggaagaaaaggaaaccaaacaaaatctagatttattacaagaagtccatgatggagacagctcaggaatggaagagactcaagcccaaagatcagaagaacctctgtcctggaagtcggttctctttccaatggaacagcctctgcaaagtgtaccacacgatgagttaatatatctcacttttagaaagaaagatactgatatgccactgatgtggtttggatgtgcgtccctccacccccacccacagtcccatgctagaagtgtcactcatattcagctttgaatcagtggggaacccatacaggaagatcataataaatatggaaaattctgataa

SEQ ID NO: 224451 - DNA, 475 bp, Homo sapiens
gggtgttgtagggaaccggaagatgagggcagagaagggattgaagctgcctgattgcgtgaccttcccaggatcccgatccctcactggttccaacaccagattccatgttcctcctctcccctaagttttttctccggagtcagatgcatttccctaaaataatttattttaaccaggatcttcttttacgaatgtcctatttgcacagactcaagcccaaagatcagaagaacctctgtcctggaagtcggttctctttccaatggaacagcctctgcaaagtgtaccacacgatgagttaatatatctcacttttagaaagaaagatactgatatgccactgatgtggtttggatgtgcgtccctccacccccacccacagtcccatgctagaagtgtcactcatattcagctttgaatcagtggggaacccatacaggaagatcataataaatatggaaaattctgataa

SEQ ID NO: 224452 - DNA, 460 bp, Homo sapiens
gactgtcacagaccagacttaatggggctgacagctgtgggtgtgggctttcgtctgtcttttggtttgctttcatttggaggtgctttcattcctagggtgagggttgtgggttttctttagatatttttattagaatgtttccattatggaagatgatgaatactaacttaagactaatttgtatgttttaggcagtatccatttggaaaaagactaagaatgactcctgtcaatgaaaagaacacttaaggctctgtttctactctctcagcctgtacattgcctttttggcctttatcttggctcaatcttgtctgttcagcataggggatttgatttactagcttccgggaagtggagagaagagtggtaactgtttattaatattttgttcatctatgagtacgttaatttgattttttggtatgtagatagatattttataaaagcatgacat

SEQ ID NO: 224453 - DNA, 255 bp, Homo sapiens
gaagatagatccgaggaatcatccagaatgtattatagagtgataaacagatggaagataggagataaacagatgggagatatcaagagaggtaaaaaaaaattatggaagctctaatgaaatggtccaacagaagtttaacaggaatttaaaaaaaaaagtaagaatagagagaatcagggacaggcaatattggaagagataatgactgaaaattctaatagttgaaagacacaagtcctttggttaaaaaaa

SEQ ID NO: 224454 - DNA, 321 bp, Homo sapiens
ttgacttttccacggccctcaacattccaatatactgcatacaaaatggacttacttattgtctgtctgcttgcaaaaatgtaagccccataagagtaccaatctttgattttcttcactgacatatcttaagcacctggaacagtgcctgacacagaacaggccctcagtattcatttacaaaaggaacaatctatactataaaaagatatatgtttataaatcaacattacatgaggatggtcaccataaatattgccaattacaattttcatctgtctgaattccccaatattgaataaaattgcttttatcagataa

SEQ ID NO: 224455 - DNA, 892 bp, Homo sapiens
gcatgctttcctcttgaggaattagggagggagaagcaaaaactcaagcagggcaagatttttgtaggattttaagtgagggaagttggctgtgaatggtttattaaaaagatccaggaagtgagataagtcacagtccactctgggcaactacttccttatctgtaaggagaatagtaattttcacctaccacactgtgagaattaatttgtgacttcagagttatctgagttacttggaagcaaagtgtgagacctagcacatgggaacatagaattttccagtgcagagctggttaatcaagaatagcaagaagcacaattagtaaggaaatatgactttcattggagaactgctaaagaggctagagattttaaaaggtattgaaacccgctatttatattaaagattaaaaaataaatatggctattagaaaatgtgtatgattggtcattttgtcagggagtagagaaaactggaatgtaatactcaaagtagccaccagatcactgaagagatgaaaataatttgttttgttttcatgcagttcagtagtatgtgaggtttttatttgggaggatttggtgtcacgatgatgtcttgtgaaaaagcagggctgattgatgtctagtgtgcattctgaagtgctaagggtctcctagcccaaaactaatgcaagcaccaatgttccagtgggactgtgggaagaatgccagatgtgggagctaaaaggacactgtcttggaatcctaaataatgagagagtgagcagcaagttgaaagcagcgacgagacaggggaagggcacctgaatataattggggctgattgggtgcgatttcagtcaagcagcataaatgaagatcagaatggagaaaagacatgaatgga

SEQ ID NO: 224456 - DNA, 489 bp, Homo sapiens
ctttcctttcattttagactacctaatttaagaaaagaatatttgtgtaagttaaaaaaatcctccagtaagctttggactctatccaagggttcagcacacaaacgtctttggagaacaagaggtttggttcacatcataaaagaaaagggatagagattaaagtgttgtgaaaggcgtcgaagcaacaagcaagagagaaagaaacacagaaaggctgagaaaatacccatccatttcttttcagccaggggagatcagtaaaaacctcctgtctccaaaaagcatggacatttttattaaacagcaataggacctggaattagctggaggctgggtacagttgcaggttgctttatacaagtatcacattcctgaagaagtgtgtagactgacgttctgtaaaccagatccaattttaattgccatttaaatggaagtcagtgaaaaactcttttagtaaagcaaatgatcatcaccaatcttttt

SEQ ID NO: 224457 - DNA, 331 bp, Homo sapiens
ctataggtcatcaagtactttattttattttttggccttctggcaagaagttgagggtttaactatgcctttctgctttgtaattacacaactgtgctcacatctgggtcaagcaatgagaggacggacagagaaaaaaagcaatggggttggtcccaccttctggaaacccctacttcaccaactagaaagaaactttcagagttttggttcctgtggggctctttctaccagtcattgccaacatcaccaccaccaccatgaccatggaacttcttggaaactgtggggccagacaatgaagagatgagagaaagagaaaaaaacaaaa

SEQ ID NO: 224458 - DNA, 714 bp, Homo sapiens
ccattttgggataaattatccattggtgttgtataaaggtatcgaggcagcacaaagggtttcaagtagtaggatatggagagactgtttaaattaaggggtacccaacaccccaggaatgcagtgggattttttttccatttttccccttccggcaacttatttgatcaccttcttttgttagacccatttttaggatgtggaaagaaaatgggtcaggcatgtgggtgtctggatacaaagtgtggctggatgaaccaaggcctcctttgctctaaaccccatctctgaatattttctttatttttgtcaagctaaagatgcagattatcagataagcagcacacccgggctcagctcactaattgactgaacaagacgtggtcacagtttatacaccattccataatggattttcatgtttgtgaatcctaactggctgtggaaatgaaaagcaaatgtctcataatcacaaatatcttctgggtttttttttttttctaagcccaaagattaaatcaactttaccccccatttgccagcaagttcacggttatagaaggaagataaatgatcgggtgatggacatatccgctgtgctactgtttagcaaattcttgtaagtgattgctagatatagcgcatttctcacttaggtgttacatgaataattggtatattaaagaaagtgtgaaataaacaggtataacgctt

SEQ ID NO: 224459 - DNA, 361 bp, Homo sapiens
gccacctcattcagaggggttcttaagggttaaatgaagcaatagttagcagggaggcttccacataagttctctggaagttatttgatcatacaaaggatcattcccttggttgtgtgggacattttgaaaagcatatggattaggggtagaagagacctcagaaggtgtctggatcattccaccctattttacagatgaggaaactgaggctcacagaagtcacatgactgccgcaaggacactcttggatagtaaaaatccaagcatggcctgccccagatctaactgttttggatttccacacatatgtattgcatatatttgtaagttgccttaaatcctctttgaaccaagatca

SEQ ID NO: 224460 - DNA, 399 bp, Homo sapiens
gaagaagaaaagaaagacaaaccctaacagacaggcttcacagcggattagacacaattgaagaggagactgggaagccagaccatgaggcagtggaaaatatccagacagaagaacagagagaaaaacctaaaccctaaaataaaatccaacgatttaaaagatggaagacgtgttggaaacaactagcagcagcgaagtgtttgtggcatcctggaaagagggccaggaagcgtagccatccctgagccagataagagcagagagaacagcgtagacaagtcacaggagaactgctgggaaccacaggccaggggaaatatccctaaggcattcaaagaaaagaaatgccattttataaggagcagtaaaataatggaatccaggagagaatggacc

SEQ ID NO: 224461 - DNA, 551 bp, Homo sapiens
cttcaattctttgtgtcctcagcatttatgcgattagggacagacagtcaacttactgttgtaaagttacttggaatggttcccctctctgtggcatgctccaaactagaatcaggatttactgattatacctccttcattttcctgaaatttttagagattgctttttaattttaactttgttttataattatgtaaactatttacatggttccaaagtcaaatctacagaacaaaatgtattcagagtttatcttctgaccggttccctccaccctatttcctgcttctcttctgctgtaatcaaatttccccttttatccttccatttaagcaatataaacaaatgataaatgatagcatgctatttcacactttcctggacccttctattttgcttaaaatattggctgtcactccatagaaccatatagtatgttttccattgtaatgcttcattatgacagcataccattgtttattcgaccagtcactcctgattgacatttgggttgtttctagccctttgctattaaaaatattgcagcaat

SEQ ID NO: 224462 - DNA, 558 bp, Homo sapiens
cagtgtgtctgactctccttgtttttaatgattttgacagttttgaggtgtacggactaggtgttctgtaaaatgtccctccatttggaattgtatgatgcttgcttatgactagacttggattatgggcaggaactgacttgtaaagtttttttaattttaatgaaaaattttaaattgatacttggttcagttatcagacaacctttaaccctgtttggaacaacttggatatgtggatctactctttaactataaatgttagaaaatataattgcagatcaattttagcattcaaattgagatgtgccataagtgaaaaatacacaatggatttcaaagacttcatacaaaatgaaggatataactgatctcattaataattttttttattgactacatgttgaaatgtatcttggatatattgaattaaatcgtacatattattcaaattgattttaccgggcttctgggctagtaggaagtgtgaaataagtgtggctcacagatttttattggataacactgccctagataataacaatacattaattgaga

SEQ ID NO: 224463 - DNA, 458 bp, Homo sapiens
atatacagacacagaaacaaagacacacaaacacatgcacacacagagaaagaatgtcaaagggtattgaaggtatttctggtcattgttttactctttattctttccccattttcttaactctctatgttgaacatacattagaacagatatttacttcataatcagaaagaatgctgtacgtcatcactacttctggaaggatccccaaaggcttagctgttatctttccacttcccactggctgggtgcaagagtgtggtacttctggcagcctcagtcagttctgcagtacttctttggttttaagcttagtctaggcaaagccaaaaatcttgaattaaggaagcaaatgctttgtgtttcagattagattaaaagaactaaatatattaactatacctgctgatttaaaggccgtggttaggaggcacagtaggatgaggctaccatgcaga

SEQ ID NO: 224464 - DNA, 1095 bp, Homo sapiens
gactgttcaaacttacattaatctttgcagacatcttatacatttacttttcatattttattttgtaattaaaacctgttttgctttatgttgttattagcgattttatagtctatttagggagataactaactaagttttatagtctatctagggaaataactagctatctagataaacctagttatctccctaaatagattgtaagctcctagtggacatggacttgggagatttttatttgtgtgtttttgttagtagtatctggtataatatcttacacaaacttgattcccaaaaatacttactgaattaatgagtgaaaaagacagctttactttctacacttgactcttgctgtatgtaattttgatatatacttcctgtttatttagttggtctcagggtaaataaaagggtaactaatgtattattaaccttcagaaccctgaagaagggtttttagttctttcaccctgtttcactttctgcttcttccctagggatcatcttcttcctttgaaataatccagatattttaattgtttattaatgtagaaggcagttcctgtcttaaatttcactgatgtccagaacattaaaatgaagggccaaaaaatggcaagtttaggaaggacgagaagaaaatgtcttaccccagcttcatccaatacctcattactagaaggataagtccatgaacagtgcccagggagataatttgtcccatagagctctcacatttagagcattcttttaaactatctcagcaatgcagtttataaccataatccacttactacacacagaaacagctttattatatgtaatctctgttttaatgggactctaccaccattactaaataaggtaaaaaagtgagataatcagttaaaatcctagctgaggattagtactgcttgggttcggctttaacaattctgttaatgtacttcaatatttctacatgatgcctaattggtattgttctgcagagtttatgacaatttatacttttgatgttgctagaaaaaattgtgttgccatttcttcttcttaaaaaatacgtaagtggcacggtggctcatgcctgta

SEQ ID NO: 224465 - DNA, 1016 bp, Homo sapiens
gcggccgcccagccccacactacagcatgctgccagtgaggacaacctgtccagcagcacgggcgaggccccgtcccgggcagtcggacatcatggggacggccccaggccctggctgcgtggccagaagaaaagcctgggcaagaaaagggaggagtcgctggaggcaaagagaaggaagcggaggtcccgatccttcgaggtcaccgggcaagggctctcccaccccaagacacacctcctggggccccatcaggcggagcgcatctcggaccacaggatgccagtgtgcaggcacccagcccctggtatccggcatctgggaaaggtcacgctacctttggccaaagtcaaactccctccaagccagaacacgggcccgggggactcctcacccctggctgttccccccaacccaggtggtggttctcgacgggctacccgtgggccccgcctgccccacggcacaagcacccatggcaaagatggatgctcccggcataactgaggggccctgcctggaactggctctctcacctcccaagactgaatggggtctagcagggcatgggaggtggaggctgggcagatggagatgaccaggaagtaagctcaggatctcagcaggccagggctcctgagacccaggaactggggtctctgcccaaccctcccatgctttcagtgccactggggaaaagaggtgaggccaggggacatggccaggacggctgggctccctggcttcccagccctggacagaatgctgttgccaaaacctgcacagccctgaggccagcctcggccttggtaacgggggaaagcagctgacagtgagacggggctcctggcccacgtgtggggcacgggcatcctggatggttggggaggcgccgacaggcacttcacgtattacaattggggatgtgggtgagggagggaatctggttttgttacttggcagtggttttttctcacccttcctttttaacaataaaatcccatttgggtcttga

SEQ ID NO: 224466 - DNA, 642 bp, Homo sapiens
gaaatgttaggttcaccgaaatgtacttcccctctgtctggtgatttgaagaagactgtgactcagctgcctttgtttctctgtagtaactccaaacaggtggcttttgaactttatctagctatcctaagtaggacttggtaggagggttgttcttataacatctattctgtcttaggagaaagaactcccctctactcttcacttggttaaaatctgttcatcttcaatcacatcattcccacttgtcttcaaagcatttatctcagtttgtaagcttgcattatgcattaaattatgagcttactcagaacaaggaatgggcttcttttgtacaacacaaaatcccaagtatctacttcaggaatatttgaaggaattatatccatcaaagacaaaaaaaaaaaaaaggaatgaaaaagtgaaaaacactgctgctgatagcttataatgcgcaaaatatgaacttccctttcttgtgggaagattatacatgcttgttcattgatcatatgcttgactgtgggacttgctttagttaaagaaatataaatgggggagattaaattttactagaagaacagccatcattgggttcctctgtattctcccctttacctctggcaaaagaatagcctgcaa

SEQ ID NO: 224467 - DNA, 456 bp, Homo sapiens
gatgctgtaacatttatagaagtattataggatttgtgaaactacgatcaaataaagtgaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttgtggcctagatctagaaacaacctcagtgaacattaattaagaaagtattgactaaataatggaataattgcattctggaatactatcaaactaccagcaatgaatttggtctattgtgactacatatcctggattccccaggaaagtcccactttcgaattgcctttcaaacacagtttttattagcagtctttcttggtttggatactaaaataaatatagttatcattgcttgatttaaaaaaa

SEQ ID NO: 224468 - DNA, 314 bp, Homo sapiens
gtaaggggggtaagggatccctgaggggtaagggatcctagggcaatctactgcaggtggccaaatggcagcctggaaggccaatttaacaatgtatccaaagcctcatgcttccattcagcagttccagctttagttctctataataaggggaaaggcagggatatgcatatatgtatgcatttggctataaggatattcatcttcccaaaggcaaacctgaaaacaacctagatacatccggccaccggggaccaattatgtaaattctcttctatgtacacaggtgattattctgcaagcatttagtcatt

SEQ ID NO: 224469 - DNA, 434 bp, Homo sapiens
gactcagcctttggctttccatagtggtgacataagagaagcagctacgtgtgtgtttattccagatgccaagtgaagcctagaacaggagttgcatcttgcaggtcccctcagtggatgggccgggccccgagggtgagggctgccacagttgactgcccagccaggctgtgggacggctgctcttgtactctccatgctctgactcaagggaacctgtgttcctggtctcgtgccatctacctggagctgcagtgaacacacatctcgaatttttcatcccatggggttgcatggctgcggctcacgtgtctcatgggccaggcatcagtcacaggccacagcaagggctctagttgacggtcaggtgagctctcttctcagtggttgtcaaactctcatgggaaaattatttaattaaattggttacttta

SEQ ID NO: 224470 - DNA, 425 bp, Homo sapiens
gactcagcctttggctttccatagtggtgacataagagaagcagctacgtgtgtgtttattccagatgccaagtgaagcctagaacaggagttgcatcttgcaggtcccctcagtggatgggccgggccccgagggtgagggctgccacagttgactgcccagccaggctgtgggacggctgctcttgtactctccatgctctgactcaagggaacctgtgttcctggtctcgtgccatctacctggagctgcagtgaacacacatctcgaatttttcatcccatggggttgcatggctgcggctcacgtgtctcatgggccaggcatcagtcacaggccacagcaagggctctagttgacggtcaggtgtgagcgccagtttgaagggcatccaacccgcggctatccatgtggaatcgcttga

SEQ ID NO: 224471 - DNA, 488 bp, Homo sapiens
aaaaggaggaaaattcaggaagataaaatagctgaatgaattatccccgctccagaacgcagaggaaaaatgaaatggccagacccagatgttaaaaatgtgttccttgctctttcctgccctagcaagggctgttccatgtttaggggatgaatgccgctgagagtattagcaaaaatacatgtgtcattgagtctgaggaagataactgagacatacaggtatttctcataatgcatgtgggcatccatagacatattcttaaatggcttaaggacttggaaactacctctaggaaacctgaaacttgaatgttggtccactagggagaagaaatgttccattagccttccaactaaagaaatacactatcaagaagaacattagctgtgtgtcctataagcttgggagaataacttacttttattttaatacatatgttacttttatggtcagtattttggtaaaatatatgctctattatggca

SEQ ID NO: 224472 - DNA, 505 bp, Homo sapiens
gcaattgatgtcttttttgaatttcttataaaaaaaagtggggtggggtgggatccatgtgcagaacgtgcaggtttgttacatagttatacctgtgccttggtggtttgccgcacctattgacccatcctcccaagttccctcccctcaccctctacccccgaactggccctggtgtatgttgctcccctctctgtgtccatgtgttctcaatgttcaactcctacttatgagtgagaatatgaggtgtttggttttctagaactatcatctttcatagttaaggtcttctttctgcctcctcacatagcaaaatggggcaagagaataagtctcttcataaggccactaatcccattcatgagagtggaatcctcatggcttaatatcttccctagggccttacctcttaacactattacattgggtattaggtttcaacatatgaatttttggtcaatgtcagtattcagaccatagcatcaaacatatccacttcaatctc

SEQ ID NO: 224473 - DNA, 431 bp, Homo sapiens
caaaactaaatgtagtcttaccatatgatccagcgattgcgttccttgatatttactcaaatgggttgaaaacttatgtctacacaaaactctgcacataaatgtttatagtagctttattcctaattgccaaaatgtagaaacaatcaagatgtcctttagtaggtgaatggataaattgtagtgcgtccagacgatggagtttagtgccaaaaaagggctatgaaaagccttttcaagccatgaaaagatatggtggaatcatatgtgcatattactgagttttaaaataagccagtctgaaaaggctgcatatcccagctactcagaggctgaggtgggaggatggctttagcctgggaggcagaggttgcagtgagctgagattgcacagcaccccagcctggacaacagagcgagtccctgtctca

SEQ ID NO: 224474 - DNA, 866 bp, Homo sapiens
tcacacctgagaacatccagctcctctcaacagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcctccctgcggccagccgaccccttgcagcaccacctgcaggacctcctcctgctgagaccccacctctcctctcaacgcacgaaacattcccaggtgcacagaagcttgtgcagactcttctaccccttctggatcagatgagagactccacctttgcagcctagctgatcctcaagcacgaattcaacaataacatcctatctatttccccacataattatgcagctaatcctggccctctctgacaatcttgagaaaaattccagctttcatcattcgaattcctggcttgaaaaaaaaaacgagtaaataaaaatcaaagctcctcttgaatagaactctgtcccactgactcatcacccttttttctactgtttcaaggttctcagatgagatttttttcttccaggataatactatttgtatgctgtatttttgcactgtaaaaaaaaataaaattatatttctgggg

SEQ ID NO: 224475 - DNA, 778 bp, Homo sapiens
cataaaatgagatgaaatgagatgtaatgatggaatgagatgagatgaaatgagatgaaatagatgagataaaatgatatgaaatgagatgaatgatgagatgatgagatgaatgatgaaatgatgagatgagatgatgaaatgaaatggtgagatgaaatgatgagatgaaatgaaatagtgaaatgaaattgaaataaaatcgaaatgagatgaaatgatgagatgatgaaataaaatgatgaaatgatgagatgtgatgagatgaaatgatgagatgagatgagatgacatgaaataatgaaatgaaattgaaatgagataagatacgagatgagatgaaatgatgagatgaaatgatgaaatgatgagataagatgaaaagggttgagatgatgagatgaaatgagatgaaaagatgaaatgatgagatgaaatgaaatgatgagatgaaatgaggtgaaatgaaattagatgaaatgtaatgagatgaaatgaaatgacataatgaaatgaaataatgaaatgagatgaaataaaataatgaaatgatgaaataatgaaatgaaaatgaaatggaaatgatgagatgagaagaaatgatgagactgaaatgactgaaatgatgagatgagataaaatgagatgaaagatgagatgaaataagatgagatgaaatgacataatgaatgaaatgatgaaatggaataatgaaatggaaatgatgagctgagatgcaatgagttgaaatgagatgaaatgatgaaatgaaatgatg

SEQ ID NO: 224476 - DNA, 628 bp, Homo sapiens
gcagtggttcagcctgtaatcccagcactttagaaggtcgaggtgggcggatcacttgaggtcaggagttcaaagaccagcttggccaacatggtgaaaccctgtctcaactaaaaatacaaaaatgagccaggtgtggtggcaggcgtctgtaatcccagctactcaggaggctgaggcagcagaatcgcttgaacccaggaggtggaggttgcagtgagccgagattgtgccactgtgctccaacctgggtgacaagagtgaaactccgtctcaaaacaaacaaacaaacaaacaacaacaacaaccaaaaatctctaggactttggctctgagcactacccaatacgtaggaatagccacagaaggccatggggaaatgaaatctgctgagatgtcgtgggcagaacaagccttgtcttaatgaggtgcatcctggctggcagaagatggtggcttggccaaagtctccaagcaggtcagcaacacagcagggagtgcagcccagggcacctcaaaccctgcgtgccttctgtcaactgcctcaggattcaccgggggactcaagcatccatttcctggtcacctcatttatgccaggaattgggagaggttgccaaaggacaaa

SEQ ID NO: 224477 - DNA, 434 bp, Homo sapiens
atcatatgcatggaagaatctcactttagtaaatctcacatttatttattgtggatatacttagatatcatacacatacatagcaaagtaattgtaaagatataaaataacattgttgtagtttaggaagatgtaaaatcataatcgttttgtttatattgttttcttttccttttttttgagatagggtctcactttgtcacccagactggagtgcagtggcacaaacaaagctcactgtagcctcgacctgagactcagtcagtcctcttgcctcagcctctcaagtagctgagaatacaggagcacaccaccatgaccagctaatttttgtattttttgtagagatggggttttgccatgttgcccaggctggtcgcaaacttctgagctcagcactttgggctgccaaagtgctgggattataggtgtgg

SEQ ID NO: 224478 - DNA, 1417 bp, Homo sapiens
gggaatgtacgtgtaataggctctgctttgtatacaggagataataccacatcatcggttatctccaaactccagtcttctctcaactgcccagttgtatgttgtcatcaatcactttttcaaggctgggtagagacaagtttctcctcgtaactttgacctctcccactctccaaatgtaatctggacctcattgctttcaaggtcagcttccccatagctcaggtatcctttgctctcctgtatcttcatttactattagtgaagagatctctgtcctggaggttattctaaactttctttgtaactattgttatagacaatggtttccaaaccagtggtttctatgtagcttttctagttccttgctatcttctcaccactggcttgaggtagtgatttggactttgctcattagagagcattatcagagatgtggagtccatcagaagaccagcttgcagtgtgtatagcatatagatgccaatattagaattctttaaattatatttaacattttcatgcttcttaatttaacttcacatgttgggaagtagattcagaaagataggagaaatacccagactctaccacttccgtgagctactagttaggcatgggcaggattaagttttatgtgtattatcttcccactaccaagaatgggttatgtttcacagaataccagttcagtttgattggcaaaaagatgccaaaccaaatttatatgtagtctataatctaagggcattcttgaaactattgcccacatcccattttttttttcatgtttacttacaaaacagagataaacattagatgtctaaaggagttagtaatgaaaagcctatccttaaaaaataaacctgttgaaatgggctttaaagacatcgaaataatcacttgtcatgcattgactgtaaatgcagatagagaaatatgtctttgaagctccacttacacaaaaataaaacttgtatatcatgctccctcaaagaatgtgcgatagattattttaagaccatgataatagagtaaaaaggaaagaaagccagaaattacaattttggatgctaaaaagtaactttctagttaaccctaaagtcctgtcagattgtgaagaaatgttccaggatacacttggattagttatgcagtatttcttatcaatgtctagcccttgtgtattgttctgaaaactaaagtttaaatctttatgctgttgcttgctagatatcctgttctttggtagaaaattcccatagtctgtactcaagaagtgcctaaaaatggatttgtgttgattttaagcccatctaataaattatatgtattttctatggtatcgtatggcttgtcttaactgatgacacagcctagaggatttctgtcacaatttgtgctttatttgaataca

SEQ ID NO: 224479 - DNA, 470 bp, Homo sapiens
gcgaataatgtcatgtttgcacgttggttttttaaaaagcctccttagagtcagtaaaggataggttttattaaagcttttcactttgcttagctgcctgataataatgccttacttttatacagcactttagaataactatatctatattacttaatataactctcacgaaagctctgtacaataggttctaacattcacaaagaaagtggggtcatttgcctttaagtccccatcacaggaattcgaattaaactcacttcttttaactcagactctgcgatctgccatcgagccccacatttttccctttgaatgcatagtccaatcctacccatttatgagaatatttattgggagaaaaaaggatactttttttcctttatacagattcagatgatgtcagacactgctgatggctgcagcctcaaagatattcctctccgtaagatcagtccaaagcctctctg

SEQ ID NO: 224480 - DNA, 389 bp, Homo sapiens
atgatcgagctatacataccaatatatgagctgctggaaccagttctgcttccagacaaggagtgatttgctggcatggacgtgtccatgtgaagggtggtgatcacatggcctagatatatgctatccatcagtccagcctcaaagccctggtgtcctattaccagaagtatatggatgagttttccaaggaggagatcaaagacaaagatcaaagacatcctcatacagtacgaccagatcctgctggtggctgacctccaccaccactaatccaaaaaattaagagacgctggtacccatgcttgctaccagaaatcctaccaataagcccatcatgagaattggggtttacttgtataataaacaatgtttgagagatttttaaa

SEQ ID NO: 224481 - DNA, 547 bp, Homo sapiens
acagattagaaaacgagcttgattctgtttttcttctcatgtaaggaagtggaatgtgtgagtgtgtaggtggggaggtgggggctgtcactgatttctgaaattgactgaatgaaaattatcacatcattttgatgtgttaaataccctaaatcattctccatgatcagatagtctctcaaaatttaagatgtcctatggtttcttttagatttctaaggcttaggaccatgatttttcttaatgaggcaaaatgttcaatgtgcagagcatctccaaaactcccctttctgaaggtttttcagacatctgacaggtaacccctggctaacccagctatctactggacacaggcagcaaagccacatcaaatcaatgaatgccagacacacttggatacaccttctaatgtatataaaaattgtagatgatgttttttatgaatagtttttactttaatagtttctatttaatggaattttcattttaatccctctctgaatgcacatgcattgatactagttaaaagaaaaagaaagaaggaaag

SEQ ID NO: 224482 - DNA, 396 bp, Homo sapiens
cggctaggctgggccccaggatgcagcctgcctttccagccctcactggtttagacaccaggcccttccaaaactcttccaaggccactgcttagccccaacagcaaatccctaccttaagccccaagtcccagactgcttgcctgtcctctgctgaggccatcagcctgtcctcatctgggacacctctccccacctgccagagccagagcagagtgcatgaatagtcactaaccagatggatggatgggtgaatgagtgatacagtaaccgtatgaatgaatgaatggaattagtggatagatgatacaataatcatatgaacatgtaattcaataactcaatctactaaccatgtgaataagtgaattatcaaataaatataatgaaaaatat

SEQ ID NO: 224483 - DNA, 426 bp, Homo sapiens
taattccagatcattaagtgctttcatttctgtcctaaatatttcaagctaatggaggggctgagtccctttagaaactccctaaatatcccaaaaagactttgactcaggagacaaggcgactcaggttttacatatcacagctaaaaccatcattcttagcaaactatcgcaaggacaaaaaaccaaacaccacatgttctcactcataggtgggaattgaacaatgagaacacatggacacaggaaggggaacgtcacatactggggcctgttgtggggtggggggagggggaagggatagcattaggagatatacctaatgttaaatgatgagttaatgagtgcagcacaccaacctggcacatgcatacatatgtaacaaacctgcacattgtgcacatctaccctaaaacttaaagtatt

SEQ ID NO: 224484 - DNA, 316 bp, Homo sapiens
tcaggtagaatgatttattctactttattctctttcaaaattgtttttagctatttcagttcccttgcctttctatataaattttagaactatcttgtctgtgtcggccaggcacggtggctcacacctgtaatcccagcactttgggaagctgagacgggcggatcacaaggtcaggagattgagaccatcctggctaacacagtgaaaccctgtctctactaaaaatacaaaaaaattagccgggcttggtggcgggcgcctgtagtcccagctactcgggaggctgaggcaagagaatggcgtgaacccggga

SEQ ID NO: 224485 - DNA, 442 bp, Homo sapiens
ttcaaagtaatgtttaaaagtgccttttatattttttcataccacattgtagggaaggccagggtcattttttaacacttaactatgctcaatacctcctcaccactataaagtaaggtcgaatgttggttaaagcaaagctgtctggaatcaccctgtcaaaagtactgatttataaccttgctactcacatttcttactgtggtgccctccctcttgttggctcctgcatctttgaagtacagggaaaatgaactaatatggcagctccaatatgcagctaatcctgccaatgatgtctcccctggaagtgtttgagagaagaatttcttttcccagtatggatttatgtaaacatttgttccattcacgagtagcacattaatgcctaattctggaaaaaatacaaagaaaaaaccttttctgcctgtctagacagagt

SEQ ID NO: 224486 - DNA, 382 bp, Homo sapiens
tgagccaccgcacccagccagtattatcattcttttttttaaaaaaagggccttggtttttcctatctgaatacttttgaacaccgtattttttgttggtaaagagacacacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactat

SEQ ID NO: 224487 - DNA, 390 bp, Homo sapiens
ttttccttaataaaaaaaggagagaaagattatcattttatttttgagttggtagaatagcatgaatcccaggatgtaaatgttgatcattttaacttttaaatgatctaaatgcctttaagtaattttttgtcatagttttatttatttgtctaggcaccgtggctcacagttgtaatcccaacactctggaggctgaggcaggtagattgcttgaatcaatcaattaacacttggtgcatttgataagaattggctgaccagggagttgggtgtgtctgaagaacaaagcgaggcttacaaaaggatgttccttcaggaggaagcagcactaaaagcactttgagtcaaaatgagtgggaaaccatttcaataaacacattttggata

SEQ ID NO: 224488 - DNA, 336 bp, Homo sapiens
aacatgaaaaatgacagggaaggacgtgttacattgctgcagatttaacaataacataactatatagacacaaaataaaaacgactttctcaggcccacaaactgacacatgaaaataattcattccaattgggattaagtgacaagcaggttttgcatctgtcctgacacatttccccaaattcttcattataggactagcaccactactactctctgtgatggcttatctatctactaagagagtgtgattaagaatattacaggtttgagtgagtgtatgttcggggcaatttgaatctatgctcctggaataataaaaattaaagaaagaca

SEQ ID NO: 224489 - DNA, 515 bp, Homo sapiens
gaacccaggagtgaatggagccttttagaagctccaagtaacaaaacaattatggtgtaccacctcatatgtaattcaaaataaagactattccaaatcatataaaaagaataaggaactctaacaaaattctgatttttcacatgatgatgactatagaggtctttttaaagaaatggcaaatgttaaatttaagacattttttccctctgtttcccttgctttactgaatgatgcaccaagttgtcaactgccaactccccaagaagccaccagaataatctgttgatcaagtgcggctgagtttgttgaacctcctgcaatgagggagagcatcaccttgacagagttctaggattatcccagaaagggaagacagaagcagaaatacatagggtgtagggtgatctttttttttttttcttttttttgagacagagtctggctctgtcacccaggatggagtgcagtggtgcaatctaggctcattgcaacctccacctcccctcaagcca

SEQ ID NO: 224490 - DNA, 507 bp, Homo sapiens
gaatcacaaggttaaaagagtatagttaatgctttgaatgttacacctttgctagaaaacaaactaccccaaaatttagtggcgctgaacaacaaacatatatcttagtctgtggttgagctcagtggttgttccagtctgggctaggccaggccaggtggttgtagctgggctagcgcatgtgtccacaatcagtgataggtcagctgaggcctagctgatctagattggcctcatctgggatgttccccctggcagtgtcctcttatcgtctagcaggccagcctgggcttgttcatatggtgatcacggaattctgagcatgcgagcagaagtgcgcaaggcctttcgagatccaggcttggaactcagacagtgccacttctgaattgcattggccaaagcaagtcacagaaccaaacccagattcaagggtttgagaaatagactccacctctcgatgggagggcttacaaggtctcattgcaaatggatggggagataccg

SEQ ID NO: 224491 - DNA, 338 bp, Homo sapiens
atgaactaatattaatatgttattaaactccatccttttttgggattttgttagtttttccctagtatctcttttctgatctaagatttcatctgggatatcacatacagccctttttttaaaaaatttttaattaattaattaattaattttttgtatttttagtagagaccccatttctagtaaaaataaaaaaaaaaatcagcccagcatggtagtggatgctggtagtccccagctactaggtaggctgagaaaggaagatctcttgaatctggaaagtcaaggctgcagtgagccgtgatcatgttactgcactccagactgggcaatagtct

SEQ ID NO: 224492 - DNA, 448 bp, Homo sapiens
ctgaaccagcggggatgagctacatgatgctgtttctcagcactgggtctgagacagctccctcagtcaggctccctcattgaatgggggccatttgaaggcagaggataagatgtatttatctctgtactccttagcactttggacacagcaggaactacatagtttgctgaatcaaactgaggaataacgtcttggtcaaaccagtgagagatggaaataaaacagtgaaaaattcacagaaaagactagaatcattatcaatcaatatttttaaagtacaagccatggtgctaaagctatgaggtatactaaagatgtaagacaggcaagtcctcttaaaacacccatattcaggaagaagaggaaaactgtcatattaagggatctgtattataggaatggcccagataagggtagtgagttttaagggctaaaaggttaaaaa

SEQ ID NO: 224493 - DNA, 1009 bp, Homo sapiens
tttttttgagacagagtattgctctgtcacccaggctggagtgcaatggcgtgatcttggctcactgcaacctctgcctcccaggttcaagcaattctcctgcctcagcctcccgagtagctgggattacaggcatgcaccaccgcgcccggctaattttgcatttttagtagagatggggtttctccatgttgaggcggtctcgaactcctaacctcaggcgatccacccgcctcggcctcccaaagtgctgggattacaggtgtgagccaccgcacctggcccattttactattatctggaggactttctttaatatttcttttagtactttgaaaaaaatctttattttgcctttccatttttatttttaaagtgtttttgccagctatagaattctagattgaggaccttgcccccttgcaactatctgccagcttgcattgtttttgatatgtacattgttgtcattcttttttttgtatgtaaaatgtccttttttttttgggcggtctttaagtttttttttaatcattgcttttaatctgttcagttatgatacgttctcctgtagttctctttatctttctcgtgcttgaggtttgttcagcttcttgaaattttggtcttatagtttccatcaaatttgggaaacttgctattactcaatttttttttttaccctcttctccccttttgtcgtcgtcttcaaggactccaattacatgtatattaggccccttaaagttgtcccagagttcactgatgttctgttctttctttttttttctttttttttgtgggaggtcttatactgtattgctccattttgcatggtttgtattgctgtgtctttaggttcactaatctgttgttctgcgatgtctaatctgctgttagacatttaatacatatttttatgttagacatgttatcaataaaaatttgatagtgcttatatatttattaattaaacagatatttattaacttcttactatgttcctggc

SEQ ID NO: 224494 - DNA, 996 bp, Homo sapiens
ccttgctatcgcccacgttgtatgcgcaactgtcgtgacttggacatccctgcgctctgcctcccaggttcaagcaatttctcctgcctcatacctcccgagtaattgggattacaggtcatgcaccagcgcgcccggctaattttgcatttttagtagagatggggtttctccatgttgaggctggtctcgaactcctaacctcaggcgatccacccgcctcggcctcccaaagtgctgggattacaggtgtgagccaccgcacctggcccattttactattatctggaggactttctttaatatttcttttagtactttgaaaaaaatctttattttgcctttccatttttatttttaaagtgtttttgccagctatagaattctagattgaggaccttgcccccttgcaactatctgccagcttgcattgtttttgatatgtacattgttgtcattcttttttttgtatgtaaaatgtccttttttttttgggcggtctttaagtttttttttaatcattgcttttaatctgttcagttatgatacgttctcctgtagttctctttatctttctcgtgcttgaggtttgttcagcttcttgaaattttggtcttatagtttccatcaaatttgggaaacttgctattactcaatttttttttttaccctcttctccccttttgtcgtcgtcttcaaggactccaattacatgtatattaggccccttaaagttgtcccagagttcactgatgttctgttctttctttttttttctttttttttgtgggaggtcttatactgtattgctccattttgcatggtttgtattgctgtgtctttaggttcactaatctgttgttctgcgatgtctaatctgctgttagacatttaatacatatttttatgttagacatgttatcaataaaaatttgatagtgcttatatatttattaattaaacagatatttattaacttcttactatgttcctggc

SEQ ID NO: 224495 - DNA, 210 bp, Homo sapiens
tacagatgaagctttgctcgcatgctcacttgcctgctgctcacctcctgctatgttgcccagttcctaacagggtccatggcccaggggttggggactcctgctttagagtggttgatattcaaactctccaaaccagtaatgaagtttgactcatatttagtatccaatcaccaggttttgaattttttgcctgccaaaagttttttt

SEQ ID NO: 224496 - DNA, 497 bp, Homo sapiens
cgaggatgaaaattccacctgctcgtcaaaactcagccagagctcagcctccctccaatgagaaaatgtcccctgtgctacaagctgaagccacaaagaccagtgtcaacggaggagaccctagtgcccacaaataaagcccagcactgtacatccacgtaaagtcctgtgaagtcagaagtaagggagaaattaaggatttagtagggtcccacaaagtctttggaaccagatctgattgtttcctttagttaaattcactcaaacatgcaagcatttgtataaacatcaatgtttttttcagtgattctgtgggattcctaaaatgtgcatctctttagtctaagatgaaacactggttataggatgaaaaaaattaaacatgcattcttcagctctcagacctcaaccacaaactgaagtcccagaaagagtcattaaatcacaatgtgtacttaaaataacaaatttgaaataaaaaatgttccaagacatta

SEQ ID NO: 224497 - DNA, 316 bp, Homo sapiens
tcttttgttttgggtattaagagactaaagtctttttgttgtgcctatgattcttacacaaagccatctaaatagatataaagtagaattatgtcacatgataaatctgaattggatatttttggcatccgaatgctctcaggaatgaaaatgtttcatcaagtgattggaatcctatagatgtgaagtgtgtgtgtgtgtgtgtgtgtgtgtgtgtgtgtgtgtgtgtaatatggattgtaactgattactttggagaatttcaaacattaaaaagtaagaagaaaactaaagaacttccaggacccatcacaaa

SEQ ID NO: 224498 - DNA, 683 bp, Homo sapiens
ggatagtctggaagacatggctttgttggaagacgtggacttgctggaagacacggatttcctggaagacccggattttttggaagctatagatttaagggaagacaaggattttctggaagacatggatagtctggaagacctggaggccattggaagatgtggattttctggaagacatggcttttttggaagacgtagattttcaggaagacccaaattatccggaagacttggattgttgggaagacgtggattttctggaagatgtgagtttgagtttgtgtttgggatcagtggcttacagatataggagcccgctgaatggccatagcagtctgtaccagtgatggtgtggtggtcccatgggttctggagccagactgtgtggggttcaactctagttcccaatttactagatgaatgatgtatgttgggcaagttactcagcttctctttgccctagtttcttcatctctaaaatgggaacaacaataacagtcctcacaattacttcttagaattttttcgaggactaaatgagataatacatacaagcttctaatagagtggctggcatattttaaaaatgtcaatagatgtccttattaaacctttggggctgcagctggaagccaataatgagaccagccatgttagcaaactgattttttttctgtgta

SEQ ID NO: 224499 - DNA, 220 bp, Homo sapiens
ggcaggctcctcttgtctgccataggtcatggctccaatctcacccctccgggaggcctccatcatcccctcacggtgcccagatcttgccttttgtagcacttcagaattactgtatttcaccaactctcaaccccataccttttcatgctctagcatatctgaaatcacgcacctaacgaggaaagagacatctgggtcagtgaaattcggttcatgc

SEQ ID NO: 224500 - DNA, 674 bp, Homo sapiens
gttgagtgatggtcacagagaacatataacttcaaaacctaaagtattgggctgggtatggtggctcatactgcaatccaagcactttcggaggattgtctgagtcccagaggttgaggctgatcatgccactgcactccagcctgggtgaaacagcaagaccctgtctcagaaaaaaacaaaacccaaaacctgaagaacttattatctgtctagccctttacagaaaaaaatttactgatctttattccagtgtatgaagatggaagtcttatcagatgatgatctctgtttttgaaaatacatttagaaccagtataatacaaatttccagcctcgccaacatggtgaaacctggtctctattaaaaatacaaattagttggatgtggtgggatacacctgtaatcccagctacctaggaggctgccacacaacaattgcttgaacccaggaggcagagattacagtgagccatgattatgccattgcactccaatctgggcaacagagggagactccacccatctcccccccaaaaaataaaaataaaaaggaaccaatataatacaaattaaatgcctagaatgtcctgtgaatgaaacttagtggaacagtagtctccccagtattgatctaattttacatccaactgttttagtattaattactcct

SEQ ID NO: 224501 - DNA, 680 bp, Homo sapiens
gtgtgggggtgtacagggcagaatatatatgatacataaatcatatctccaaatctttaatgagtacaactttcacttattcatgttccatcagataagattaaaattttccattaaaaaatttatttcattgaattgtttaaccaatattcattttatgttcaaaggccagtatagctttcacaaagcgacagaagcctgtagcccatatatagatagcatttaatccatatgtgagaattcaggagcattccaggaggcatcccagatttctcccaaatgtgatctggcatgttcaatttacatactcataaaaattcactcatcctcggaaaatgtaaaacacacttaagtatgatgaccagatagatgaatgcttattgttttttttttacatgaaaaataaaagagcacatgatttttaaatgtccagaactctcattacttgggctttggtgtttattttgatgaaagaatcaatattaatagtgtattgggcattagcaagggaaaaaaggtcatgaggattgcagctcagaagctgatatctctgaaatcagagaaaaggcgtttaaggtgatcaagatttccttttctccaaaacccctcaggaaagtgaggtccaaaaaaacctcaggaagttagataacttcctgatcctcagtttctctcctgcaaaa

SEQ ID NO: 224502 - DNA, 1093 bp, Homo sapiens
ggcactatgggaagagggccaaggagggagggaaaggtgaagaatgcaaaggcaagaagagaccagtcctctgcatcccccactagaagagaaagattttctccttctttgggtcctacattctgtccttcaccctgccccagccctgtacctacagttcaagcacaggtggctcctgagcctgacagttctgccacattatgctctttacagactctcctggaaacctcagtacagagagaatgatttttcttggaaatttagttgcaagttccaggcatgtgatttaaaacattcacattgggaatgtcactgctttagaggcagagactgcccaatgagtctgacaggttcacttgtattagatggagttaactcaattactacacaaagccactcagagaattgactaagttacagctcttctctgctgccgggaataccatgctcagccccagccacaaaatagagtggcatgaatgctggaagacatgctggggggtggaggggcgtcccaggatctatcaccctgttttgcagagagaaatgcttaaagttgggggtggcgggtgagagaagtgactgcatcaaaggccaggggtcatgtggtgtggacttggccagagcccaggtccccagtatctcagtctacctgcctggtccacatcctcctaacaacacttcctgatgtggcttctgcaggatcctggccctgagatgttcctgggagagaaagcttgtggggttgggcaatgctgtctattctagaccccttgtaggtgacactcccagtgacatccttgtatcctaggctctgggaagccctgcaattaaaacaacaaatgggttggattttgtttaatccactgtcctgcaagctcatttgaccaaagaagccctttgtttcaaggcccccctgtcacaagctcctgcacatgctctgggaaatgttgtgagacaagccctgtgagctcagggtggagcgtgagagctgggatctagtttaggccatggcactggccagcgccaggcagatgctcatctttgtggggctcatttctgtacctttcctgcctgcctgcccctcaggaat

SEQ ID NO: 224503 - DNA, 971 bp, Homo sapiens
ggcactatgggaagagggccaaggagggagggaaaggtgaagaatgcaaaggcaagaagagaccagtcctctgcatcccccactagaagagaaagattttctccttctttgggtcctacattctgtccttcaccctgccccagccctgtacctacagttcaagcacaggtggctcctgagcctgacagttctgccacattatgctctttacagactctcctggaaacctcagtacagagagaatgatttttcttggaaatttagttgcaagttccaggcatgtgatttaaaacattcacattgggaatgtcactgctttagaggcagagactgcccaatgagtctgacaggttcacttgtattagatggagttaactcaattactacacaaagccactcagagaattgactaagttacagctcttctctgctgccgggaataccatgctcagccccagccacaaaatagagtggcatgaatgctggaagacatgctggggggtggaggggcgtcccaggatctatcaccctgttttgcagagagaaatgcttaaagttgggggtggcgggtgagagaagtgactgcatcaaaggccaggggtcatgtggtgtggacttggccagagcccaggtccccagtatctcagtctacctgcctggtccacatcctcctaacaacacttcctgatgtggcttctgcaggatcctggccctgagatgttcctgggagagaaagcttgtggggttgggcaatgctgtctattctagaccccttgtaggtgacactcccagtgacatccttgtatcctaggctctgggaagccctgcaattaaaacaacaaatgggttggattttgtttaatccactgtcctgcaagctcatttgaccaaagaagccctttgtttcaaggccccacagagagatcgtcgaggctctctctgtggggccactgagggaattgaggttggat

SEQ ID NO: 224504 - DNA, 407 bp, Homo sapiens
tacaggcgcccgccaccatgcccggctaattttttgtatttttagtagagacggggtttcaccatgttagctaggatggtctcgatctcctgacctcgtgatccgcctgcctcggcctcccaaagtgctgggattacaggtgtgagccaccgtgcccggccaacatatatttcttaataagattatttggcttctcagctaagaggagattagaagtggttttcttctaaaaaccatgtcggaaattgaggcaggtactagggaggcaagtacattgtagaaagagaccagaaaactaaaaattacgctctttaaaagaaatttctgtattggaatatttaatagtagatttttcttaatggatgattgagaccaggccgatttttttttaatcacaatatggcttg

SEQ ID NO: 224505 - DNA, 717 bp, Homo sapiens
taggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatacaaagcccgtttggtggcctcttcacacggacacgtgagacagtctccaactcctggcctcaactgatccactctcattggcctcccaaggtgctgggattataggcatgagccaccgcacctggctcagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttc

SEQ ID NO: 224506 - DNA, 177 bp, Homo sapiens
gtagaaaaaaggtctcacttagttgctcaggctggtctcaaactcctgggctcaagtgatcctcctgcgtcagcctcccaaagtgctaggattacaggcgtgagccacagcacccagcccaacactttattttcttgccaatactctcgattcccttgcccccttctttgtcatcac

SEQ ID NO: 224507 - DNA, 464 bp, Homo sapiens
cgtcacctctgctgtctgttagcagagtggaggagaaaatacacagcacaaacaacgtgaaaaaatagttactctattcattaaaagctgtaacttccagattggacttgagaagcaattaagcaacagaggaacctcatctactatctgtattcaggcatgctcatgagaacacgctgctccagctggacttagaggaacccggtgcatcacaggcattcctgacagagtctcgtggtcctgctggtccactcagtggtactcagtcctcctcattctcggggataggttccaagacccccaggggatgcctgaaactgcggatggtaccgaaccctacatatattatgtttttttcctatacatacatacctatgataaagcttaatttacaaattagatagagtaagagattaacaacaattacagcaatatactgaaataaaagttatgtgaatgtggtc

SEQ ID NO: 224508 - DNA, 485 bp, Homo sapiens
agatgagccaattgagcaggagacaatgtaagcagctgtgggggtgtcgagtactccctcctgcctgtgggagctgcaccgtggagtctagcttgtcaccctccggaggcagagcccctcctccctgcctcctcttggtctagatggacagccatggcagcggaggctgcagagctgagcaggcccagctgcagcctcccagcctttggaaccctgcttctccatcttggccacacataggatcacctgaggagctcaaagtctacagcccaaggttggtgagatgggaaccacccagcacagcgggatctccttggaacctaaatccagtgatggaatcttattgtccacagtcttttgtggtatgtgctaccaccgaagatcctctcctaacctatcatgtgttcaatacgtctcagctcctagacttgctgaagccgacggaataaaagaacctctcaacactggggccaatactgacatga

SEQ ID NO: 224509 - DNA, 431 bp, Homo sapiens
gagacaaattccaaagtaggaataggaaacgactaccagtttagttaaggtatgactagcactgtttgcatcctttgctccacttctcctaactctcatttgacccttagcatcaagctcaaattattttttcaagggctctctgtatgaaaatgaatggttatgtctcccaagagaaggaaggcacaatttaccaaacagcaaacactctattcctatttattcatccattcattatttatgaattgccctatatacatcgggaactgggctgcatgatgatggaagaggtgtgtgctattttcagagaatgaatgtcatatcagcatttcagggccagtatgctgtttcttccagaccctgtggaaatatccaagtctatgtctaaacttgtatactgttacaagtaaattcaataaaaataataagac

SEQ ID NO: 224510 - DNA, 542 bp, Homo sapiens
gatcacttgagcccaggagttcaagaccagcctggacaacacagtgagactctgtttctttaaaaaagaaagaaaaagagtatggaggatgtgtcttcaggcaggcagatacacaactgaaaactttctagaaaggccttgaggaatgaattgttcttcgacagaagatgggaaagaggtcattctcaatagaagaaaaaaaatgaccaaaagtgaagaagaaagcaagcatggggcatactcaggaaagatcaagacctctgagagaaccagtaaatgggttacatagatgtaatggtgtggcaggaggctacacagaaggaagggcaaaaccacctttaaatgttggattgaagagaatctgcatttactttgttccacaatgagtcttattaaagctttaatcagtagatatgaagaagacaaaaggggagccaaggagatcacaccaggtagaggcttattataagtgtcttgtgttcacaaagcatttgaggtctctgatggcaagaaattttgcaatgaaaatggcaaaggcagaa

SEQ ID NO: 224511 - DNA, 586 bp, Homo sapiens
tcttccacgaaaccagtccctggtgccaaaaaggttggggactgctgtcatacattagctaatgagctctttgggaactgaattttaaattttttaaattttagttaacttaaggctaagtggccacatgtggctagtgactatactattagggcagattggaacattccaattaaaagtcagagattgtcaggctagataaaaggaaaaaatcaacatccatcttaaatacagagacatggataggttaaaagtaaaaggctagagtaaaacactactatacgaatacttatcctaggaaagttggcttatgcctgtaatcctagcaactcaggaggctgaggcaggaggatcagttgaacccaggagtttgaaaccagccagggcaacataatgagaacccccatttctaaaagaaaaataaaaaaattatctgggcgtagtggcgtgtgcctgtagtcccagctgtgagagagactgaggtgggaagatcatttcagccttgaagtttgaggctgcagtgagctatgattgcaccactgcagttcagcctgggcaacagagtaataccacatctctaaaaata

SEQ ID NO: 224512 - DNA, 675 bp, Homo sapiens
gctattaatacatgccacaacctagatgaatctcaaaataattatgctgaatgaaaaaagcagaagaaatatttgaagtaataatgactcagagtttcccccaaatgaacgtcagataacaaaccacagatccaggagaacactaacaggaaaaatatcccccaaaatatatcaaggcatatcatatttaaattgcagaaaatcaaagataaatacaactctgaaagtagccagaggaaaaaactttacccacacaggggctaagataataattatgtctgactacgcctcaggagccatgaaagcaagaaaagagtccggagaaatatttaaagcattgacagaaaaaaaaataccaccaacctagaattctggtaccctgggaattgcctcaaaagtaaagaataaatactttctcagacaaacaaaaattgagagaatttgtcagctgaacttctctctcagaagaaaaatgttatagtcagaaactcagatctacataaaaaaggaagagcatcaaagaaggagtaagttaaataaaaacattttatttgaattgatctaacagacaatagtttgttcaaaataatggcagcaatataatgacaaatgctcacatatatgtgctcatgtatgcttatatgtaagtgtaaggaatgacagcagtgatacaag

SEQ ID NO: 224513 - DNA, 422 bp, Homo sapiens
tagatgtcatgtggctcctgatatgatcacagcatagccaaaatctaattcccaaaaaatcaagcaaaccaaaattgagggacattctacaaataaacaaaaaactgttctgtattctccaaattttaaaggccataaaagacaaagaaagactgagggaccattccagattaaaaaagatgaaagaagacaactatatgtaacatgattttggtattagattcctgacttggaggagaaaaaaggcattttttacttaaaatagtttttatcaatgttaatttcctgattttgaaaaatatccttatttttaagaaatacaccatgtagtacttagcaatgggacatcatgtctgtaaacttattctcaaccatttcaaaaaaaagagacaaacacaatagtaaagcaaatgtggtaaaat

SEQ ID NO: 224514 - DNA, 489 bp, Homo sapiens
cactagagttttattgtttttttcagttgtcctttgctttatttgtcattttctattgaaagccttaggatagttagggttgcaggtggctaaactatcttataaggcctcccctatctaatttctggagagaatgactgcaaagaaaatggagaaagagtgtgtgtgtgtgtgtgtgtgtgtttactggttaaaaaaatcaatttgcaaagaccccattattcagtgaacgaggggaaaaggcataccaagctaatctaaacacagcttccagaatctgagtggttttatttacctaggatgggaacagacaactttctgaaaggctaatcagaattaatgaatagaaaaattaagaaatagaattaattcttggaaaacaggaaaggaaaaattgtaatcaggcatcaagtttgttcaatttaaataagctgaaatctattagaattaagaaaaaactaccttaaggctaaccttccccttaagatt

SEQ ID NO: 224515 - DNA, 541 bp, Homo sapiens
agaaatgaaataatgaaatacacaccaaaaaaaaacccagaaatgaaaaggatatccctgagctttgtattaaattcttaagtgtcataagctatttcataagatattgggttaaggcctcaaatgtaagccacacactgtttctgacagcccttcacatgccgtgctcatttctacacatgccaaagagctccctttcaccagccattttacccaatagggaaatcagtgtcaacctgcaaggcagaggggcaaacaggcttggggccctgcgtgttatgtccagacactgctccttctcctacagaatgtagagcactactttgggaggattaaaagagaaagtactaggcctctctcctgctctctccccacatttaagagactgcactgtcaacaggcacgtgtgtgtgtgtgcgcattcttgggctcaggaatctgatgcagggatctagaacaagctgccatagctattagcagactactgcccacgactgcctctggagcaccttcactctgaggccaccacttttacacacat

SEQ ID NO: 224516 - DNA, 593 bp, Homo sapiens
ttctggaaagcatagttttcatcacatctccatatggttttctaggccacctacctctatcatcttggccatcaagtacaaaattagcatgctgaagaattttgagtattttgcctgcatctcattacaattaaacttctctgacttcagctaagttaatcttccccacatcccaaaagtttctttttgtgtgagggttttggggaggacagcattttcaaatatctatatgtaaattcctttataaaggaaaccccaagattcaaaagctgtctgtggttatcattttctcagttacagtttgataaattcttagaatttcaaggtgtgagagctgtggtcagcatgtcttcaagtatattggggtattttaccccctcagttagctgagaaagtatcaaccaagggaagaaagctatacaacaccaaaaaatgaatatgatgagtatagaaggagatttacggagactttaaacacataatcgtatacacactgttctgtaacacttgtctcttctgtcttttcctagaaatgtttgcttttgaaaacctgaaagttgtttgaacttttattatccattgttcgaagctag

SEQ ID NO: 224517 - DNA, 477 bp, Homo sapiens
agtcgcccgtcctcttccctatcaaccattttgaggatcataacatttatcatgagctttattatgggagactcttcttcgtgtttaaaaataaacgctggcttacggaactatatttggtatatggaagtcgtttgcatgtaaatgtgcttaaaggacaactgctttatttaagatgcagagtgagccccagctagagcgtgcctgggatgggggaggggacaggacccaggggtctgcctggctctggacagatgagtgtagcccacagtcctgttgaatctgttgtccttttccctggggacagttgcagaacaggataactcgtacttaaaaattcatagaaaatgtttcttattataacgtcataattgttatgactcagaaaagtagaattgcctttccactatgcctgtctgccctcacttttgttgcctaccgagtccccagcagcagctgcagaatcattaaaaaaga

SEQ ID NO: 224518 - DNA, 457 bp, Homo sapiens
aaacaaaaacaacagaaaacaaaaaaacccccacaaaacttaatattcaaagtaatgtagacattcagagaaaagttgtaacttgttgcttgaatgaagcagagtaggtaggacaattctgataattgactaaaataatataaggatatcatagtgttctgttagagatttaacttgtttctgctctggtgagaggtagcaattcaatgtggagacgtgcgcatcatgtctggccaacaccattgaacttgggaatgacactctccagggacatctcttagaaggttcttagagaaatgggacatgggttgttttactggttattaatggataagatacttgaatgctgggctgataattctgcttccccacctcctctactccagatttatttcccaccattccctgctctcctttttctcctagtgatggaccccaataaactgtgttatgtaga

SEQ ID NO: 224519 - DNA, 479 bp, Homo sapiens
caaaaaattacaatgaatatttttacatatgtctagtgcatacatgtgaaaatttagaagtgtgaggtgtgtgcacgtgtgggatcattgggtgggacgattatgtgcatattcagtaatacatgtgtcaaaaagctcttcaaagtgcttgtgccaatttaaacttcccaaagaactatctgagagtaccactgttctacatcttcaataatacttaataatttttaaatgttaccaaatgttaaatttttaaattcacatgagtattaattatgtatcttaatatgtatttccttaagtattcataaagttgagaacgttttcatgctattagccagtggttttcttcttttgtaaagtgtttattcatacccttcactcatatacacatggtattgtttgctttttggtgttattctatagatgttatttgtaagttctgaatactaattctatagctattaaatatctaacatata

SEQ ID NO: 224520 - DNA, 345 bp, Homo sapiens
gataaacttagtttacaaagtgcctttatgttcattattttttttaattcttagaataaccatgggaagtgtgtgtcatgcttaatataaagtaaaatatgtattatgtacataattgagggtaagttatacattatcattagaactctgtctcttccatttctctctatatgttggctttattctctgaaatgatcttcccccagcagcagtggtcatggctaccggtagctctggaacaacatcctcaaagtttccctccctcaacactagtttgagaaattctaaggcaggactttggtcctgttacatcaaaatttcatccccctgttaatcattatgtgt

SEQ ID NO: 224521 - DNA, 570 bp, Homo sapiens
atactaatcgagaattggccagtggtatactggtagatgtttaaagatcaaccctcggggagaaaacatggccctgatttgtagcatttgctggcttctgtgatgttaatacttccatcttggctgattaaatttgaagtgaaggggataaatgcaggatggccagagatgtggttactgaaatgatcagcatgtccagagacatatggtgaaatcaggagagtttgtgtagataggacagtgtttggcttagttcagggttggtgtcccataaagggaatctagtcgtggtataatccctgatccccactggtgcagtgttaaactttggctcacgtgccagtctccacattcagagccctaggacttgccacataaccagtggtgactagggtgattgggatggtggttggggaggtaaagtagagagattagcacttccttggtgctgcttccatgcattaattcattagcctagcagtaaaacctggcacctatccttctcccagaactctctcctgggctgcttttcttccatatcttcagcacctgggggcctggggatgtcct

SEQ ID NO: 224522 - DNA, 434 bp, Homo sapiens
acacacacacacacacacacacattgtgcaggccctggaccttgcctctgtctccttcctgagagatggccagcaacacagtttctcaactatttcgtctggatcaggaaaaaaaaaaaaaaagattcttggaaggtggaagagaaccatgggaaacttatttctcccctgtccccatctagacaacaattacatgggcagaatctgtcagatgtactactttggaactctagagtctattgaagaaggcctgcaacttccagggaaaggcttggacagtaaattgctgttaattttggacaatttcagcttttatctcaatagctatgcatcccctactcattagcctcatggctgggatccatgcacatgtttgtgaagcagcttgcatgtagcttatgggagccatgtggggaataaatactatgtctttc

SEQ ID NO: 224523 - DNA, 230 bp, Homo sapiens
gaaggcagagggctacaggagcctagaaagcaagggaagaggagagaaaagaaggggtcaaggagtatgcatccctatggggaagatcagtgatctgtagctggccagttactcaaacctgtgccacacgggttttatggtatccatcatcaggactccagctgaggaatcaaatcaaggaaggggaataagtaatagtgttgagaacttagaacagcctgagcattaat

SEQ ID NO: 224524 - DNA, 769 bp, Homo sapiens
agcggggttgcacaagtgccttgtgggaaatgtgactgcctgaaatagtggctaataatggcttgtttccaaccgaagcccatttgcctttcatggttaacattctccaggcccaggcagggaaacagaagtcccggaagctcaggctgctgctgcctgtgatggaaatggtctctatggtgactccccgcaggaaacctgcctgggtgatgtcttcctgaggaccatagcctgtccgcttggggccattatctggacaattgggagccgaataccacccaaaaatagccagacaccagaatataagtattttgtattacagtctcactaaatttgggaaagtaggagaagggtaagagtgcaggctttgcaggcagctggacctaggctctgccagctactaatggtgtggccttgagcaactgaagttcgaggagcctgtttccctggctacaattcagggatgattggggttgcattccataaatgcaatattttgaatatcagatgtcaaatgcctgaaaataccaccaaatcaaccctcggataaggcagccaggtttcctgctaccatgggacttgattaagattgggaagagccatgacctaggagtttgggatgggaagacatggcaaggcaagagtttttgaagagtcttggtgaaaagacagtcattagatgctattaaaaagttgtacaatctgctgtttgtgtaaatgttatttgcaaagtccccgaaatgaacaataaaattatgttcagctttta

SEQ ID NO: 224525 - DNA, 862 bp, Homo sapiens
agcggggttgcacaagtgccttgtgggaaatgtgactgcctgaaatagtggctaataatggcttgtttccaaccgaagcccatttgcctttcatggttaacattctccaggcccaggcagggaaacagaagtcccggaagctcaggctgctgctgcctgtgatggaaatggtctctatggtgactccccgcaggaaacctgcctgggtgatgtcttcctgaggaccatagcctgtccgcttggggccattatctggacaattgggagccgaataccacccaaaaatagccagacaccagaatataagtattttgtattacagtctcactaaatttgggaaagtaggagaagggtaagagtgcaggctttgcaggcagctggacctaggctctgccagctactaatggtgtggccttgagcaactgaagttcgaggagcctgtttccctggctacaattcagggatgattggggttgcattccataaatgcaatattttgaatatcagatgtcaaatgcctgaaaataccaccaaatcaaccctcggataaggcagccaggtttcctgctaccatggtaagggagaagaccctttacagagtcttagaatcatctcagaaaaccaaatgcaaatgggatatgtctgagttttgagcatctttcctgcagggacttgattaagattgggaagagccatgacctaggagtttgggatgggaagacatggcaaggcaagagtttttgaagagtcttggtgaaaagacagtcattagatgctattaaaaagttgtacaatctgctgtttgtgtaaatgttatttgcaaagtccccgaaatgaacaataaaattatgttcagctttta

SEQ ID NO: 224526 - DNA, 370 bp, Homo sapiens
tctactcctgtttcctcctctgtcagatggtgtgactgcagggcctacctacagggctgttgcacagatgaatgaaagtatatgaaacccttggagcagtgcctggcccagagggagcaccacagggatgtgtcagatctctcatcaaagggatcaggaattcgagacctgggtaatatggtgaaatcccgtctctacaaaaaatacaaaaattagctgggcgtggcagtgcacacttgtagtatcagctattagggaggctgaggtgggaggatggcttgggccagggaggcggagattgcagtgagccgagattgtgccactgcactccagcctgggtgacagagcagcaagacgctgtttcaaaaaa

SEQ ID NO: 224527 - DNA, 545 bp, Homo sapiens
gggactgggggccaacctgatgcaaagagaggcataaaggtggtgagcctgagagttgaggtctcacgaagtaaaatgtgagtgggacttcaccctctcagtgggcaaccacactttcccatcctgagatgaggctgccaagagagcacactgctaacactgcctgaggagagcacgcctcctgtctccttcaccctctgcttctgagaccctcctgttactgttatcatcgttccctagcctggctctgcctttctcagcagcccacattccatggatgggagcaggggggcagggacccaaaggagggaaatggctgtgggtggtgtgaaggccccccagccctcaggaaggtggggcaagagaccactgagcacaagggatcttgcccacctcctctttgactctgtggattatccatccatctgctcactgtgaagatggagaggcagtgccctaaggctgtatattagcttttccatattttttcaacattgaaaaaataatttttaaaaactgtgatttttttaaaaaatcatttggct

SEQ ID NO: 224528 - DNA, 520 bp, Homo sapiens
gtcggcgaccccgcgcagcgctgcctgcagaccctggagaaggcggaggcctgcgtctccgggtgctttcctacctctgggctccccgagaccctttctgaggccggaccctagttagtccgctgggctggggatgagggctaggggctgggaatatcagtgattgggaggacttaagtttttagttaatttgaccttgttgggcggccaagtccttaattataacttatatttgagtacaaaattatactcgggattcaaggctgtaagttaaaattaagtatgaaaatactggaattgtaaagatggaaagtagattcttttattaccagtttaaaaaaaaaaaaaaagcatttcccaatccccttctccaaaggaaatccatctgatgccatttctgtaaatgcactgatgaaaaccgtaacactgtcagctctgatcttgtagtccctaaggaattataggttctatctgtggttctctgacattttattaaacaagtgaaagtattcaaggaagc

SEQ ID NO: 224529 - DNA, 224 bp, Homo sapiens
cagtatctggaattgatatggatctttgtgtttaagacagggaactgaagcctggctgtaccatacatactttaaacatttatgcttatgtaactgctaatcgaattttgaaaaactatataacttttcacactttttacaaggatgtttaggtttaatgagttgaaaagatatacattctagaatattgtaaatatgacattttaaataaaaattgttacacc

SEQ ID NO: 224530 - DNA, 205 bp, Homo sapiens
cagaaagtacctagttaggagggaaagtagacacagacgttcaaacctatgaaatgagacagcgatatggggttctgacagaggtacggggagcatgctccaggactacagatgagggagtaacattgggatgacctggggaaggaaatgctggaactgggtttctgaaaggagatttttttttttttttttttttttttttttt

SEQ ID NO: 224531 - DNA, 189 bp, Homo sapiens
ccacccctccacagcaccctcacagggtgccctatattcatattggcacaaaagccccataaccagtggggcctgtgagcatcctgtgggcaggggttttgtcttttgcatttgtgcattccacacagttagcatcagagctggtacatagtaagtgctcaataaacattggttgaataaatgaactac

SEQ ID NO: 224532 - DNA, 279 bp, Homo sapiens
tattcttggtgttggattagttaattactatcaaagtaattactttcaatggcaaaaacatcaattacgtttgcaccaacctatagttacactgcgaaaagtgactatggtatatcatgatggggtattctagagttcaggaaatctgtttcctcatctggagtctcattgcatatggttgtttaatattatatgtaaatattcataaaaatgtgcatttatgtttttgcaccacttttttgtaaaggttagacttcattaaaggaattaccagattat

SEQ ID NO: 224533 - DNA, 563 bp, Homo sapiens
gctagccattggccaggccaccaggggtccccatgataatgcacagctagttgcttgagcatggttatggtgattcgtgcccccaacagccttccatgaccatatgtgattattaatgtgctagaatagtttatcttggtgtcttgcacacatcatgatttgtaatgtatatatttaataattataaaagaaagcagttatttgctttctttaacatacattatcttcaaattcctaacttagtgatgatgcaatcattcttttcacatgtgtatgtttttttgtgtcttggggaagctttgaaatacttgctgatttatggagagtgaaaagtgaaccagactttctcagaacatttagaaaaactcagacactcaaaagctaaaatcaaacagtatttgaaatgatttatacaattgcagccataactttttcccacttaagccaaagtacgtctaaacaatcctttcatactgctaagtcctttaaatggaagcaatagatgtctataaatcaaatgatagtttacatttatttcataaccactttttctaacccatttt

SEQ ID NO: 224534 - DNA, 318 bp, Homo sapiens
cacacacacacacacacacacacacacacagagccaatgtcaatttccttgttttgatactgcaccaatgtcaatttcctggttttgatactgcactaaagttatgtaaaaagtaaccattagagccaggtggtggtgagcacctatagtcctagctacatggaaggcggaggcaggaggaggggaggatcgctttagtccaggaattcgagaccagcctgagagaacctgtctcaaaaaacagagtgaagggtacatgggacctctttgtactatttttgcaatgtcctgtgaatctacaattatttcaaaagaaaa

SEQ ID NO: 224535 - DNA, 365 bp, Homo sapiens
gatggacgtgtttgggttccccccagtgagctctaatatgttcataaagagaaaaagcactacttttaaaaatgcgaagtggccgggcatggtggctcactcctgtaatcctagcacattgggaggccgaggtgggtggatcacatgaggccaggagttcgagaccaacctggctaacatggcaaaaccccatctttattaataatacaaaacttagctgggcgcggtgacacgtgtctgtaattgtagctactcaggagggtgagacacgagaatcgcttgaacccaggaagtggaggggccgagatcgcaccactacactcaagcctgagcgacagagtgaaactgtgtctccaaaaaaaaaa

SEQ ID NO: 224536 - DNA, 500 bp, Homo sapiens
atggggagttactatttaacaggtgcaagagtttcagttttgcaagatgaaaaaaagatctggagatggatggtggtgatagttgcttcgtttatctgtaaatagtatgtgactctccgaaatggtgattgagaatacaacttttttttttgagatggagtcttgctctgttgcccaggctggagtgcagtggtgcgatctcagctcaccacaagctccgcctcccgggttcaagcgattctcccatctcagtctcctgagtagccaggcacacgccacaacacccgctaattttttttttttttttttttttttttgtatttttagtagaaatggggtttctccatgttggccagggtgatctcgaactcctgacctcaggtgatccacccaccttggcctcccaaagtgctgggattacaggcctgagccactgccctgaccagctttttctattcttaacagagcatctcctaggttctagatcgcgagcggccgct

SEQ ID NO: 224537 - DNA, 444 bp, Homo sapiens
tgtttgtttccagggctccgctggaggtaagtaggtggtggcgtggatgacgtgcgccacagtggaccagccagtgggtctcaccgtggtgagttatgtcccattccgacatgtgcagagctgaggacatgagttttgagccttgaattaccctgggcttttagcccctgctttgccaaatgctgcctctcaataaaggttttcggtttgaaggtaaaggaaaattgaattttctgtgttgaaagtagcaggtggttctgtcagccatggcctcaggggcgtttagggggaatatggaagtttgtcctagtacgttgagcaagatagcgcagagttcgttcatttgggtttttatttaatatgatttgcatattttactctaagatttccatctctgtcggctgtgggaggacagcagccgagcaagttggatgtaaacagagg

SEQ ID NO: 224538 - DNA, 410 bp, Homo sapiens
gcaccatcctccccattttaggcactgttctctaattggcctgccttcctttctggtgaatccctattggctctcttggggctcttgcattctcaggtctgtggttacattgttgcttttcttttctttctcctgcctagatcctggcattgctacttgtatttttctttctgatactgccatactaactcaatgttatgttgaaaataatgtttttcttaatttataaagtaagttattttgtttcagtctaatttttttggagtcacatagttcaaaggattctacataagcattgtgctcaccatacggaccattaatttattcagcaggtcattaaccatgcagatcattaatttattcagcagatattcctccctactttgtgccaggccttgtatcagaggctg

SEQ ID NO: 224539 - DNA, 228 bp, Homo sapiens
tattgatgtatacctgctttccatacacacacataaactcttctatgtgttttataataacgaatttaataatctttgaagatatttttactgcatcctcaattcactgcactaattcatgcaattataaactgcaggaaggaggaaatacccccatcttgcgataaataaagcaaaatccttggcagaaccatgcccgcctgtccgcgccccgaccagccctcccgg

SEQ ID NO: 224540 - DNA, 630 bp, Homo sapiens
tcactgctgagaggggaggtgctctggggttaaaaggactgaattacccaagctttgtcacacaggggttgtgaaacaatcatgtatcttttcttttaaatccttagttttcacacctatacctcatatttttttttgaagatggcatccaacaaaataggtacttaaactatttagcagcatgcttggctgcattcggttcataaatactcattcctctgtttttcaaaagtctcataattcaagtactttgcccaaagtcctcaaactcagcagctgtgctgcttccctttcctccaactttcgcaaatttcatctgttctatggcatctactatcgaacatcagaaagaagaggcagaacttaacagttaggaaacagacttcctctactgtaatatgaaagtcctcttctagatttttagcactccttacaagctttggcctttgtaaaaggatgttatgtaaaacaaacaaacaaacaaacaaaaacaaaaaaaactgtgctttgcctttggaacctacttccctggacatacgctctgagtacagaaagaagaggctttagcaaccagaaaattaggaatagcatgtatgaaattagacatggaaccttgcaactttgagacag

SEQ ID NO: 224541 - DNA, 523 bp, Homo sapiens
gtaatcccagctacttgggaggctgaggcaggagaatcacttgaacctgggaggcggagattgtggtgagccgagatcgcgccattgcactccagcctgggcaacagaatgaaactgtctcaaaaaacaaaacaaaacaaaacaaaaaagagaagaaaggtagaaaaagaaaaaacaaaacagaaatgtcgttacaccctaacttgagagtgttttctttttctttttcttttttttgagacagagtctcactctgtcgcctgggctagagtgcaatggcaatggtgtgatctcagctcactgcaatctctgcctcctaggttcaagcgatcctcccgcctcagcctcccaagtattgggattacaggtgcctgccaccatgcccagctaatttttgtatttttagtagaaacggggtttcgccatattggccaggctggtcttaaactcctgacctcaggtgatccacccgcctcagcctcccaaagtgttgggattacaggcgtgagccaccgcgcctggc

SEQ ID NO: 224542 - DNA, 583 bp, Homo sapiens
aataaaacatatcaaagaggacaaggcagagcctactagaaatgttttgcctttattcaagttactgataaattcattggaactgggctgggtttcctagagattactcttctggtggtctcttagtgattggtcattcctcttcgtgactggtcattcctcttgtttgcttaactacagaccaacctttaaaatgcccatttataggaggaggttataaaaagcactttgtaaaatgcttcattgttttaagaaaactttcagcctttttccattaaaaaaaaagtaaccatatcaaagatggaaatcaaaccgttgtttttaagacggggaaatttctagtgcctaaatatctgtaagctgtgagtttctgtaatccgttttagatttgtttcttggactatagattgtgagtttaaagacatttaaaatttttgattgccctcaccttccttggggcacattttatttattaggatttttattatatcttttcaagttgaaaacccttctaacagaagggggagtcatgataacatttggatgaggtctgtcattttacgtggtctgcaggcttaacttg

SEQ ID NO: 224543 - DNA, 573 bp, Homo sapiens
accggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaaaactgagtccaggaacacctgccttgttcagtgaagccgctgcccatctaaagaagctggaactggaaactgtgaaggctgctggaccctggcctcctctgcacatcaacataaacaaggctgaagaaaagaaagtctcggagaaaactcttcagactccacttttgccttcccctgttgcggatcatgtgaagtgtaacattctgaaagcccagttggaaaatgcttcccgagtgaacatccagggtggaaaggaggaatcaccgtttgtaaatatcaataagaaatccagtcttcaggacgctagtgtaagaagtcctattcctattcgtgtggaaactgcccagccagctgtggaaaagccggaaatcaagcctccccgag

SEQ ID NO: 224544 - DNA, 423 bp, Homo sapiens
taagcctgctcttttctgaatgacttacccactttttgaaattgtgccatgcagcttttcgtgctgccttccctgtcctcagctgctgctcaggtgccaaccttccatcctcaggctggtgctcgcgccctggggacatgcactgtcctttgtacagctcttcgttcatctcacaaagtgcccaggacattgtaggtgctgagtaaataatgggatgattgaggaaataaatatgtagaagttccttctgcagataaattttggggttattcacataaacaaatattacttgaataattagcattttcttagcctattgggtattctttatcttcatgtggaagtgggtccagtttttgtgtaagccagaagcttatgtaagttttgagaacctctttaaaaaaaagaaaatataaagttggt

SEQ ID NO: 224545 - DNA, 360 bp, Homo sapiens
ctctgctcatatattgtctcagaactctgcccattccctttaggcagagtgtatgaggccaggaattgtctatttgtgttctgaatacctactagatgtgtcagaaacatagtcaggatgtgccattaactttgatattgaggaagtcatcctacttaagggagagagaccagtgaatattctgtggcattctgaagtatttacaaagtcctgggggaaacagatgagtggaaaagttattcaggttcttagcaaggtgtttggttattaaagctgtctcaaagggttttagaagttaaaaaggtgggtaaaggcattctactgtgcgagagtggaatgtgtataaagcatggaaatatt

SEQ ID NO: 224546 - DNA, 289 bp, Homo sapiens
tgggagttgcttatgaacctctctttttactgaactatctcctccgtgcagaatttctcagcacctttctacctgccatgatgattccttccaggcgcatcacacggttctccatggaaactttcactttctatgattgaccaagcctgtcgtccctgggactgtaactgccagtcagccacgcagcattgccccaacaagcaggcgttctagctaagagaaccgaaacaggtaccaggcaaaccacatgccatcccatccccaaaataaataaacagtgaaaaaccca

SEQ ID NO: 224547 - DNA, 663 bp, Homo sapiens
gagttttgccatgttggccagactggtctcaaactcctggcctcaagtgatctgcctgcctaggcctcccaaagtgctgggatttacagaatgtgagtcactgtgcccaccctcaattttttgacattgcttttgtagggaagtcctttttctgaagatgcatctatggtgttggttgagtagggcactttgattttgatttcgggtgcatgcagtagtatattatttcttccactgtaaatagcttcagtggtaactgtgatttccctagtggcatagagtatggttattagtggaggctgtgggaaagttgctggggactagaatgccagatgggccagtcttcagtccctagtggtggcagtggtgggctgggcatgcctgtccttgggtctttgggcagcttacactggcaccagtgtcagtgaatccagacagactgattcttgggcctccacggggctcgctcagatgctggtaatggcagctgtggtctgggcacccaggcaggttctcaggccccttggcagctgatgtgatgtgggtgatggcagtagcagtggtggagcaacccaaatgttcatgctagtgttggtggtagctacaacaggttagacgggccagtctcttggcctgctggtggtatgtgcaggtggttgccag

SEQ ID NO: 224548 - DNA, 2511 bp, Homo sapiens
  misc_feature (29)..(29): n is a, c, g, or t
  misc_feature (659)..(659): n is a, c, g, or t
  misc_feature (765)..(765): n is a, c, g, or t
  misc_feature (1967)..(1967): n is a, c, g, or t
  misc_feature (2005)..(2006): n is a, c, g, or t
  misc_feature (2078)..(2078): n is a, c, g, or t
gctacacttagtgactctgagggacatgnaaccctccccgcatgctgctgctgctgctgcacctacaatcctgccacccccaatgagatctgcccacccctcttggccgccttccccaggctcaggttttcctcactctttccctgggttccacgcgcccgcgtagcccgaactccgaccctgaggctccgcgtcccggcccccatcgcaggggcgcctctaggaaccagaatcccgcagatgactacacagacaagatcgtgcccccaagttcggcgagccgggcgcccaccgcgcccccagcccacgcccccggagttcctgcgccacccacagcggccctgagcttcaatctgcactttcaaaacttcccagttgcctccagagccctgcagttgaagatcttgtctagcacatggttttgctgttttcctcaccccgaactccctccttggagggccatcgttctctgtctcagattccaccctccttatcacacaactagagcttcggaggaacgtgatggggctcccaactaaggagggaaagaccatcatagctcagggatgaggctccgagatcctcagataacattaattgtcctctgtcttctcttgacttggcacatccttgcttggagcagggcaggagcagctganagggaggtggcacctggaggtctcagtcatttcacttctctgagcctcagttttcccatatgcaaagtgaagaggtacactccctcagggttttgcatcttcttantggcagaaacctagtcaaacaaaatattatgtaaatgttcagtataggcggggcgaggtggctcaaacctgtaattccagcacttttagaggcccaggaggctcttgaggtcaggagttcgagaccagcctgaccaacatggcaaaaacctgtctctactaaataatacaaaaattagctgggcatggtgacacacacctgtaattccaactactcggtaggaggctgaggcaggagaatcgcttgaacacaggagggaggcggaggttgcagtgagctgagattgcaccactgcactccatcctaggtgacagagtgagactctctctcaaaaaaaaaacaagtttataaaggaatgtatattgttctgattgacattgaaatagggtcaactacccccggtcaccagagcagcagtaacacctcaggggccacactttggaggcactgcccagaaagatttctgggtctttaaaagtcccttccagtcctgggaaattctatgtgaaaatgatggtccctgcttgctataatccctacaggtgacttattatctaagccatttaacacaggattgaatactatgcgactgtgtgccaagcaagaagcagtgttgtatgggacaccctagctgtgtataaggtatctggtaataacacaggaggccacagtgatagactgtgataacggaagtaattccatatccagtttaagtgtcttttctagggagtataaatcgttatctccattccaatatggactgaaaggtatcgacttttatccatgtgccaaaaattagattggctggttcctctcttctactccataccaggtcaggtatcataataaggactcagagtggtccaagctgcccaaatatctgtgtcttccactctgacctgtctgggaaccccaaatttatatccaactgcttacttgacaactgcagttggtagcctatcaggcgtctcaaatttgacctagccaaagcagaagtcctcattttccccgtaaatctcctccccagttttccctgtctgaatcaatggcataagcagctacaccattgctcaaatcagaaccttatgagtcctactgaaaccagccaaagagtcctatagacagttgtttttgtttttgtttttgtttttgtttttgagacagagtttggctcttattgccctcactggagtgcagtggcncgatctcggctcactgcgacctccacctcctgagttcnngtgattctcctgccgcagcctcccaagtagctggaattacaggcacgccaccatgcccagctaagttttgtntttttagtagatacagggtttcatcatgttggccaggctggtcttgaactcccaacttcaggtgacctgcctgcctcagcctcccaaagtgctgggattatagaagttgacccttttgcagttaaagctggaaacttacttgttttatccgagttccttcctcaggaaaggaccttcaggcctctcacaaaaagtatcaaagaactgaagccataaaaagtatcaaaagaactgaaaccagatcactgcactagatgctgggcccctcagtcaccatgattgcttccttgcccctcccatgttcctgttttcttacatattgttacatttctttcctgctatataaacccttggttttggtcagtcaaggagatggatttgagactgcactcccatctccttggctgcagcacctgattaaagccttcttcct

SEQ ID NO: 224549 - DNA, 2787 bp, Homo sapiens
  misc_feature (29)..(29): n is a, c, g, or t
  misc_feature (659)..(659): n is a, c, g, or t
  misc_feature (765)..(765): n is a, c, g, or t
  misc_feature (1967)..(1967): n is a, c, g, or t
  misc_feature (2005)..(2006): n is a, c, g, or t
  misc_feature (2078)..(2078): n is a, c, g, or t
gctacacttagtgactctgagggacatgnaaccctccccgcatgctgctgctgctgctgcacctacaatcctgccacccccaatgagatctgcccacccctcttggccgccttccccaggctcaggttttcctcactctttccctgggttccacgcgcccgcgtagcccgaactccgaccctgaggctccgcgtcccggcccccatcgcaggggcgcctctaggaaccagaatcccgcagatgactacacagacaagatcgtgcccccaagttcggcgagccgggcgcccaccgcgcccccagcccacgcccccggagttcctgcgccacccacagcggccctgagcttcaatctgcactttcaaaacttcccagttgcctccagagccctgcagttgaagatcttgtctagcacatggttttgctgttttcctcaccccgaactccctccttggagggccatcgttctctgtctcagattccaccctccttatcacacaactagagcttcggaggaacgtgatggggctcccaactaaggagggaaagaccatcatagctcagggatgaggctccgagatcctcagataacattaattgtcctctgtcttctcttgacttggcacatccttgcttggagcagggcaggagcagctganagggaggtggcacctggaggtctcagtcatttcacttctctgagcctcagttttcccatatgcaaagtgaagaggtacactccctcagggttttgcatcttcttantggcagaaacctagtcaaacaaaatattatgtaaatgttcagtataggcggggcgaggtggctcaaacctgtaattccagcacttttagaggcccaggaggctcttgaggtcaggagttcgagaccagcctgaccaacatggcaaaaacctgtctctactaaataatacaaaaattagctgggcatggtgacacacacctgtaattccaactactcggtaggaggctgaggcaggagaatcgcttgaacacaggagggaggcggaggttgcagtgagctgagattgcaccactgcactccatcctaggtgacagagtgagactctctctcaaaaaaaaaacaagtttataaaggaatgtatattgttctgattgacattgaaatagggtcaactacccccggtcaccagagcagcagtaacacctcaggggccacactttggaggcactgcccagaaagatttctgggtctttaaaagtcccttccagtcctgggaaattctatgtgaaaatgatggtccctgcttgctataatccctacaggtgacttattatctaagccatttaacacaggattgaatactatgcgactgtgtgccaagcaagaagcagtgttgtatgggacaccctagctgtgtataaggtatctggtaataacacaggaggccacagtgatagactgtgataacggaagtaattccatatccagtttaagtgtcttttctagggagtataaatcgttatctccattccaatatggactgaaaggtatcgacttttatccatgtgccaaaaattagattggctggttcctctcttctactccataccaggtcaggtatcataataaggactcagagtggtccaagctgcccaaatatctgtgtcttccactctgacctgtctgggaaccccaaatttatatccaactgcttacttgacaactgcagttggtagcctatcaggcgtctcaaatttgacctagccaaagcagaagtcctcattttccccgtaaatctcctccccagttttccctgtctgaatcaatggcataagcagctacaccattgctcaaatcagaaccttatgagtcctactgaaaccagccaaagagtcctatagacagttgtttttgtttttgtttttgtttttgtttttgagacagagtttggctcttattgccctcactggagtgcagtggcncgatctcggctcactgcgacctccacctcctgagttcnngtgattctcctgccgcagcctcccaagtagctggaattacaggcacgccaccatgcccagctaagttttgtntttttagtagatacagggtttcatcatgttggccaggctggtcttgaactcccaacttcaggtgacctgcctgcctcagcctcccaaagtgctgggattatagaagttgacccttttgcagttaaagctggaaacttacttgttttatccgagttccttcctcaggaaaggaccttcaggcctctcacaaaaagtatcaaagaactgaagccataaaaagtatcaaaagaactgaaaccagatcactgcactagatgctgggcccctcagtcaccatgattgcttccttgcccctcccatgttcctgttttcttacatattgttacatttctttcctgctatataaacccttggttttggtcagtcaaggagatggatttgagactgcactcccatctccttggctgcagcacctgattaaagccttcttccttggcaatacttgtcatctcagtgattggctttctgtgcaccgagcagcaggacctagaccaaacccctggtgtttcggtaacaatacttgattcctcccatatacagtccatcagcaaaatagcctcaaaagtgtatccaccatccgactacttttttccatgtacactactgcaacattgtcttatatctggactgttgcaatagcagtgaaccagaagggagcttaactggtcctctgaattcattcttgccttaaataaatcttccatatagt

SEQ ID NO: 224550 - DNA, 525 bp, Homo sapiens
aaccattgcaaccaccttgtgagtttagattattcctattgtacagatgaggacattgaggctcaggaagattcagtagagaagtggtggcaaagacaataaaacaaagggtataatgaaggactaaatagtatcatttatgtaataaatattatgtgagtctattcaggagaaatttatgtgggctggcatcattcaggaaccttcaaggaacagagaaacctgagtcaggctgtgagaaaaggttagactttgttgatttgtggaggtggagaggagaattccaaatagaggaaaatgctctggcaaagtcatagagttgggttacagattaaagtatcagagacaccagcataggaaacagagcaagagcatgtctctacaaaaaaaaaaaataaaataaaattggctgagagtagtggcgcgcccttatattcctagctacttgggaggctgaggtgggaggatcacttgagcctaggagttcaagattacaatgagctctgaagagtgagaacccgtctc

SEQ ID NO: 224551 - DNA, 365 bp, Homo sapiens
ccagaaaatactgttggctttctttatttttaaggctagaaaggtataaactgtgtttatagaaaaatacttatattaagccgggctcggtggctcacgcctgtaatcccagcactttgggaggccgaggtgggcggatcttgaggtcaggagatcgagaccatcctggctaacacggtgaaaccccatctctactaaaaatacaaaaaattagccaggcgtggtggcgggcgcctgtaatcccagctcctcgggaggctgaggcaggagaatggcatgaacccgggaggcagagctggaaatgagccgagatcacaccactgcactctagcctgggcgacagagcgagactctgtctcaaaaaa

SEQ ID NO: 224552 - DNA, 386 bp, Homo sapiens
caaaattcacatatagtgatcttaagtatacaatttgatgtctgtgtgtaacagccatccttatcaagacacagaacattctcatcacctcagaaagttccctcatgtcccttcctatttgatcttcacctccctctaataggtaaccacagttctgatttttatcttcaagattacgttcgcctgttcctgaatttcacataaatggctttttttgcaccacaaatgagtccaagattcattcatattgttgtgtttaatgatcatttgttttttaaatttgtactccattgtaagaacaatataagtaattttctgttggtgaacatttaaaatgttctagtttggagctattatgaataaagctatagtgaacattcacgtat

SEQ ID NO: 224553 - DNA, 377 bp, Homo sapiens
gattaggaatttgccactccagccttcagtgagaccaaaggtctgtcaatgtagctagcctttgattgttcattccagagttgaataatcctttcatctgccactagagccccgaacccagcagccctacacctcctaaatcataaaatcatttcacctggcacctttaaaggtagaaaatggtgagtgatcactgtcacataaaggagatttaccactgaagattaaacttgtatctgaaacatctaacacttcctcccagagatggacatggatgacatttctgcagccttcatgaaatgagttggctttattttttgtgctatattagcatgagtcattgtggtttgggggtaagcataaatgagcttggttgt

SEQ ID NO: 224554 - DNA, 291 bp, Homo sapiens
ctgggttcaagtgattcttctgtctcagtctcctgagtagctgggattacaggcgcctgccaccacacccagctaatttttgtatttttagtagagacggagtttcgccatgttagccaggctggtctcgaactcctgacctcaggtgatccacccaccttggcctcctaaagtgtgggattacaggcgtgagccaccacaaccagcccgtacctcctcactcttaatgtctgtatagtattctattatttgggtatgtagcaacttacttagccagaccctccttttaaa

SEQ ID NO: 224555 - DNA, 167 bp, Homo sapiens
cattctgctattctaataagtatgtagtgatatctcattgtggttttaatttatgtttttctaaccttttttatatttaaatttttcatataaatgttcatgttggtctattagcatatcttctacatttaattctttaaattcattccaagaaacaactataggtg

SEQ ID NO: 224556 - DNA, 475 bp, Homo sapiens
tgaaaccccgcctccactaaaaatacaaaaattagccaggcatggtggtgggtgcctgtaatcccagctactcaggaggctgtgccaggagaatcgctcgaacctaggaggtggaggttgcagtgagccgagattgcgccgttggactctagcctgggcaacagagcaagactcgtctcaagaaaaaaaaaagagagagaaaacgatacgtgtcctggtgacgactcctgcaccttccctgctagcctgccttgctctgccctgcctcctccctcctcctgctgtggcctctggagctcctctctcctggctcacccagggacgtcacccttgcctcttctctctgcgactcccaggcaaaggactttccgctcacaagcaaacatgtgctggcaggtctcttcctgtgatccctccaccctctatagctactgccccgatccctctgcttcctccagcttctcgtcaattcgcc

SEQ ID NO: 224557 - DNA, 429 bp, Homo sapiens
atggctttgaagttcagaacatgagaaagagctaatggtagggactgacttgaaagcctttgcattctaagaatgatgattaggtttctaatgtattattaaataatgtccagcccacaaaaaagatgaagtctgcaaaggtatacacaataactctgtgccttgctatggtcctatctgatctcaaacaagaagctctttgggttgtgttgctggtggttggatgtgttctgagccatagctaggcttatgcacataacaaagtctgattcccaggaatctttttaggaaacacctcccagattaagtaatatttacctacttgtcctctttgaacagtgctcctactgattctttaccctaatgaagttcatgtcccaacccacacccttttcctaaaacaattaagcttttagtggtgacatgatg

SEQ ID NO: 224558 - DNA, 503 bp, Homo sapiens
acaataaaacaaaaacccacatgatttagaaatgtttttgacaaaatccaatcctcattcatgataaaaactctcaacaaactagaaagaaaagaaatttctttagcttgattgataaagggtatcttcaaaaaactcaaagctaacatcatctataatggtgaaaaacagagtgctttgcttctgaggttgagaataggaaaaggatattcattcttactatttttatttaacattgtcattgagattatagccattgcaataaggtaagaaaacgaaaggtatctggatgggaaatgaagtaaaactcattacttgcagatgacatgactatttatgtagagaatcagaagtctacaaaaaagcaaatagattaactgagttttacaaagttgtaggatacaagatcggtatgcaaaaacagttatatttctgtataccagcaatgaacattctacaaataaaattaagaaaattttattcttatgaatattctacaaata

SEQ ID NO: 224559 - DNA, 375 bp, Homo sapiens
gggcaacaggcagaaccaaagagtcaagtttgaagaaactataggacttttacttggagctgacacagagcgtatggagcgaagtgtgaactcaaggaaggcaccatggcacatgcctattgtcccagcaagttgggagtctgagacaggaggatcacttgagtccaggggtttgaggctgcagtgagttatgatcatgcctgtaaacagccactgcactccaacctgggaaccgtagtgagaccctatctcaaaaaagaaaaaagtctgaacttaagtctaatctacctcttttggactgtgtgatctcatgttactttactacattaagcctcagtttcatcatctgtaaaacagcagtacttccctgatgga

SEQ ID NO: 224560 - DNA, 294 bp, Homo sapiens
gcccttctgtttctttttacagagtcaatttctacccatttgtcaacccactcaagaactactttgcctataaatcttagattataaactccatgagtacaggaccttgagttttctttttttttttttttttcaactcagagtcttgctctatcacccaggctagagtgcagtggcatgatctcagcttactgcagcctctgcctcctgagttcaagcgattctcctgcctcagcctcccaagtagctgggattacaggtgcctgccaccacaccgaactaatttttgtattt

SEQ ID NO: 224561 - DNA, 502 bp, Homo sapiens
cggccgccggtcctccgggacgcggaccgccaggacttgaacgcaactcccaattgcagaaaattggcaacgtctctgaagagcccttgcttttgcctggacccccagcatcatggtttcccatttcatggggtctctcagtgtcctgtgtttccttctgctgcttggattccagttcgtctgcccacagccctccactcaacacaggaaggtcccgcagcggatggcggcggagggcgcccccgaggacgacggcggcggcggcgccccgggagtgtggggcgcctggggcccctggtcggcctgctcgcgtagctgcagcggcggcgtgatggagcagacgcggccctgcctgccccgctcctaccgcctgcgcggcggccagcggcctggcgcccctgcgcgcgccttcgcggaccacgtggtgtcggcggtgcgcacgtcggtgccactgcaccggagccgcgacgagacgccagcgctggccggtacggacgccagc

SEQ ID NO: 224562 - DNA, 597 bp, Homo sapiens
tgcagggagagagaactgaggatgagggggctaccatccccatatatggctggtttgtgctgtgcaccaacaagaacctgctttgaatttccatgccaatttgcaacccccatactgttccaagcaaggacttgaacgcaactcccaattgcagaaaattggcaacgtctctgaagagcccttgcttttgcctggacccccagcatcatggtttcccatttcatggggtctctcagtgtcctgtgtttccttctgctgcttggattccagttcgtctgcccacagccctccactcaacacaggaaggtcccgcagcggatggcggcggagggcgcccccgaggacgacggcggcggcggcgccccgggagtgtggggcgcctggggcccctggtcggcctgctcgcgtagctgcagcggcggcgtgatggagcagacgcggccctgcctgccccgctcctaccgcctgcgcggcggccagcggcctggcgcccctgcgcgcgccttcgcggaccacgtggtgtcggcggtgcgcacgtcggtgccactgcaccggagccgcgacgagacgccagcgctggccggtacggacgccagc

SEQ ID NO: 224563 - DNA, 342 bp, Homo sapiens
ttcccccaagactcatgcagcatggaagccctgccctgggaaccagtgaacctggtaagaacttagcagagacaaccataaaattgtcccaagaaatacctccataagtcaagacacatgcaggaccccacagaatataagctccaccaaagatgatctcacagacaacaatgacaaaacaaatagtcttacaccagttctagtggtagttcttacataacagccttttattttattttgttttatttatttatttatttatttttgagacagagtttcgctcttgttgcccaggctggagtgcaatggcgtgatcacggttcactgcaacctccgcctccc

SEQ ID NO: 224564 - DNA, 317 bp, Homo sapiens
gacgacattctgagcctcccttacagtgaggtattgtcctgtgactaagctctagctaacaggatttgcatggaagtactgcattcaacttctggattgcacacttcaagggacagggagagttctccctgttgtttctgccttgctggctgaaacgcatccatggtggtgagacacctgggactccacaattaagggcagtacctcgtggagtgtgagaagcaatacacaagaagcctgggactctgaacactttgtggaacaaagccactacagcagctcagactttttcaagaagaaataaacttccattttta

SEQ ID NO: 224565 - DNA, 462 bp, Homo sapiens
tgacacaaagtcagtattaccaacacagacctgaactgaaaagagctatactgtagaagaaggacgctggacaggtcctgtggtcctagggagaggaatgtaagccactgctaaagcaagcccagcagggaggaagtcagaggaataattatcaaaaacctctttcttctgtcaccctcctttctccttctggtaccttccactggccaaactcagccataaatcaaagagcaagggatcattcagtctcttggagcagagtcaagtagagaaatgtggtaatgaatctggaagggcaaagagagaatatccaacatagaaacaatgggtccactgtatttcacaacaaaaaaagttactggcaacttttgtcagaccaattttagtggagtggtgggggcagaaaataaattgcaatgagaggagagaaggtagagctgttcttaaatttattaaaaaaaa

SEQ ID NO: 224566 - DNA, 349 bp, Homo sapiens
gttgagcctgggaggttgaggctgcagtgagctgtgatcgtgtcactgcactcctgcctgggcgacagagcaagacactgtgtcaaaaaaaaaattaatttgaacaatgcttgctaatgttttgaagtacattatctgtacattgtggaatggttaaatctagctaattaccaaatacattatctcacatagttatcatttttgtggtgagaatacttaatagctactgagtatttttcaagaatacagtatgttgttaactaatcaccatgctatacagtagtgctcttaaacttgttcctcctgactgtaattacgtatcctttgtctaacatcttcccaatcccca

SEQ ID NO: 224567 - DNA, 192 bp, Homo sapiens
cccccacccccacccccacggggccccgatttgttttttcctagggtggttaacatgagtttcacttgaaatcagagttacacctgggattatgacttggaattctttcttgttattacttttttttctttttcaagtaggttggctaattatatttacttgtggaaatgtggggactctatgctttttttg

SEQ ID NO: 224568 - DNA, 668 bp, Homo sapiens
actgagacaaaaaaccaggactatattcgtacatggaactgggatgtaacatcctacccatgacttaatttataagcattgtttattctctttggagcaaatgaaatgcttttccaagggacagctgcaaaggccaaggatttgaaaagaagaaaattatgataaacccctcttaatgcaggaaagattagatagcttgctaccagaaatcaagaaatatttataataatcacattcaaccctagactttcctctaagaatctaaacagaaaactttaatcctccagaatgtaaactgatgccatggctatatatggtcacagaaatcctaaggggaagaaaaagaaaagaagagggggagaaaaaataaacacccagttgctgtgtctcttaaattggtgtatgtgtgttctaccacagagatctgttaaccttggcaaaatttacaagtaagaagcattaatcaactttacacaagtacacgtgacactttcctttttaagtggaagccacaaactcctctccctttgggaaatctcactgtcatgctgaggatttttcttcatagataatactaccatggcaaacatcaaaaacaactggattccatattctgtgggcttgaccgccccatgaaggcaagcaatattaacttttcttgtggttga

SEQ ID NO: 224569 - DNA, 782 bp, Homo sapiens
actgagacaaaaaaccaggactatattcgtacatggaactgggatgtaacatcctacccatgacttaatttataagcattgtttattctctttggagcaaatgaaatgcttttccaagggacagctgcaaaggccaaggatttgaaaagaagaaaattatgataaacccctcttaatgcaggaaagattagatagcttgctaccagaaatcaagaaatatttataataatcacattcaaccctagactttcctctaagaatctaaacagaaaactttaatcctccagaatgtaaactgatgccatggctatatatggtcacagaaatcctaaggggaagaaaaagaaaagaagagggggagaaaaaataaacacccagttgctgtgtctcttaaattggtgtatgtgtgttctaccacagagatctgttaaccttggcaaaatttacaagtaagaagcattaatcaactttacacaagtacacgtgacactttcctttttaagtggaagccacaaactcctctccctttgggaaatctcactgtcatgctgaggatttttcttcatagataatactaccatggcaaacatcaaaaacaactggattccatattctgtgggcttgaccgccccatgaaggtcctctgccagggtcaatctcagcagaaacatgactcttcaaaaatagatcatcacagttgtgattaaatctcccatgttcaaaatttacagcctataattcaatgccgatatgaataatgacttaaataaaaagttacagtc

SEQ ID NO: 224570 - DNA, 565 bp, Homo sapiens
tccctcctccccaccccccattaatcatgagtcccttgaaggaacagattggggatccccacagtgtccagcatagaatgtcatgtatacaataggcatttaatatgtgtgtcttatacaaattaaacagtatggtagaagctcgtaatcttagtcttgctcagtcctaaggatctttcccttttcagtgtatggcagtgagggagatggtaagagggagactggcctaaagaggtttcacttcctttggcactagtataggcttaggaggtttgggtgttctccctaaatcagtgttctacagcccagaaacaaggtttctgaagttggcacttcagcgccataccatgtacgtttaggcagtgatgtgaatcagatgtggccagcaatgatggaaatgtcacaaagtggagagacagggaagtgagggtgggaatgtagtaacattaaataagagctaatgagtagaatgaactagagcaggaccaagactacagcttgggtacaatgggctgagcagtctatgtcaggaccctaaggctgggagtgccaggccctgagtgat

SEQ ID NO: 224571 - DNA, 1096 bp, Homo sapiens
gcatcttaactatgtctttttaagtctacataatggcactgacattgataaccttggtaaagacgtgattgcaaaattgttataacatttgtgtgatcagcaaggcacctgttattgagcaatgtggagaaacggtcagttgctgccatacactttccatatttttggaatacttaatacataaatcattattaggagaatgtgtgagaggatatttgtacttttgaaagtcaacataattcagtaaagaggtggtttctttgtcaatttatttggaatttatatcacctatcatttcattgtctgctttatataaataattatacccagagaacaaagtaaccaattaaccagagtcatgccagtgagtccaagccaacttggaagaacagtgctataatattgccatctcattggatcttgaccctgtgggaatctagttaacttccgtgaggaatagtccatactcatttccttttcatattatcatgtattgcttcccccattattataattgactgatttgcatagcacagtagtggctgaaatatcagaagatattctccctttgttgatgaaagtacgtattgcataaccttgtatcttttttcttttaaaatgtttgttgtgaaataatacaaaagtatattgtgtatgtatggtttaaaaaataacatgatcacacgtactcagccttcagcttaagaactagaacattctcagctgcctagaatcccccatttgttctccctccatagattatatgaggtaaacattcttctggattttttgttaataatttcccatgtttttatttgtgactctaccatctatgtatgtattcctagtaatatattgtttaaatttgtttttgaacttttatgtaaatggaatcatgctgtatgtattcttctgtgacctcttttttctgacattgtttttgagattcccatccatgtttatgcatgtaactgtatttcatgttttcacagctatatggtattcgattgtatgactatttcacaatttatttatccattcttctatttatggagatttggattgttttcagcattttgcaattacaaacaatgct

SEQ ID NO: 224572 - DNA, 511 bp, Homo sapiens
gtctgctttataccagaacatactaatttggaaacagtggttttcctgaatctgccttagtccactctgatatgaatagtcagcgtacagagtgtggaaaatgcaataaaaatgtgttcagactctcctgagaagaaataggctgtgatacagtttgggaggaaaagactatgttattgtttcaccagaagaaactaggttatcaaagaaatgaaagggaaatacaaaatttaaaaatatatgtatatttacgtaaaatttttatgtgacaaaaggctttcaaaaagcctcactgaaaggaaacaatgaaacctaaagaaatgatccattatgtagttctaataaaggttaaaccttttaaagtttgtcaggtccatacagtacgatctaaaaattgaggaactaccattctgaattagtttgaattatagaataagttgttgattttgttattcattactttcagatatttaatgtaatttaattaaatgctaataaagcattttgaagt

SEQ ID NO: 224573 - DNA, 581 bp, Homo sapiens
gcacgagcagagacggggtttcactctatcccccaggttggagtgcagtggcaggatcatggctcactacagccttgaccccttgacctcctgggctcaagttatcatcctgccttggcctccggaatagctgaaaccacaggtgcgagccatcatgcctggctattaaaaaaagaaaaaaattataaagacagagtctcattatgttgcccaggctgggcttcaactccttagctcaagcaatccgccagcctcagcctcccaaagtactgggattacaggcaggcgtgaaccaccatgcctgggcaacaaatatttcagcacaggtattaaaagcaaatatggtgaaatggtaacagctgtcaaacgtgggtagtgagtaaatccttcatcatcattcttctctccaatttggaaaagttttcataataaaaagtggtgaggtcgggagaaaggacagatggttagaggaagcacagttctactcaccattttcccaagactgaacttgacggagaggtggggacccgctgaggttgagaggaaagcttcagggaccagaggtttatgggagcaaagat

SEQ ID NO: 224574 - DNA, 236 bp, Homo sapiens
caagtagctgggattacaggtgtgagtcaccgtgcctggcctatgttattaatttttaaaaattcatttaaatatttaaaacttctgagttttaatctctaatatggtaaatattgatttgtaaaacttacataaaagattttcaggacctctggtttttaagatcacaaatgaatcctgaaaccaaaaagtttgagaactactgggcagactggatgtttccttgcctctgataa

SEQ ID NO: 224575 - DNA, 549 bp, Homo sapiens
tgccttgatgtactgcttatggataccatatgcttttatatatccattgtccagaatgggtcaccaggtatatttacattggtaggaacaaaaactcttctgcattatgtagatgttaacctaaccagtaaccagattaactatttaaggtggccaggctttgaaagattggaacaagcaggtgttggggtagtgccagaattgtcaaaaaacaaaaaacaaaaacaaaaaaaaaacagttaagggctagttgaggcaagatccactttgaaagggataccaatgtagaggaacagcatggagaacagagaggtgaatggtggggcagtataagaatacttgctttgtcaattaggatggcagctaagtctattgcatataagcatggaggaatgcctgatgctacttaacatgagaaaggtactgtgggacatatctaggttgacatgagaaatatgttatgggacaaaaagattgtcctaagatacccacaacaatcccatcattttcacagtaatataggtcaaaaagattgtccaagttgggtag

SEQ ID NO: 224576 - DNA, 389 bp, Homo sapiens
tgaaaacaagctggaggattaaagcaaaactatgctgttccccagagacccttatgtcttcaactgctctccatatatcttcttcccaacttcaacgtggggaagtgtataatcttacagcgaagatcatgttccagaccagcagcatcagcatcacccaagaacgtactacaaatgaagaatctccggcctgctgaatcagaaagtgcagcttcgatgagccccccgctgatttacttggggaagagaacttcttatctatctcgactgaacatggcattaaatctgttttcagaattacctgtcctagatttttctccatccttgttttctctggctatactcaaaacagaatcttcctcatcacttgtagcctgaatggaatttga

SEQ ID NO: 224577 - DNA, 311 bp, Homo sapiens
gagacaagatctcactctgttgcccaggctggagtgcagtggcacgatcctctagcctcgatctgctggactcaacgatcctctccacctcagcctctcaagtagctgggaccacaggcatgcgctactgtgctgggctgattttttaattttttagagatgttatcccactatgttgcttaagttggtcttgaattcctggactcaagtgttcctactgcctcagcctcccaaagtgttggaattacagatgtaagccaccgtgcccagctctgatttacgtgtatttctgtccccttctgtggtttttc

SEQ ID NO: 224578 - DNA, 1160 bp, Homo sapiens
tgatgactcactcctgtaatcccagcactttgggaggccgaggtgggcgaatcacttgaggtcaggagtttgacaccagcctgatgaacatggcaaaaccctgtctctactaaaaatacaaaattagcctggcatggtggtgcatgcctatgatcccagctactcgggaggctgaggcaggagaatcacttgaacctgggaggcggaggttgcagcgagctgagatggtgccactgcacgccagcctgggtgacagagcgagactccatctcagaaagaaaaaaaaaaaacaatttatttctatatcaattaccaagcttcagatctaaagggctttactgatacacatttttctattcaaggttcagtagaaagtgggacgtgactgaacacaggacacaggaatatacaatactttggaacttaggaacaagaaggatgactgaagctctattaactttcaagcaagagcaaatgtgattataattcagggtggttggagcagtgtgtggaaagatgctcagtgttccaaaacacaaaaatgggaaaagtaagggccaattccatttaacattcagcctaatacattttcaaaaactaattctgtgcttagaaactgccaactttcaaatggagatagctgaaacagcaaaaatattctttaacagtgatggttataatggaaatgctgacagatcattaaccacagcagtcctttagagaaaaaactgctgtaacgaaatcctgcagctaaaatttaatgaataccctaatcacatatttgctaatgcctctgaaatgtctaaatcggtcaaattaataaaaatcagtgctatctattaagtctgactattgagcctagggcctagccctctgactaccagctgttgtgaactacaggttgattttttaaatgcagggcatgtattctgattcttccatagtgaacagtaatggttctgttaacaggttcaaggtctactcttcttagagtgcttcttatgtgacaagcactgtagatataaaagttaagtccacgccttcaaggaacatgcctagtagggcagggaagcacacaaataagaacataagacaggagccttaccatacttgagtagagctggataccaggaaattggtgatgtgagaatgggcaaggg

SEQ ID NO: 224579 - DNA, 665 bp, Homo sapiens
tccctctccaatctgccagctgcagctgttcctgtcactcggcctagggccacaccctcaggagaaaaccgtgaggaggttataaagggctccccagcaggagctgccgcccgtgcctctgcactggggacctctgaccttccatatcactacagagatgtgtggctattccggtcgtccaccactcattccacgtagatggaggcttgcgatgcccagagtgctggggggagacttggggctcttttggttacaagtggcaggaacccaaaacagggctttcctggaagaagtctagactcattcactcaagggaaggaagagtggaacgtccagccctcaggaaggttaggcagagtagaagcacctgaacctatggcctaggcactcaactcagctgggacattgtctccctccaactctcacctctctgtgaggcttcattttctcctcctgcagactggcttcctccacacggtgggaagcaagactgccttgagctttccagcctctcacatcccggcatctatgccagagagggactctccaaagagaaggatccagagaaagccactgatgggccaacttgggtgaaatgatgctgttatagccatttgcaattctctccgtactcaccattgccccctaaccccaattttattcag

SEQ ID NO: 224580 - DNA, 668 bp, Homo sapiens
agtgaaaaaatggtatgttcagggtaactaagcagcagagtagaatcactggactacccgtatcagctgttagacacagcagcagtggcaggctttcagtctccacctgcaatgtggtgtcatgccagggctcagaagtcttgtcataccccattgtttgctgcactgcctcacttggacttggttagacttctagctttaaaaaatgatatcttgtctttaattggtttttgttgattcttttggccagttcccaagttttgaactgagaaggaaggctgggtttgttgtgcgtgtagacttttgacacaagtttgttctatgcaactctatcctttaagctctgtgtctacttttcttggttagtttacacttcgaaagcagtaatcgcttctctgagcaacatggcagactgaactggtgtagaggcccaccctatgccaaacacttggaaatgctgactaaatataatgacatagtttatgtatggcaaagcttgaaatcacaaagaaggctattaacatgtcacttgcctggtaaaagcatgagggaaaaaaggataaggagtttttaaaaattgaatacttatcctcatttctaaagatggctctttttttttttttttaaggaaaaggtggacaacatatatctgatatgggggaagaaag

SEQ ID NO: 224581 - DNA, 488 bp, Homo sapiens
agatttgtctcaatgagtactgcctaaaatttgtttccagagaaaattttagcaacttttacattttaccattaatacacttaaaggggataactgcagagtagaatggattactttgaaagaagtccctataactggaggttttgcacacttcccaggcattttgtggaagggtcacaagtattagttcacagttggaatagaaagtgatttgcatgaatggaaaggagctgtgggaattataatctttatgttgtttttatatatttgtactattttgtgcctgggtatgttaagcatgtcattgtgacattttccttgaagattatgtttggtctaggcaaattcctgattattaaaaaactatattaggataataatcacttgtagtttacaagctattatccccagtctcttaatcccttattttggcagtacatatttgattaagagatagctaagtattatgttcctaattgcttaagtag

SEQ ID NO: 224582 - DNA, 470 bp, Homo sapiens
cagagaaaaaatgcacttaaataactcactgaaacaaatggatgtagcagatgtgtacagaacattctgtccaagatctgcagaataaacattcttgtaatcagtacatgcaacattctacaagatagaacatataataggtcacaaaacaagtctcaatgaatttttaaaacagtgaaatcatatcaagtatcttctcagaccacaggagaataaaactaaaaatgaactctcaaagaaacccttacaactgaacaaatacatagaaattaagaaatctgctcctgagtaatatctgggttaacaatggcataagatgaaaatttaaaaattaccttaattaaatggtaacaagttattgaaaccttaagaatacagcaaaagcagtggtaagaggaaagtttatagtgactactgcctacgtgaaaaagccggaaagagcacaagttgtcaacctaatgttgacacga

SEQ ID NO: 224583 - DNA, 2106 bp, Homo sapiens
cttacctcagcaaccctggcacctccaacccgacacatgctactgctgctgctactgctgccacccctgctctgtgggagagtgggggctaaggaacagaaggattacctgctgacaatgcagaagtccgtgacggtgcaggagggcctgtgtgtctctgtgctttgctccttctcctacccccaaaatggctggactgcctccgatccagttcatggctactggttccgggcaggggaccatgtaagccggaacattccagtggccacaaacaacccagctcgagcagtgcaggaggagactcgggaccgattccacctccttggggacccacagaacaaggattgtaccctgagcatcagagacaccagagagagtgatgcagggacatacgtcttttgtgtagagagaggaaatatgaaatggaattataaatatgaccagctctctgtgaatgtgacagcgtcccaggacctactgtcaagatacaggctggaggtgccagagtcggtgactgtgcaggagggtctgtgtgtctctgtgccctgcagtgtcctttacccccattacaactggactgcctctagccctgtttatggatcctggttcaaggaaggggccgatataccatgggatattccagtggccacaaacaccccaagtggaaaagtgcaagaggatacccacggtcgattcctcctccttggggacccacagaccaacaactgctccctgagcatcagagatgccaggaagggggattcagggaagtactacttccaggtggagagaggaagcaggaaatggaactacatatatgacaagctctctgtgcatgtgacagccctgactcacatgcccaccttctccatcccggggaccctggagtctggccaccccaggaacctgacctgctctgtgccctgggcctgtgaacaggggacgccccccacgatcacctggatgggggcctccgtgtcctccctggaccccactatcactcgctcctcgatgctcagcctcatcccacagccccaggaccatggcaccagcctcacctgtcaggtgaccttgcctggggccggcgtgaccatgaccagggctgtccgactcaacatatcctatcctcctcagaacttgaccatgactgtcttccaaggagatggcacagcatccacaaccttgaggaatggctcggccctttcagtcctggagggccagtccctgcaccttgtctgtgctgtcgacagcaatccccctgccaggctgagctggacctgggggagcctgaccctgagcccctcacagtcctcgaaccttggggtgctggagctgcctcgagtgcatgtgaaggatgaaggggaattcacctgccgagctcagaaccctctaggctcccagcacatttccctgagcctctccctgcaaaacgagtacacaggcaaaatgaggcctatatcaggagtgacgctaggggcattcgggggagctggagccacagccctggtcttcctgtacttctgcatcatcttcgttgtagtgaggtcctgcaggaagaaatcggcaaggccagcagtgggcgtgggggatacaggcatggaggacgcaaacgctgtcaggggctcagcctctcagggacccctgattgaatccccggcagatgacagccccccacaccatgctccgccagccctggccaccccctccccagaggaaggagagatccagtatgcatccctcagcttccacaaagcgaggcctcagtacccacaggaacaggaggccatcggctatgagtactccgagatcaacatccccaagtgagaaactgcagagactcaggcctgtttgagggctcacgacccctgcagcaaagaagcccgagactgattcctttagaattaacagccctccatgctgtgcaacaggacatcagaacttattcctcttgtcaaactgaaaatgcgtgcctgatgaccaaactctccctttctccatccaatcggtccacactccccgcccccggcctctggtacccaccattctcttctctacttctctgaggtcgactattttaggttccaaatatagtgagatcgtagagtg

SEQ ID NO: 224584 - DNA, 332 bp, Homo sapiens
tagttctggaggccagaagtccaaggtcagggtgtcagcaggcaggttccatctggggctgtgggaggatctgcttcaggcctctctccttggcttgtaggtagctgtggtctccctgggtcttcacctcatcttccctgtgtaagggtctgtgcccagatttcctcattttataaggacaacaatcatatgggtgctaggggctcggatttcaacatatgaattttggggttggatacagtcagcccccaacccttgttatcaatcgttcagtgagccatgattgcaccactgcactccagcttgggcaatagaacgagattacatcacta

SEQ ID NO: 224585 - DNA, 198 bp, Homo sapiens
ataaaatgaatggaaattaaattgttatggtcacacaacgtcataatgcgttacaggcaaagctgttgaccacttagaggtagtattcattgagaaacattcttagactgtcagattgcttgatttagtgtaaagtaatttttttttttttgagacaagggtgtttcactcttgtttcccgtgctggagtgcagtggc

SEQ ID NO: 224586 - DNA, 475 bp, Homo sapiens
gagggttcttgaactagctctacataggaaactgccaacaataacttcctgtggcatttgttaagttgtgattctgcccctcactgcttgacttagtcctcttgacaagggccaggaggagaaaacaggtctcaaagaacagtgtacatcaaagcctggctttccagcaatgcctgaccctgccaaagaaggcagggaagcccccacagagcctcttagaaacctcaactccctcagcctcttgtcccagagcatcactggcaggtatagaccaagcatatccacatccacacgtacgtcttttttgcttttattcattttagtttataacaactatttatttaggacgtggttctgtgagctgttaaattgttctattgtcagatcatagctgtatacatttgtggggtgtcaaaacgatgttttaacatatacatacaatcagtgtgattaaatcaagctaattaacacatcc

SEQ ID NO: 224587 - DNA, 685 bp, Homo sapiens
aattaaatttttgtctctgagtcatttagtaattaagttagtcatggtacccccttctcttagatactttaattggcgatactctgggggtattgcaacaacaaaactgatgatcagaattagtttaacaacataaatattcttaatgaggatatcttctgaattatcataataaagtagtgtttatgtttttctgttacataaaaaaatcgaggactttctttggtaagttatacttcataccagttttagtcatttagcacattagagagtaccagtgagctatacattatgtagactatagatatgttaaaaagtacattctattcatgataaaactaataaactaggaatagaaggaaacttgctccatctgataacatctatgaaaaaacccggagctaatacatagttaatggcaaaatattggatgctttctgcctaatattaggagcaacataagggtgtcctctgctgccacttttttttaacattgtactagagtttctagccagagcaattaggcaggaaaagaagtaaaaggcatcagagtgataaggaagaagtatagctatctctatttgcagatatttatagaaacatcctaagaaatttgctaaaaatctattagagttaataaatgagttcagcaaagttgaactcattttatgtaggctcaatgtat

SEQ ID NO: 224588 - DNA, 329 bp, Homo sapiens
acatctctatagatacataaaatattttttaaaaatccaacatttagtcatgataaaaatttttgaacaaacctaggtatagttgagatccttctacctgataaagtgcatttacaaaaaaatcatctggcaacatacttaatggtatgaggaagcaagcaaggatgtctgctatcactgctactgtttaacatcatactgcaggtgctagccagtgcagtaggcacagaaatcaatgcatgcagattggaaagggtattattcctgtaatatttttactgtacacagataacatgcttatctacgtagaaaaatccaaagaaaataca

SEQ ID NO: 224589 - DNA, 452 bp, Homo sapiens
tggggtgaggagggggaggggacgcgggagagggggcctaacctacctcagggctggggaggtgcacccaccgggaccggacctctgaccctgaagcaaacttgccctcccatcccctcttcggtggaccacccagtgaggtcagctctgcaggggccacagggtggtcttaccccagccgttcgcctaatggtgtgagaactcactgtagtcacaaagcggggtctctactttcagcttgaggagcacataaagggctgctagagtgggcacctctcccctgggctgcgggagctgaccgtggggcccgatcccagagggttgcggtcctcccaccccagcctgtccttcagccctgctgccactgccttgtccatgcagggcaccagggccctccgaccctcacccaatcctggaggctgctggactaagcagctggagacactcccctt

SEQ ID NO: 224590 - DNA, 476 bp, Homo sapiens
acagagaaggtacagaataaaaggaaatgcaaatacaatttttagctaaggaagctatagttcatgtgacttcactccttaagctgaaaaccaaaccacccaccctcttagacatcagggaactatagaatttgctgctactactgctgctgctgctacaagcctgcaaggggtgtgcaaaagagagtagataagggctccaacagaacccctgccatggtctatggtccttcctgccacgtcctacaggagcccaggagctctggctatgcctgtcaacccggccatgcaggtgactgaaacaacagcctgccatgatgtaagtggtcctggctaaaaggggctggagagagggctttagagaagcatgttgggttcaaaagcctagagtgctgaacaagtcacagcaaacaaataaaaccctaaaacccaggaccaactgaagggggatctatcccccagccaccactccaaaa

SEQ ID NO: 224591 - DNA, 438 bp, Homo sapiens
tctccagctcaagtgatcctcccacctcagcctcctgattagccaccatgcttggctaatttttaaattttttgtagagacagggtcgcactatgttgcttaggctggtcttaactcctgggttcaaacagtcctcccaccttagcctcccaaagtgttgggattacaggggtgagtcaccatacctggctctcattaaaattttatgctactttttctgattttgcagtgaggctaaatattttttgcattcagtctgaagattcatctaaattacattagttttcagtagttatgcatagtatcacgatgatgttgatctccgtagcactcccctcctttgagatttgcagtataattttaagacatatataagaataattgagtgtggtaaactcaccatgtcaaatgcaataaatcattttccaatcctgttca

SEQ ID NO: 224592 - DNA, 528 bp, Homo sapiens
tgtggttctgcccctcaccttcccaaaaagaatcatttactaataattgtcctcattgggcctattcattcccccattatcttctcccctatgaagggggcatttatgtctcaaccatctggcctctctttgagttcagattttgtatgactctcatgcatacatgtgcatgtaataaatttgttatgcttttctcttgttgacctgttttttattatagggatgtaggccataacactttatgatggggaggaaagggatcaccccctttctgccctacatcagtttacaatctgtttggcagagatagaatcctcagaaagcaagatagaagcatagaagatgaagtaaccagacgccaccctgcctcctccagtgaatgcagctacaaaaactgaaaagggctgggctcaatggctcctgcctgtaatcccatcactttgggaggctgaggcacaaggattgcttgaggccaggagtttgacaccagcctgggcaacatagggagaccccacaactacaaaacaa

SEQ ID NO: 224593 - DNA, 394 bp, Homo sapiens
gtacttatctcaagttggaagcaccaggctccagtatttccttcaagctagaaccacagaaatgactcttaataagatgaggtatcttctataggagggcattgcggagctggactgagagggggaagactgcccagcaagaagcccctgtgcccataaacccagttccatgtacaaccaaatggaaagttttccttgcttcatgcagtctctcacatgctaaagagattgctttggttggaactgaagttgtagagagtttaattttgtaaatgctcagaaatcatgttataaagttaaaacattttttaaaacgtaaaggttaaccacaaatagcatagaaataaaatgtcaaattttatgagaaatataattttgtaaaaaggaattttga

SEQ ID NO: 224594 - DNA, 184 bp, Homo sapiens
gggcatgctcacagcctcgggggtctgtctggcatctgccaaactgctttaggtaaaaagccaattgtaacaactccaaaacgtctcaccaccattagaagcaaattgagaattaaaatttagaaaggccacttgaggaaagttgtattatcttatttcagtttagtgtggagtttttatatgg

SEQ ID NO: 224595 - DNA, 692 bp, Homo sapiens
actggtcataccctgtggggaatatctccttccttattctgagaagatcactcaaagaaatggttctgcctataaagttgttgactgagtacttataatcatgaaaagctggaaactacattttcaacagaaaatagttaaatatattttgatagaatattaacaatctatcaaaaaaggataaatgtgaaaattttgtagcagcacagaaacaaaatctgaaataatctcatggcaagtcaataaagcagaacccaaggttttgtattaactgattgtgaaaatatgtatgctggcttgggtaaaatccagcagggaggttggaaaaataaaaaatgttcaatctacgtggtaagaactgttgctaactttttccttttatatttcttttaaatttgcttcaacagtatatttttctgactgttcaagatctgagcaccagccagcactgtggctcaaatctgtaatcccagcactttgggagaccaaggcaagaggactgcttgaggccaggagtttgagagcctgggcaacatagtgaaatcccatctctacaaaaacatgtaaaagttagccaggtaggctgggcacagtggctcacacctgtaatcccagcactgtgggaggccaaggtgggcagataacttaaagtcaggaattcgagaccagcctggccaacatggtgaaacccc

SEQ ID NO: 224596 - DNA, 4868 bp, Homo sapiens
  misc_feature (2296)..(2296): n is a, c, g, or t
  misc_feature (2299)..(2299): n is a, c, g, or t
  misc_feature (2321)..(2321): n is a, c, g, or t
  misc_feature (2325)..(2325): n is a, c, g, or t
  misc_feature (2776)..(2776): n is a, c, g, or t
  misc_feature (2781)..(2781): n is a, c, g, or t
  misc_feature (2786)..(2786): n is a, c, g, or t
  misc_feature (2793)..(2793): n is a, c, g, or t
  misc_feature (2825)..(2825): n is a, c, g, or t
gctgccgcggggagggcgccatcttggccccgcggagcgtgactgtctcggctggaagcgtgggaggccggaggatcagtgactggctgtcgtggacatgctcgctacacctcccggggcttcgcttcgtttactattaactgtcgttactcctctgtatctcgtcagcaggggctgcctgcggtgttagaattacacgcccctgccacctgggcacggagcccagtctcccggcccctcagtcagtccttgggtgtagctggagcatttaagaaaaatgaaatataggaactcagtgcatggtttcctgggcctttttattgaatatcatttctaacatgtacacagtataacccaggcttagtggattccgggacagaaaatgttgggagctgggatagtcaagtaaacaagaagaaatggtaaagagatgccaagtgggagaggaaactacggatgcagagagaggatctgggataaagagaacaaagatgcgtggtcgactttatggaaactcgtttctttttaataagtgaggtacatggtagaagactttgacatgttgattatgtgactgggaccaaggacaacaactcgagaattgattaaaactacagttattccttggttgccccaaggatgatcctggtacaatatggctatttccttttcactggtaatccttatttactcttgaaagggtaaaaatccgtgtcttgtacatatttggagtttcacaataccttcacatagtaatctatgtgagaattattttaaacattttggagaccaaaaaggggaaagagaaagagacggaaaattactaattacactaattgtattttacccccaagaacgccattaccagcggttaacattagttccaggagtccaaacatagttttcaagataaaaccccttacactataatcattagaaaccaaaaattataataattcaccaacatccagcatactcatttaggaagggttgaagaatctgtgtaaatagagttgtttgataacagttataaaaatatccctttacccatcttcaccctccatcccgaattcaaaactagtaacagttgggataaaggtatagaaaagaatcagttttgcaagtgtagagaatggagaaagcaagaaaccgctctcatgttttcattctgaaaagatatcactaaattctctacaacccctcaattggtgttagggtatatggtcagtagaatcaagaaataacccaatcagctgagatcaccatgattctcagacttgaggaaggattgcctctcaaaaatgaagggctaaagacaggaatagagtggcacaattcttaatagttgtgtgctgtatgagttttttttaaggatgagtcaaaagatcttaagatttgtgatgtaaaagattggacacgatttaaatatgtattaaatgtctgtagtagtgttttttataattgtctggtcatctaccagtgcacaacaaaccataacaaatttcgtggcttagagcataactccagaagtgtagctcagcgttgctgcctgggtctgggatctgaaggcttgttcactctatgtctggcagttgatgttggctgttgactgggaactcagctggaacatctatatgtggcctctccatgtggctgtttggcttccccacagcctggcagctatgctccaaaagtgagcatcccaagagagacaagagtcccaagaggacaaggcagaagctgcactgacgtttttttttctctctttctttttaggttagccaagtgaagcagtgggagtggagaaggaacaaagaaatctgtaaagtagttgtgatcaattagttgtaaacaccactgcactcagactcagaccagcttgcattgatttttatgacctaatctcagaggttgtacagcgtcacttccactgtactctacttgttgaagcagctacaaaaacaccacatttaagtaaaggggacactaattgggaggagtgttagtcacattataagaagagcatgtggaatgagagattaagtagagatattattgcagtcatttaaggaaaatataatctcccataatattaatatctgttttccttttgtaaaaaaaaaatgtaccatttcaggctgagcatgttggctcatgcctgtaatcataacattttgggaggctgaggccagtggatcacctgaggtcaggaattcgagaccagcctggccaacatggcgaaacctcgtctctgttaaaaatacaaaaattagccgggtgtggtggcagtcacctntantcccagctactcggaaggctgnggcnggagaatcgcttgaacccaggggcggaggttgcagggagctggtaccaccactgcactccagcctggatgacagagtgaaactctgtctcaaaaaaacaaaacaaaacaaaaactaaaatgtaccatttcagattttttttctgaaattaaacctgaaaaggtcaaaaaacacataaattacagtccctttcaattacttaccaggtacaggtattgtttaagtctatagaagttcagactatagtagttcaaaataccttatacagggcagcttataaaaagcagaagtttatttctcatagttctgaagactgggaagtccgggttcaaggttctggcagattcagtgcctgtcgagggactgctttttggttcacagatagtgtcttctagctgtctcctcatgtggtagaagggtgccttttttattagtacccctagttttatttnttttnttttnttttttngagacaggggttttactatgttgcccaggctngcctcaaactcctgggcttgagcgatcctcccacctcagcctcccaagtagttgggactacaggcacatgttaaaacacctggttcctattagtggttattttataaaggcactaatctcatctgtggcaccagagccctcatgacctaattacctcccaaagatcccatcccctaataccatcatattggtgatgaggtttcaatacatgaatttggggggctggggacacaaacattcagaccacagtagttgttacattgatatgagctggtaagtgttaacacctggcagcaatcagatacccagccataggtgaaggcaggtgattagaattaccagccaacacatttatgtgctagctaatttttattcaaaactttctgaagctacattcaaagcagttaatgggaaatggagtaaaaaaataggcaacctctcactctagataatgctgttaaaagtaatttttcctcccagtcctctcctgtaatgaatagtataagaaggtatcctcccaacgtagaggcaccttgtgtttccaaagttttaattagttgtcatgataattttatgtgtcaacttgactgggttaagggatgcccaaataggtagtaaaacattatttctgggtgtatctgtgaaggtgtttctggataaaattaacatttgaatgggtagactgagtagagcagactgtcctcccccatgtgggtggcccttatccaaatggttgaaggctaaaatagaacaaaaaagctgagtagaggggattccctctgcctgactaccttcgaactggggcggtggctgtttcctgcctttggacttgaactgaaacatcagctcttcctgagtcttgagcctcctggcttttgaactgaaacaacagtaatggctctcctggttctcaggcatttggactttgactagaactacaccatcagttctcctgggtctccagcttgccaatctccagtttgccaactgcggatcttgggacttgtcagcctccataactccatgaaccaattttttgtaataaatctctttctatatgtctatttattctgttggttctgtttctctggagaaccctaatgccatacataatttttaaaaaaaaaaaaactctttccttctctgtttttctcttatacttttgtgagtgtagtgataggccaaatcacataagtgctaataaatacttttccaacaagtacttaaccttgtttaggtgataatcacttgtcttacctttgtgttcagaagaattcccaattccaactttcttaggtatttattgaaaagcaggaggagggttcggtggagggaagaagagatggaataggatttaggatcattgcaaagaccgaggtagttggggaacataaaggttttatgttgcctttcttcttcctccttatcattgaaggtctcctcctccctcctgctccccatcacacaccctcacatgcccccatgtggcctcttactaaacagggagagaagagaagagctggagaaatggaagtattttgtattggtaagcccaagcagcagcatgctgagaaaagaggagtttttatggcccctggctacccatctggaataaacagttctatttccaaatggctatttctatgccaatgtaaaaagacatagataatgcagattattgtgtagacattactaatattcaacaatatctcgttttcctcttcttccaggcatactgaagactatatttctcagctgcctttgcaggtgggcagggtcatgtgactattatgactaataaaatgtgagcaaaagtgacgagtcacttgtgggctgaggcagtgaaaagttgtttgtgattctcaaatctctcttctgttctgccattgcaattgtggaaggagctttatgttgaaacggaagagccaaaagattgaagtagtctatgtctcagtcaccatatgggagggcaaatgccctggagaaccacccagacacacaacaagtttgtatgaataagaaataaaactttgttgtataagt

SEQ ID NO: 224597 - DNA, 3629 bp, Homo sapiens
  misc_feature (1057)..(1057): n is a, c, g, or t
  misc_feature (1060)..(1060): n is a, c, g, or t
  misc_feature (1082)..(1082): n is a, c, g, or t
  misc_feature (1086)..(1086): n is a, c, g, or t
  misc_feature (1537)..(1537): n is a, c, g, or t
  misc_feature (1542)..(1542): n is a, c, g, or t
  misc_feature (1547)..(1547): n is a, c, g, or t
  misc_feature (1554)..(1554): n is a, c, g, or t
  misc_feature (1586)..(1586): n is a, c, g, or t
gctgccgcggggagggcgccatcttggccccgcggagcgtgactgtctcggctggaagcgtgggaggccggaggatcagtgactggctgtcgtggacatgctcgctacacctcccggggcttcgcttcgtttactattaactgtcgttactcctctgtatctcgtcagcaggggctgcctgcggtgttagaattacacgcccctgccacctgggcacggagcccagtctcccggcccctcagtcagtccttgggtgtagctggagcatttaagaaaaatgaaatataggaactcagtgcatggtttcctgggcctttttattgaatatcatttctaacatgtacacagtataacccaggcttagtggattccgggacagaaaatgttgggagctgggatagtcaagtaaacaagaagaaatggtaaagagatgccaagtgggagaggaaactacggatgcagagagaggatctgggataaagagaacaaagatgcgtggtcgactttatggaaactcgtttctttttaataagtgaggttagccaagtgaagcagtgggagtggagaaggaacaaagaaatctgtaaagtagttgtgatcaattagttgtaaacaccactgcactcagactcagaccagcttgcattgatttttatgacctaatctcagaggttgtacagcgtcacttccactgtactctacttgttgaagcagctacaaaaacaccacatttaagtaaaggggacactaattgggaggagtgttagtcacattataagaagagcatgtggaatgagagattaagtagagatattattgcagtcatttaaggaaaatataatctcccataatattaatatctgttttccttttgtaaaaaaaaaatgtaccatttcaggctgagcatgttggctcatgcctgtaatcataacattttgggaggctgaggccagtggatcacctgaggtcaggaattcgagaccagcctggccaacatggcgaaacctcgtctctgttaaaaatacaaaaattagccgggtgtggtggcagtcacctntantcccagctactcggaaggctgnggcnggagaatcgcttgaacccaggggcggaggttgcagggagctggtaccaccactgcactccagcctggatgacagagtgaaactctgtctcaaaaaaacaaaacaaaacaaaaactaaaatgtaccatttcagattttttttctgaaattaaacctgaaaaggtcaaaaaacacataaattacagtccctttcaattacttaccaggtacaggtattgtttaagtctatagaagttcagactatagtagttcaaaataccttatacagggcagcttataaaaagcagaagtttatttctcatagttctgaagactgggaagtccgggttcaaggttctggcagattcagtgcctgtcgagggactgctttttggttcacagatagtgtcttctagctgtctcctcatgtggtagaagggtgccttttttattagtacccctagttttatttnttttnttttnttttttngagacaggggttttactatgttgcccaggctngcctcaaactcctgggcttgagcgatcctcccacctcagcctcccaagtagttgggactacaggcacatgttaaaacacctggttcctattagtggttattttataaaggcactaatctcatctgtggcaccagagccctcatgacctaattacctcccaaagatcccatcccctaataccatcatattggtgatgaggtttcaatacatgaatttggggggctggggacacaaacattcagaccacagtagttgttacattgatatgagctggtaagtgttaacacctggcagcaatcagatacccagccataggtgaaggcaggtgattagaattaccagccaacacatttatgtgctagctaatttttattcaaaactttctgaagctacattcaaagcagttaatgggaaatggagtaaaaaaataggcaacctctcactctagataatgctgttaaaagtaatttttcctcccagtcctctcctgtaatgaatagtataagaaggtatcctcccaacgtagaggcaccttgtgtttccaaagttttaattagttgtcatgataattttatgtgtcaacttgactgggttaagggatgcccaaataggtagtaaaacattatttctgggtgtatctgtgaaggtgtttctggataaaattaacatttgaatgggtagactgagtagagcagactgtcctcccccatgtgggtggcccttatccaaatggttgaaggctaaaatagaacaaaaaagctgagtagaggggattccctctgcctgactaccttcgaactggggcggtggctgtttcctgcctttggacttgaactgaaacatcagctcttcctgagtcttgagcctcctggcttttgaactgaaacaacagtaatggctctcctggttctcaggcatttggactttgactagaactacaccatcagttctcctgggtctccagcttgccaatctccagtttgccaactgcggatcttgggacttgtcagcctccataactccatgaaccaattttttgtaataaatctctttctatatgtctatttattctgttggttctgtttctctggagaaccctaatgccatacataatttttaaaaaaaaaaaaactctttccttctctgtttttctcttatacttttgtgagtgtagtgataggccaaatcacataagtgctaataaatacttttccaacaagtacttaaccttgtttaggtgataatcacttgtcttacctttgtgttcagaagaattcccaattccaactttcttaggtatttattgaaaagcaggaggagggttcggtggagggaagaagagatggaataggatttaggatcattgcaaagaccgaggtagttggggaacataaaggttttatgttgcctttcttcttcctccttatcattgaaggtctcctcctccctcctgctccccatcacacaccctcacatgcccccatgtggcctcttactaaacagggagagaagagaagagctggagaaatggaagtattttgtattggtaagcccaagcagcagcatgctgagaaaagaggagtttttatggcccctggctacccatctggaataaacagttctatttccaaatggctatttctatgccaatgtaaaaagacatagataatgcagattattgtgtagacattactaatattcaacaatatctcgttttcctcttcttccaggcatactgaagactatatttctcagctgcctttgcaggtgggcagggtcatgtgactattatgactaataaaatgtgagcaaaagtgacgagtcacttgtgggctgaggcagtgaaaagttgtttgtgattctcaaatctctcttctgttctgccattgcaattgtggaaggagctttatgttgaaacggaagagccaaaagattgaagtagtctatgtctcagtcaccatatgggagggcaaatgccctggagaaccacccagacacacaacaagtttgtatgaataagaaataaaactttgttgtataagt

SEQ ID NO: 224598 - DNA, 330 bp, Homo sapiens
atcggtttatttcaaaggatgttttattttattttctcctcagacatactttatcatcccttaaagtcagtagctcaaaggaaactttaaaagctataaataggccgggcacggtggctcacgcctgtaatcccagcactttgggaggtcgaggaggcagcagtcgcagccggcctgcagagtgagatgcagtgccagagggcttcaggaggaggtggcattgtgattgatgtctgaagagtgtctccatgataatggagtcagtgcaaagtcccaaagactgggaaggagcaagaggaaaggatagctcatatccagctgccccactcc

SEQ ID NO: 224599 - DNA, 522 bp, Homo sapiens
actttgtgaacatactaaaaagccactctgtcatactctataacgtggtgaattttgtggtaaatgaattatacctcaattttaaaaagttatattcagggtaacacaacagaataaggaacatctacaacatatcattaacaatccctggatacaatcccaaataactaggcatactagtaaaccagaaaaagtgacctttactcagaagacaagcaatagctgttgagcctcagagcataccagatggtaaatgaccaaaaaaaggattttaaaactgcagttataactatgcccaaagagctaaaggggaagacaaagtttataataaataaccaaatagaaaatctcaatagaaaacaatatttaaaaaaaaacaaaaacaataacaaaaaatggaaatatgagaccaacttatataataaaaaattcactggatgtgtttagtgacggattgaggtgacagaagagtcaatgaacttgaagttcatagaatagaaaatattcaaccttaaatacacg

SEQ ID NO: 224600 - DNA, 1305 bp, Homo sapiens
gtagagagataggtgatgcaggagggaaagctggattggaaaagggagagttttgtagacgggctacgctcattgtgcctttgaaagagcagagccggcagcctctagtcatcatttggatatacaggactagagcatgaatctgatgtagagctacagaatgaagagcaacagcagctgtttaaataccaagaaagtgtgtagaatgaaattggacaagccaagcatggtggtttcatgcctttagtcctagctacttcggaggctgaggtgggggaattacttgagctcagcagtttgagttcagcctgggccagatggtgagaccctgtatcttaagaaaagaaaaaataagaccaggtgcagtatctcatgcctgtaatcccagcactttgggaggccaagttgagaggactgctcgagtgtaggacttcaagaccagactgggcaataaagtgagacccatttctaccaaaaaaaaatcaagaaattagctggacatggtggcacatgcctgtggcctcagttacatggcatggcaggctgaggcaggaagatcacttgagcccaggaggtggaggctgcagtgacccatattcatgccactgcactccagcctgggcaacagagtgagaccctctctcaaaaacagataaagtggacagaaaataggtcagtaaggactaatcatttaagggacaagcccccagaagagtggctactagagtgggaggaggaaaagcagaaggagaaagagttgaagataggcgaggctgtggtcccagtgctgaattctgccaagcagtgacttgattcatgaacactcactggatgctgactctgtttctcttctgagtgctggggtagaggagaggagaggtggagcacagttcttgcttttatgagcttatgttctaggaagttcaagtattttttcaggtagtatgaaatagcaggaagaggaagcaggctaaagggacacagagtgattgggggctattttaagtagaatgataaggaagagcctgtctagagagctatttgaacagtgacctgactgaagggacaacagaaagcagtgctgacattacaggtagcaggatgactgccaagacagaaacgcatttcatatgtgtttgaggaacaaacagcaaggtgaccagcatggggagagtgaagaatgagggaaaccttgaatgagaataaagcaattccatcttggatgctaatctgccatattctgattaatcccagttccaacaattcatctacgatttctattttatctttttaaaaaaattattt

SEQ ID NO: 224601 - DNA, 365 bp, Homo sapiens
ccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattca

SEQ ID NO: 224602 - DNA, 412 bp, Homo sapiens
cttgcccctgaagcaacatcaaatactttcatgttattcttgggggcgttttaattcttccgatcctctgaattcgtgtttttgtacatctctttccaacctgggcctacacactaacagaaatagttttttacatcgaaggacaatgcttagtgttttattcagtctcaactcttttctttcttttttctcgttgtgtttcaaaatgtttattttttctgtcttgtgatagttttggaggaaaaatattgaaataattcaaatcaggctcttaactctgctttattaaatttatagtcatagtagcctgtgagtatgcttcgggggaggaaaaaagaatgctggggtctttattcttcaagttctctaagtttgatattttgaataaacacccagaggtgtctctgccttt

SEQ ID NO: 224603 - DNA, 533 bp, Homo sapiens
caagcaagtagaatgatcagctacaggtatgaaaaggttgtaaccagaggtagctacaagtcaggtgtgtaaaagaagaaggctttactatctgttatttcaaagtactgaaacctatagatcccaaaacaaatcatcactttcattgcttatcaggcagcctcttatgagaagctgcttctaaccctgttttctcctggtgaccttggtacgttttgccatgagtgattcctgggccagtagttcacactgagtgtctttccaggtgccttacttgagagcctcgccttccgtcttgcacagccacccacagacacattgctgctcactggcaggactggtcctgtcgctccctgtgccatccccagtccttctttaaagggaaaattaaattctctctccctcataccacagtaatagaataggtctcagaatatatctttagttagtgcatatatgtgtaggcgtgttttcttttgttaatttcagagatttttttcccattagtaatatcagtcatgttttcatgaaaa

SEQ ID NO: 224604 - DNA, 460 bp, Homo sapiens
aaaacaagaataatatggcttttgtttttggctagaaggtcagagtttcttcctttttttttttttaaatgctggcctattttatacaggctcttgaatgattattttcttttctcctaggcaatctggattaattgatacagtaaaaggtctggaagtcctaaaatgttaggtcaattcctaactccgacacaaagaagctaaacaacctgcaagagaatatgtaaaaaaaccaaccacaattttcctatctgcaaaataaaggaggggtgccactgggcaacattttaaaaaccttgtgttccttatgctaattattcaccctttggcattccagatcatgcctcttgacatcagtagcttgattgccaatgggatgatgctactggtttcacttttaaatatgggtttcaaaagtttcagttttcatagtcttcagagaaacagaatattgaatgtg

SEQ ID NO: 224605 - DNA, 413 bp, Homo sapiens
caaaacatgactagcatattttgagcattcatgtagacctgttaaatgaacacatggaataatctcaaatgcctgctaagtattttatctcaatttcatcttgttatattaaaacctgtggtcagctgtggtggctcacgcctgtaatcccagctatctgggaggccaaggcgagaggatcaagaggttaggagattgagactatcctgactaacacggtgaaaccccgtctttactaaaaatacacacacaaaaaaatttagctgggcatggtggcaggcgcctgtagtgccagctactcaggagactgaggccggagaatgacatgaacccgggaggtagaggtgcagtgagctgagctcatgccactgcactgcagcctgggcaaccatgcgagactctgcctcaaaaac

SEQ ID NO: 224606 - DNA, 364 bp, Homo sapiens
gctgtgtattacaggcgtgagggcacgcccggcctgtggatgttttgatctgtgttctgttgtgtacagtgtaagccatttgtaggctgatttctttcctagttcttcctcttagtgaaaagtaaagcagtttagatcatgttgaatgataaactgaaatttagaaatgcaaacatagaatacaatgtcagaatatcaccaggtgccattttggttgatattttataaatagggagatatttttctgtttactctccatagggattttgacactttccacccacccctttttccttttgtcaccttggtatattctgccagaaaactgacatcagaatgtcattgcttctgatcgattttattt

SEQ ID NO: 224607 - DNA, 429 bp, Homo sapiens
gtaggaggggcaagctgtttcaaatgtccttcccctacaagtggtcgtatcaagtgaacatgagagaacattgactgtaagaagttcttgcattattacaaaaaaaaaaaaaggattgattatgaagtgcaacaggtgcttaattatatgaaacaacagcacactgagatctgcatctatcaaacacatcttccatggtcagccaatcctgtgtgcacatattaactttgtttgtaaattcacacttgagaccacttaatttgaagtgtgactgagttctgtttgggaggggaaaacagaagagaagattaatacagcttcagttttacccaaatattcaatatcttcatcattttgctgtggacgtggaagaaaaaggggatgttcattaccagaacgaaccatctggtaatcaggacagggactgca

SEQ ID NO: 224608 - DNA, 338 bp, Homo sapiens
catcactttctattattgtacactaccttttttctctacactacttctcaatccttatgatttattattactgtttttgttattgttttacttgtttatgcatgcttgtttcccctgggcacatgcctggcatgttttaggcaccagtacaagtgtgttgaatagatagatggatgaatctctaatgttttccaactatagcaccctaattgagactggaaagattctgtcaagaataattcttgggtcttgatttcaccaaacagtagtattgacacagatacttataaccctctggaaacagaataggacaaaataataaaatatttttttctgct

SEQ ID NO: 224609 - DNA, 586 bp, Homo sapiens
aggctggacttacccagaccaacaggggcaatatgtcctttgttccacccaaacacccctttctccctgggcttataaagcactggaattttgcactgaattctttcgggggatggagattctgggaacctcggactttataagatgctcttcccaacgacaacattgcttacctctttatttggattctcttgtgtaaatcacccatgagcctttaaagattggtatgttattgtttccattttacacattggggaacaaattgaggccccaagaggtaaagttgatttctaaaggtcatacaattactaagtggtgagccaggatttgaacctgtatattctggctccagagcctatgagcttacctttatgctatactgcctcatagtttattatcactctgtctaccatggtagccactagccacatgtggctatttagatttaagttgattaaaatagatgggcatggtggctcacgcctataatcccacctctttgggaggctgaggcgggcggatggcttgaggtcaggagttcgagaccagcctgggcaacataatgaagccccatctctacaaaaaa

SEQ ID NO: 224610 - DNA, 121 bp, Homo sapiens
gggggtgtgtgtgttttagacggtgtgtatgtgtgttagggtgtgtgtgttagggtgagtgcatgtgtgtgagatgggtgtgtgtgttttagggagtgtgtgttttttagacagggttgag

SEQ ID NO: 224611 - DNA, 3393 bp, Homo sapiens
  misc_feature (2)..(4): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (14)..(17): n is a, c, g, or t
  misc_feature (1132)..(1134): n is a, c, g, or t
  misc_feature (1138)..(1138): n is a, c, g, or t
  misc_feature (1140)..(1142): n is a, c, g, or t
  misc_feature (1144)..(1144): n is a, c, g, or t
  misc_feature (1148)..(1149): n is a, c, g, or t
  misc_feature (1151)..(1153): n is a, c, g, or t
  misc_feature (1155)..(1157): n is a, c, g, or t
  misc_feature (1160)..(1162): n is a, c, g, or t
  misc_feature (1165)..(1165): n is a, c, g, or t
  misc_feature (1167)..(1167): n is a, c, g, or t
  misc_feature (1169)..(1169): n is a, c, g, or t
  misc_feature (1171)..(1171): n is a, c, g, or t
gnnngnttnggnannnnaactaggaatgaactttcacttttactgtttaaaagtaaaaatatctttggaagctgaggaatggctgctgggagaagtcgattttaacccaaatgtgatctttctgtcttctccatagacttcacatctccctctgggacagtaatgaggagagagtgtttggccatcgcaggtgtaggaggtggaggcagattctgcgtgggtggcttctgtcaacagacgctggactgtgcagggcagctgcagtggttctggctggttgctgtggtcagtgggagtcgtggcatgttcctgggggcagtcacatctctgaacatttcctttatgacagttagtgcagttttaaaaaaggaaaaatcttcaatgttaaccttttttctgtctcttatttctaccctttaagattatctttatgacttctaaggatattttaagctcacagtcacacttggaagcagtgcccttgtaaggctctgcctagtgtggctgtattagaaaggtcattcctggttcttacatgtgcttctcctttccacgtctcccactggcgtgctgactttccaaggggaacgtgaagctgtccgcagtccttgcccttgccctttcttttggagactgtgtgaatgagcagcagccactttaatgtgaggcagccatataaacaatgaactttcacttgctgccaggaggtcataaactcaaggtcaccaaatgaattctagcttcagctcttggtttagtaatgtaccaagtttggtattactttttgtttgttttaatcaggtttctgccctcatcttctatttgggaaattaaaactggtctgttggcatggctggtgactgagcggcaggcacattcttagtctctgactttctgcagccatctttgagtgcatataagtgttgggtaacagtctactgaatgtgctacaagtgtgcggagttgtgttcatctttaacttgttttttttaaaaaacactctcttggtaaattgggatctcctgttgaaaactgtatttgtttggcagttgagtttatgcctggagcccctagagcacatttaactggttggtggtcagttgtaccatactgaaaaaaaaaaaaaaaaaannntagnannntnatannannnannnagnnnacncntntncgtcactaagggacactcctacactcttaatcttaccatcatgaatgtttccctgcaagattcaggcacctatgcctgcagagccaggaatgtatacacaggggaagaaatcctccagaagaaagaaattacaatcagaggtgagcactgcaacaaaaaggctgttttctctcggatctccaaatttaaaagcacaaggaatgattgtaccacacaaagtaatgtaaaacattaaaggactcattaaaaagtaacagttgtctcatatcatcttgatttattgtcactgttgctaactttcaggctcggaggagatgctcctcccaaaatgagttcggagatgatagcagtaataatgagacccccgggccccagctctgggccccccattcaggccgagggggctgctccggggggccgacttggtgcacgtttggatttggaggatccctgcactgccttctctgtgtttgttgctcttgctgttttctcctgcctgataaacaacaacttgggatgatcctttccttccattttgatgccaacctctttttatttttaagtgttgaagctgcacaaactgaataatttaaacaaatgctggtttctgccaaagatggacacgaataagttaattttccagctcagaatgagtacagttgaatttgagactctgtcggacttctgcctggttttatttgggactatttcatctgctcttgatttgtaaatagcacttggatagcaagttataatgcttatttatttgaaaatgcttttttttttttacgttaagcacatttatcttgaactggagcttctaaaatgggccccaggggtgcaagatgttggtgtaattcagagatagtaaaggtttatcgcagtgtgaattataagagtccatccaaatcaacgtcccctccctcctctcatgcgatccaggtaattatgcagttagtgccacagtagactagcctagcaaagggtttgctccttgctgtctctgactgcaccacacagctattgatggcagctgaaagaaagtggatcatgccttaattttaaatattcctgtcctctggttattattttaaggaacttcatcatgttaaaatgacagcattcaaagatgtaccacaatcaatttatcaaggaaataaaggctattgtaaccagagatttaatgcattcttctaaatgtaaatttaaaatttgccctttaaaaaagtccactttccccatatgcaaatgttaataggatttttatggggattaagaagcggcaaaactacagaagcagaattcaaagtaatttaaaaaatacacaccagttttaaatcaagagaagttgtaatctcttgttttaagcttgcgtttgagggaaaatgactttttcaccaatttaatatgcattgttctgttgtttttatttatgattgatcattatatgtgacttgcataaactatttaaaaaaaaaaactataatgaccaaaatagccatggctgagaaacacagtggctgggcagttcaataggaggtgacaatatgacaacttctcaagcttgggaactcaccagactgtttcctcctttaggtaacagattctgtcccacggctaaacttgtctttcacgtgggaattgcttttgtcaaacgtgaaagagtaaacaatagcatttccccagaatgccagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtcttttttttttttttttaaagaaacttttgggtgggttttgttttttattagttaccctaggggtatgttaccctggggtatgaagggaggtgaagataacggaggggggag

SEQ ID NO: 224612 - DNA, 1320 bp, Homo sapiens
ttgaatcaaacttttaaaacagagatacagaaaactcttcatgaaaagatttttttgtcttcctttctttgtatgtttgatatacagataactgttaacagtattctgatttccattattcacatttctgtagtgacaaggatcaagtatctgcaggcatttctttgtcccgggaaaagcagattttttcaaggaaatgatgtgttgatatataatagaacatacataaatacttttgctagctgtgcagttagttagaaagtgttgatgttttgacattgggtggctgttggtcactgcagatggaattgctgaaagaaatttacataacctgttaagagaccaatcattgttgcactagattaggtactcaagttagtttacagaattttgattatttttggttggcttggtatgagattggctttcgattatatgcttcaattgggtctaatgactcttccctgtcattgtaaatggaatcagtggagataggtcaatgacaaggttgattatagaccagggcttacagaagctaatcatctgcagtcttcatttacatacatgcttctgctgttggcttccagccaaggctggtgtagtatagtacatgaattttggagtcattattgatcatatatttccaacaagtgtgatgaggtggagttggcttaagttgaaatgtttagtggaaaacattggttcgttaaaagtagcagtggatctacagctcttttttgagaatgaattgctattatgtttgctgtctacactgaggtgtggcatgaagcctttctctcgtctcctttataccttggtggatctgtgtttccggacacttttccttttgaaagttgagatcccgttcagaggctgacagacttgtccctagaagaaagggggcataaatatgccaaatgcaaaaccacaatgatttctttgattacagggaccttggggccagcttgcggtaagaacttgcctttagaagatcctttggttcccatcagtgtctccctctcctcaaagggatggcagcccagtggacagtgggcacatgaccctgacaatttccgggaaacgaggactcccaacgggaggtaagactgcgtcttgatccagacggtccggcccaagacagactgttgcaaccattccctcatcatgcgccctgaaatcccttgcccttccaatccacagcccttatagattggcaccatttgtacggatcggacggtaaccttgggactggcataggtttgtttgttcgtcattggcctatacgcaaggccccaaaatgggggtaacggggggaatcaa

SEQ ID NO: 224613 - DNA, 4073 bp, Homo sapiens
  misc_feature (1812)..(1814): n is a, c, g, or t
  misc_feature (1818)..(1818): n is a, c, g, or t
  misc_feature (1820)..(1822): n is a, c, g, or t
  misc_feature (1824)..(1824): n is a, c, g, or t
  misc_feature (1828)..(1829): n is a, c, g, or t
  misc_feature (1831)..(1833): n is a, c, g, or t
  misc_feature (1835)..(1837): n is a, c, g, or t
  misc_feature (1840)..(1842): n is a, c, g, or t
  misc_feature (1845)..(1845): n is a, c, g, or t
  misc_feature (1847)..(1847): n is a, c, g, or t
  misc_feature (1849)..(1849): n is a, c, g, or t
  misc_feature (1851)..(1851): n is a, c, g, or t
ttgaatcaaacttttaaaacagagatacagaaaactcttcatgaaaagatttttttgtcttcctttctttgtatgtttgatatacagataactgttaacagtattctgatttccattattcacatttctgtagtgacaaggatcaagtatctgcaggcatttctttgtcccgggaaaagcagattttttcaaggaaatgatgtgttgatatataatagaacatacataaatacttttgctagctgtgcagttagttagaaagtgttgatgttttgacattgggtggctgttggtcactgcagatggaattgctgaaagaaatttacataacctgttaagagaccaatcattgttgcactagattaggtactcaagttagtttacagaattttgattatttttggttggcttggtatgagattggctttcgattatatgcttcaattgggtctaatgactcttccctgtcattgtaaatggaatcagtggagataggtcaatgacaaggttgattatagaccagggcttacagaagctaatcatctgcagtcttcatttacatacatgcttctgctgttggcttccagccaaggctggtgtagtatagtacatgaattttggagtcattattgatcatatatttccaacaagtgtgatgaggtggagttggcttaagttgaaatgtttagtggaaaacattggttcgttaaaagtagcagtggatctacagctcttttttgagaatgaattgctattatgtttgctgtctacactgaggtgtggcatgaagcctttctctcgtctcctttataccttggtggatctgtgtttccggacacttttccttttgaaagttgagatcccgttcagaggctgacagacttgtccctagaagaaagggtggcttctgtcaacagacgctggactgtgcagggcagctgcagtggttctggctggttgctgtggtcagtgggagtcgtggcatgttcctgggggcagtcacatctctgaacatttcctttatgacagttagtgcagttttaaaaaaggaaaaatcttcaatgttaaccttttttctgtctcttatttctaccctttaagattatctttatgacttctaaggatattttaagctcacagtcacacttggaagcagtgcccttgtaaggctctgcctagtgtggctgtattagaaaggtcattcctggttcttacatgtgcttctcctttccacgtctcccactggcgtgctgactttccaaggggaacgtgaagctgtccgcagtccttgcccttgccctttcttttggagactgtgtgaatgagcagcagccactttaatgtgaggcagccatataaacaatgaactttcacttgctgccaggaggtcataaactcaaggtcaccaaatgaattctagcttcagctcttggtttagtaatgtaccaagtttggtattactttttgtttgttttaatcaggtttctgccctcatcttctatttgggaaattaaaactggtctgttggcatggctggtgactgagcggcaggcacattcttagtctctgactttctgcagccatctttgagtgcatataagtgttgggtaacagtctactgaatgtgctacaagtgtgcggagttgtgttcatctttaacttgttttttttaaaaaacactctcttggtaaattgggatctcctgttgaaaactgtatttgtttggcagttgagtttatgcctggagcccctagagcacatttaactggttggtggtcagttgtaccatactgaaaaaaaaaaaaaaaaaannntagnannntnatannannnannnagnnnacncntntncgtcactaagggacactcctacactcttaatcttaccatcatgaatgtttccctgcaagattcaggcacctatgcctgcagagccaggaatgtatacacaggggaagaaatcctccagaagaaagaaattacaatcagaggtgagcactgcaacaaaaaggctgttttctctcggatctccaaatttaaaagcacaaggaatgattgtaccacacaaagtaatgtaaaacattaaaggactcattaaaaagtaacagttgtctcatatcatcttgatttattgtcactgttgctaactttcaggctcggaggagatgctcctcccaaaatgagttcggagatgatagcagtaataatgagacccccgggccccagctctgggccccccattcaggccgagggggctgctccggggggccgacttggtgcacgtttggatttggaggatccctgcactgccttctctgtgtttgttgctcttgctgttttctcctgcctgataaacaacaacttgggatgatcctttccttccattttgatgccaacctctttttatttttaagtgttgaagctgcacaaactgaataatttaaacaaatgctggtttctgccaaagatggacacgaataagttaattttccagctcagaatgagtacagttgaatttgagactctgtcggacttctgcctggttttatttgggactatttcatctgctcttgatttgtaaatagcacttggatagcaagttataatgcttatttatttgaaaatgcttttttttttttacgttaagcacatttatcttgaactggagcttctaaaatgggccccaggggtgcaagatgttggtgtaattcagagatagtaaaggtttatcgcagtgtgaattataagagtccatccaaatcaacgtcccctccctcctctcatgcgatccaggtaattatgcagttagtgccacagtagactagcctagcaaagggtttgctccttgctgtctctgactgcaccacacagctattgatggcagctgaaagaaagtggatcatgccttaattttaaatattcctgtcctctggttattattttaaggaacttcatcatgttaaaatgacagcattcaaagatgtaccacaatcaatttatcaaggaaataaaggctattgtaaccagagatttaatgcattcttctaaatgtaaatttaaaatttgccctttaaaaaagtccactttccccatatgcaaatgttaataggatttttatggggattaagaagcggcaaaactacagaagcagaattcaaagtaatttaaaaaatacacaccagttttaaatcaagagaagttgtaatctcttgttttaagcttgcgtttgagggaaaatgactttttcaccaatttaatatgcattgttctgttgtttttatttatgattgatcattatatgtgacttgcataaactatttaaaaaaaaaaactataatgaccaaaatagccatggctgagaaacacagtggctgggcagttcaataggaggtgacaatatgacaacttctcaagcttgggaactcaccagactgtttcctcctttaggtaacagattctgtcccacggctaaacttgtctttcacgtgggaattgcttttgtcaaacgtgaaagagtaaacaatagcatttccccagaatgccagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtcttttttttttttttttaaagaaacttttgggtgggttttgttttttattagttaccctaggggtatgttaccctggggtatgaagggaggtgaagataacggaggggggag

SEQ ID NO: 224614 - DNA, 2973 bp, Homo sapiens
  misc_feature (124)..(124): n is a, c, g, or t
  misc_feature (318)..(318): n is a, c, g, or t
  misc_feature (712)..(714): n is a, c, g, or t
  misc_feature (718)..(718): n is a, c, g, or t
  misc_feature (720)..(722): n is a, c, g, or t
  misc_feature (724)..(724): n is a, c, g, or t
  misc_feature (728)..(729): n is a, c, g, or t
  misc_feature (731)..(733): n is a, c, g, or t
  misc_feature (735)..(737): n is a, c, g, or t
  misc_feature (740)..(742): n is a, c, g, or t
  misc_feature (745)..(745): n is a, c, g, or t
  misc_feature (747)..(747): n is a, c, g, or t
  misc_feature (749)..(749): n is a, c, g, or t
  misc_feature (751)..(751): n is a, c, g, or t
ttttctttggaagactgtgtgaatgagcagcagccactttaatgtaggggggggggggccgacaaaaaaaagagggtcccccccccccaaaaaaattttttaaaaaattttttaaaaaaaaaangggacccccccccaaaaaattttggggaaaaaaaaacccttttttttttttcccccaacccctttttttgggggcccttcgggggccccacccaaaaggggggaaaagggggttttccaatttaaaaaaaaccctttcccaaaaaaagggggttctcctaccccccccaaaaaaaaaaatttgaaaattctctnagcttcagctcttggtttagtaatgtaccaagtttggtattactttttgtttgttttaatcaggtttctgccctcatcttctatttgggaaattaaaactggtctgttggcatggctggtgactgagcggcaggcacattcttagtctctgactttctgcagccatctttgagtgcatataagtgttgggtaacagtctactgaatgtgctacaagtgtgcggagttgtgttcatctttaacttgttttttttaaaaaacactctcttggtaaattgggatctcctgttgaaaactgtatttgtttggcagttgagtttatgcctggagcccctagagcacatttaactggttggtggtcagttgtaccatactgaaaaaaaaaaaaaaaaaannntagnannntnatannannnannnagnnnacncntntncgtcactaagggacactcctacactcttaatcttaccatcatgaatgtttccctgcaagattcaggcacctatgcctgcagagccaggaatgtatacacaggggaagaaatcctccagaagaaagaaattacaatcagaggtgagcactgcaacaaaaaggctgttttctctcggatctccaaatttaaaagcacaaggaatgattgtaccacacaaagtaatgtaaaacattaaaggactcattaaaaagtaacagttgtctcatatcatcttgatttattgtcactgttgctaactttcaggctcggaggagatgctcctcccaaaatgagttcggagatgatagcagtaataatgagacccccgggccccagctctgggccccccattcaggccgagggggctgctccggggggccgacttggtgcacgtttggatttggaggatccctgcactgccttctctgtgtttgttgctcttgctgttttctcctgcctgataaacaacaacttgggatgatcctttccttccattttgatgccaacctctttttatttttaagtgttgaagctgcacaaactgaataatttaaacaaatgctggtttctgccaaagatggacacgaataagttaattttccagctcagaatgagtacagttgaatttgagactctgtcggacttctgcctggttttatttgggactatttcatctgctcttgatttgtaaatagcacttggatagcaagttataatgcttatttatttgaaaatgcttttttttttttacgttaagcacatttatcttgaactggagcttctaaaatgggccccaggggtgcaagatgttggtgtaattcagagatagtaaaggtttatcgcagtgtgaattataagagtccatccaaatcaacgtcccctccctcctctcatgcgatccaggtaattatgcagttagtgccacagtagactagcctagcaaagggtttgctccttgctgtctctgactgcaccacacagctattgatggcagctgaaagaaagtggatcatgccttaattttaaatattcctgtcctctggttattattttaaggaacttcatcatgttaaaatgacagcattcaaagatgtaccacaatcaatttatcaaggaaataaaggctattgtaaccagagatttaatgcattcttctaaatgtaaatttaaaatttgccctttaaaaaagtccactttccccatatgcaaatgttaataggatttttatggggattaagaagcggcaaaactacagaagcagaattcaaagtaatttaaaaaatacacaccagttttaaatcaagagaagttgtaatctcttgttttaagcttgcgtttgagggaaaatgactttttcaccaatttaatatgcattgttctgttgtttttatttatgattgatcattatatgtgacttgcataaactatttaaaaaaaaaaactataatgaccaaaatagccatggctgagaaacacagtggctgggcagttcaataggaggtgacaatatgacaacttctcaagcttgggaactcaccagactgtttcctcctttaggtaacagattctgtcccacggctaaacttgtctttcacgtgggaattgcttttgtcaaacgtgaaagagtaaacaatagcatttccccagaatgccagttttatggagccccaaatgctctgaaaacaattagtaacctggaagttgtcagcccaaaggaaagaaaaatcaattgtatcttgaaattttacctatggctctttggcctggcttctttgttcattataagttagtgtgttccttcaggaaacaatgccttaataccatagaacatgggggccttaatagttgctaacattaaaaaagcaaacagaatgattgagggatccttatgaaaacaaaatggtgaattggacatgcagaacctaccatttccttcccctgtttgcaatttttgtggggaggggaggatgttagtatttacaaaagatgattttaagaacttccaagagatgagtttaagaattccatagagtattagttgttcactgtgtaattaatccttccggagagtcttttttttttttttttaaagaaacttttgggtgggttttgttttttattagttaccctaggggtatgttaccctggggtatgaagggaggtgaagataacggaggggggag

SEQ ID NO: 224615 - DNA, 407 bp, Homo sapiens
acttaattgaaccctcataaaaattaatgtgtagtgctttctaggtatggaataaacttctattatttttaaaaactgctttggaatacccacacatatttctcttaaaatagtgaagatggtcaaatttgactgtaattttaccaaggaatttattatattaaagccacctggtcataatctcagaaatctgatacagttattaaaaaatttgagtacatgaaaattaggaaccagagaagtttttattcaaagacttctaacacagaatggcaaaaacataaatggagatgggcactatacattagaaacagagtaatgtaggtggcatttatccatgcaatcagtggatcttatcggtatcaactaaattctaggtgatctgctatagccggggatataatgat

SEQ ID NO: 224616 - DNA, 480 bp, Homo sapiens
agatagcagtaattagtgaacctaatgattgtgcttctctttgtagttctaccagtttagctacctttgttagcacacaccttgtacccacctgacaagaggaagatggggaatggggaattggaaaggaagagggagcaacctcactgaatatggtatgccaagcagtgaacatatgtcgcgtcatcacactctgacaataacccacaaaggagaccaatatcccattataacagaagcagaaaagaaacaacccttatgttactttaccaataggaaccttctctagatttgaccccaaatgatattattccaaagcctatgcttttgaaaacttaagaaatgtacagatttattttgagaaaaacaaccttccataattcttgagcatactccatgaatctcctagattctgtggagccaagttggtaaaataccacattagaagtgaagtgctaccagttggaggagcaaaatagc

SEQ ID NO: 224617 - DNA, 365 bp, Homo sapiens
gcagtgagccgagatagcgccactgcactccagccttgggggcagaggcagactccgtctcaaaaaaaagaaaaacaaacaaacaaaaaaaagaaatggtaccaattatggaagtctgcagatgtaactattttttgcttataaacacaggtgtttttggtgtttttaacatctcaaaatgttgaagacagttcaatgtgtactttatcacgcagtactataacattatatgactgtatagtaggctaggtgcttacagaactatgtcctatggtaattgctcaaatgttcatttaattgaatcaaattatttcagattgtgtttctccagttacaaataagtgtctgcagaagttccaatgatt

SEQ ID NO: 224618 - DNA, 531 bp, Homo sapiens
caggcgaggtgctatggctaagggattaatcttttgtgtcccaactatgttgctctgacggttccacttgcactactggtttttacttcatcgttaatctctgctctggccgataacagcctgcatgaaaacatcaccagttttcaagtttttctcaggatgaacagtacatagaaaagtgagcctgaatgctgagatcctgagaccgtgctgcggcgcctgggaattcatagagcagcttttaaggggccaccacttctcgcatcgtgtgccatgcaagtaaacctaccctatcctgagacccttgcctggggtgactggaagagctgcttctgtagaatcctgggccagaccatctatctggacgaataggagaaaagcctagttgttgtctcctgcaagatgtattcagttgtaatttcgcctttgttccttaatctgttagtatggtatattacatcgattaatatttcatattaaatcagtcatgaattcccattatgagccccacttgctcatgattgaagatat

SEQ ID NO: 224619 - DNA, 275 bp, Homo sapiens
agagatgaaaagaaatacctcctgcctcagccatgaagccttcactgtagaaacaacacatgtgctgactgtcccctggaacggcctctctcttcaggccaacacagtccactttggttctgccaacctgctgaccaaccccaacagatggaaggaaggaagagaaagccgaggtgcagatgacatggcttatgcaatatttttattgtgccagtattcaaatgtattacattgatttgttctgactgacaataatgtggatgctttgatatcag

SEQ ID NO: 224620 - DNA, 415 bp, Homo sapiens
tgccttaacatccaggatttaatttatcttgctttattcatttaaaatgttatgtaaggaccttgccaatgtttaagtagatcaactattgtcatcagttgggctagtttctatttgtgttattcctatcatgcgttcctttataattctctacaaaagaccattcttttaaaaatagacatataagattatttttagcaacagtaggaatgacaaatgagtttcacctattgtgcaaacttcaatcaattgatagtagttgccaagtgcacagtattgaggagaattctgaggcttcttcaaagcttactagaaaagatagccatgattttttaatgacacctattacaattggatgtgtgtatgtgtgtgtgtgtgtgtgtgtgtgtaagatagaagttatgtactttccatt

SEQ ID NO: 224621 - DNA, 520 bp, Homo sapiens
ctgtctagtttgtgttcaaattattattattattaaagacagggtctccctatgttgcccaggatggtctcaaactcctgggctcaagggatcgccctgcctcagcctccagagtagctggtattacaggtgtgaaccactgagctcagcataaaatggttattttttaagtatatatagccaggcataattaaattaaatatagtttaaaagtgagtttaatgttatttttttcctcctcttcctgggatcataaaatgattaatgttaaaattagtgttctgctactgactggaacatacatgtttattatttccctctaatgtgaacacttgctggtagtatagaatatagtcatcttcaattccgacagttgacataaggcaattttataagtgattaatcacatactattgtgcatgtaggagggttttggcttagagttattttggtgtactttttggatgttacgatttttattttataagtaaactcatgtttgttacctgtaatgttttac

SEQ ID NO: 224622 - DNA, 107 bp, Homo sapiens
acattgagattaacatctctctctccacctgtcactaaccagaaatactattgccttggttaagttttgggagggagggaaaactttcctatgtgtcttataaggga

SEQ ID NO: 224623 - DNA, 280 bp, Homo sapiens
ttagtcattctatttcagtaaatattgaatttataagagacttaaaaggcccattggccttattgagtttcatttatcaaatgtcatattctcaacatgttgcacctgtaatttatctgttgggggagcataatttatgaagtattctgctttataagtaaatgactcttaaccaattgatgtcagtaaaagatgtatttgcatgacttcctccctgatagggttcacttttaagtaatgtagttcaattattgttgaaataaaaaagtttcttcctttt

SEQ ID NO: 224624 - DNA, 557 bp, Homo sapiens
acattgaattttttcagaaaacacctcatactcttgcttgggaacataacccttgcttccaggaggctgaggatctcaccattctgtgtatggatttggggctttcagctacaagttgaaaaccaattctccattgtgtccgttgctctctttatttcaagtactgagggaaaaaattttttgccttctctctgggagaggactacagttgcatgcctattctctaggtattgactttcaaccagtactctgttcctcttttaccccagcattttgttgtgctttttaagatatcctggactcttagtctgacttactacctctataaatgaaaattgcttgaattttcagagcctctttacccttatctgtagaatgtccaccttaggaattgaaagaattatttatgtaaaaatattttatggctggatgtggtggttcacacctataatccaagcactttgggaggctgaggcaggcagatcacttgaggtcaggagtttgagaccagcctggccaacatggcaaagcccgactctaccaaaaatacagaagtt

SEQ ID NO: 224625 - DNA, 322 bp, Homo sapiens
ttgggacacagttggctggtacaagaaaggtttttgttttgtttaagtctaggaataaaagtactatataacaataatcccctggtagatcaagctaggactttgaaaaggcacatggtggaattcaacatcaatttttcataaaaattatctttcaacaaatgaaaggtcattctttgataatagaagtgtgatagtacatgaggctgacccaagaaggtatcaattttaagatgcagcagatttttaaaaagatcatcttgctttgaaagaatgagaaaagaaaagcttttctaaacttctaagagttagagaaaacata

SEQ ID NO: 224626 - DNA, 722 bp, Homo sapiens
cctttccttcggagtgtgtagctcagtggtgtttaaaaaaaattacccaagattatttgcatatagaattcttatacctttcataagcttggaagcagcatgcataagcctggtaaatgcttatcaacctgtagcacatttagttatccatctgtaagctattgaacaaaggctggagtctcaatctgtatgcatcagtttatatttcctgaccaaaatctgattgcaatggtatttgaatactttcttcgtaattgggaccgtgaaagttggagtgtgtgctatgggtgttgtatccgttagacattttcttttctagctgaaatcatagctttgcatttgacacctagctttattgttgcagttgagacgcaagtttgaaataagtctaacattttattcttaagttgatttttttgttgttctgaatttttgtctgtagcttggtttcgcagagtcatcaattcctttttatctgtaattacacatttgtttttatttcaaagtaattataaggtgttatattgcatataatcagaaaactaaatggaaataatgcttttcagtaagcccggcccctttgaccgatacagaaaacttgaattaaactttgactacgtaggtattaattggcttcattacaattattgctgtaaaaatgaacagtgactagctctggaaagatttaagcgtcagtaattgttggtctcctgccttaaagt

SEQ ID NO: 224627 - DNA, 543 bp, Homo sapiens
gcgtcctggagtcgtctcggttcgcccttttgcgtgccttccaccgccgcgagctcggaatgtctggccccgggtgcttcagggtccgagaacctgcagaagttcacacttaaatcctacacgagagtcgtatttatgatgcagaactcggtgcagaacccgatggagtgcccaaggcgcttgagccgttcctagaaggggaaggagagccgcgggcggcagcggggcaggggacggaattgggaagcttgggagcaggaagaaggccagagctacttagggtacattccacttttgcttggcgccgggtaggaaccctgctagaaaggaagtaacgtgtgtttgtctcgtttgctgttgttttacaaacagggaaaatgaggttgaaaagggtgaatgaattccttaaggtcaagaaaaaggatcggtattcaaacctgcctatctggaagataagcttagactgccctacaggaggcactgtggcttatccccttggggctttaaagatgtgaggaccttagagatccattagtctaacct

SEQ ID NO: 224628 - DNA, 756 bp, Homo sapiens
gcatcttattgccccttttttctcttacccgggaagaaattattcttctggcgcatgccatcctctctgtgaataattttctttcttttctttcatctatttatttaaaatagtgattggggtctcactatattgcccaggctggtctcgaacttctgggctcaagccatcctcccaccttgacctcacaaagtgctaggattacagacgtgagccaccgtgctcaccctctgaataaattcactgggagttactatcctagtgataatgattggagttttcaaggtagattagatatacaagagaagaggatggaagaagagaagaggatagaagaggagtaaagaatgggatagtactgagaaactagttcagaaaaaaatggtaaactctcacagaaatacaagtgggtgagtttgcaatagcaacaggggtaacaagttgaggaaaataactgagaaaaaaccttagtgattatcttaggagacttttgagttgatgtttttagggaataaagtagggctgaaacagtatttcaagggcttttggaaatatgtggaggtagtggcaccttttaaccttgacagtaaaaggaactagatagaatataggcagtggaaaagataagtgaatggatgaggaagtctgttggaagaagccactggaagcaacttgaactgtacttggaagagatcattaaaggattatgggccaagaagaaatatgtgggaataaaactaattgacaagtacagtt

SEQ ID NO: 224629 - DNA, 772 bp, Homo sapiens
ggcctcaggaaacttacagtcacggtggaaggcaagacagaagcaggcaccttttttcacaaggtggcaggagagagaagtgagtgcacagaaaaaaaaacctcctacttttaaaaccatcagatctcctaagaattcactcactatcatgaggatagcatgaagtaaacttcttcgacacatggcgattacaggtccctctgtcgatgtgtggggataataatttgagatgaggtttgggtggggacacagagccaaaccatattattctgctcctggcacctcccaaatctcatgtcttttatatatatttcaaaaccaatcatgctttcccaacagtcccccaaagtcttaactgattccagcataactcaaaactccaagtccaaagtcttatttgagacaagtcccttctgcctatcagcctataaaattaaaaaaaaagttagttacatccacaatggggacctcatgaccctgaccagtgccctattctactgtggctcaactgatatccaagatgcaagacaaagtcctttttactctttcctctaatctcctctagcagaaggaagcggtcttttttggagctgcaagctgtgctgcctggggttgggggagtggtaatgcaagtactcctttagctgtcctggctggtgtctcagtaggttttatggccactcacctcagtacactgactctgagtacagtactattgtgtctgcagtagtgtatgacatggaaaataaatctccattctccaagactcttc

SEQ ID NO: 224630 - DNA, 241 bp, Homo sapiens
tagctgggactacaggggtacaccaccatgctcagctgccttttcttggttttagttttttgtagagacaaggtcttgctgtgttgcccaggctggtctcatttgaaactgccaggctcaagcaatcctcctgcctcggcctcacaaagtgctgggaccacaggcatgagctaccgtgttcttttcttttttcattcttatgggcactgagtaatatagtctgatgttcaggaaaggatat

SEQ ID NO: 224631 - DNA, 225 bp, Homo sapiens
ttggttcaacccagtcaacatttaatgagcatctaatatctgccaggcactagggattcaacagcaggaaagttttcaagaagcttgtgatctagaacagatgtcctgagctcctgtgaaattgaaattgggggttatttgtatataggggtgagtggcagagaagggtgggagaaatggcttttttgtcaacttcacaaaggaggcttttgacactcccccgcc

SEQ ID NO: 224632 - DNA, 617 bp, Homo sapiens
ccttgccagattcagttccagccattccagccaggcgcaaggctggcaggaagggagcggggccccagcgccttcccgcgcaggcctccaggaaatgaacttttcagagcagaactgggctcaggccagaggtcatcaggggagatgggagaagacaagggcctgggggcttttggctccgtagacttagccgctctcatcgttccccccttcctcgatcatctcccatctcacagccgagcgcccgggcacccaaccgaggggctagaatcgggacaaagcagcaggcaaggcctggaaaggccagccgcggggagaggaggccaggggaggggctctgctgccggcgcgcggcctttccccggggcctctactctccaggggtcccctcgagctgggggccctcgctggaaatagaaagcaaagcgtggagacgaagggatgggtgtgtgtatctatatatctgcagctccccacaaacgcgcgcaccccggggagccagcacagaaagccggcctgggtgtcgagggtgccggtgcccggggtcagatccagggtgccggtgcccggggtcagatccggggcgccctccgcggaggggcgcgcaccgcggccgc

SEQ ID NO: 224633 - DNA, 462 bp, Homo sapiens
cccattttaatgaattgtaatctccaagagtttaaatttctcactaggccaaatgaaaacatcccttcttacaaagaaatagaatagaaggaaaactaacctacattatcggattcatttaattctctctcccccttaaataaaacccatgtttcattttagcaattttagcaattttcaagatacatatctgccaagctaatgccatatttccaggtatcatgatcaaactccttatttttaactggaaaatggactgaaaatgccccagcatggttatcactagttttcctgtccagctaagctagcctgtgggtaagaaccaggaccaggagctgaattcttataccagccttaacaatagagaagaaaaaatctgggggaatgctctgagcaattcatcatcaccaaaaaaacctctcatataactgaccccttgtcatcaggtcaacttacacattt

SEQ ID NO: 224634 - DNA, 428 bp, Homo sapiens
gttaagtagtttttagggtcacaagttcataagggatagcaccaggttcaaacccatgcattctgaccctaattatttaactcttttatagtgcttatagcttaacacactatattacactgcctctataagtgtctctagaaaaagaaggtaaaggaaggaaacttgggagtggccaaaaagtgatgcaagtctttttctacatataaaataatgtttaggcttcattgcaagtatatacttgaactttacaataaggtttccttctctcggcatccttatgaagaaagtaaattgtgtggtttaatttaaatatacaatattcatctcttgaacagccatcagttatgagtgggtctgtttgaatgaaggagtccagtagagaaggtggtggttgagtctccagcagcagcagacaggataatgtt

SEQ ID NO: 224635 - DNA, 275 bp, Homo sapiens
caaactgtatgatgaggattattttctccagaatgcttagaacagcctagtctgaggttgctcactgtagggcacaactacttgtttcgggtgagcaagataacaaacggatcaattcagctagagaaacacagtataatgcaggagaaaacatttacctctcacttctttgaaattattaaatgtgcatgcaccagttccagctgagaaaatcagaactggacaatgccagaataaaagtttaaagtttctgtcatccaaactgatcactgcag

SEQ ID NO: 224636 - DNA, 442 bp, Homo sapiens
caggccaggggttgaagtaggctcatcagtcaaatacccactgacatccccatcccttaattgcagatacattcaagccctctgggaggcagacacaaaccatctgcactccagcagaaacgcacgagcagaaataggtacctgttagttgctaaagccaggccagtgagacatagagctgagacaggcaatgggagccctggattaggggaagagaagaggagagaggtccataccgctgcacagtgaggacaagctgatttcctgaggcatcgatgaggctcatggcactggcatgggagaggttggtgcaagagaccccattgattgccaagagctggtccctctctcggagtcctgctctgccagcctggctccgtcttcgaatctgagatgttgaaggagacactgtaggtaagagggggctccaaagggaatagaa

SEQ ID NO: 224637 - DNA, 331 bp, Homo sapiens
ttatcagcacagggaacattctgtaagatagaccatatgatagaccacaaaacaagtttcaataaatttttaaaaattggaattacatcaagtactctctcagaccacagtggaataaaactataaactgatttctaaaggaaccctcaaaactacacaaatacatggaaattaaataacctattccttaatgatcatcaaaaagtctgaaagagcacatatagacaatctaaggtcacttctcatggaactagagaaacaagaacaaaccaaacccaaacccagcagaagaaataacaaaggtaagagcagaactaaatgaaattgaaac

SEQ ID NO: 224638 - DNA, 367 bp, Homo sapiens
gggttttctgctcaggatgtctaaaggctgaaatcagggtgtcacctggactgagttctcatctggaggccgtggggaaaaattcactttcaagctcactcttcttggcagaattcagttccttgtggctgcaggactgaggtccctgcttcctagctggctttcagctggtgctgctctttgctgctggagcctgccatgttcctcacactgcattccatcttcaagccagtaatggtgcgtcacatttttcttgggcttctatctctgacttccgttctgtgaccagctggagacaacacttgtttttttaatctgtaaagtgagactatttgattaggtcaggtttggtatttttttccgcaaa

SEQ ID NO: 224639 - DNA, 451 bp, Homo sapiens
ccttttaaaatattttattttattttatttaaagttccagggtacctgtgcaggatgtgcaggtttgttacataggtaaacatgtgccatggtggtttgctgcacttatcaacccatcacctaggtattaagtccagcatgcattagctattttttgaataggatacaacttttatctgaaaagcgtatttcaaactttggaaactaaagcaaacattatatatgaccattaaaatatacatatacatatcatgataggtaaacattatatatgacaattctatgctatacataaatacataaagtctatgtgtataataaataccccatttgtcatagaaagacatactgtgtggtttagctacgattggaaaggtacagttctctaaatcaccatatgcacgttcttttagcaagttagggcctatttctatatagtaatgtgatgatt

SEQ ID NO: 224640 - DNA, 436 bp, Homo sapiens
cattattttgtctatgacaagacccaagactgattcctggagagttcctagaaggctgaacagagaagcatccagcaaaggagaaggaggggccagtgagagaggaggaaaaccaggagtacatggtgccacagaagccaaagatagccagttttaagaaccagggagtgatctgctgctgatggccagtgctgctggacggtcaagcaaaagctgacaaaggagcttggatttggccataaggagatcttgagtgacttggcacaagtggtctcatttgagtggtctaaatggaggctgagaagtggctcaaggctctctcctcacaaagtggttaccagctgcgccaagtttacatgcatggatggtcttcagtgcctgggattgtaaaaaggacataaagcttcttgccgtgtgtgtatttcagttccctaaa

SEQ ID NO: 224641 - DNA, 438 bp, Homo sapiens
taaatggtgcttaaatagcccattctttgcaagtcatccatgttgttcctttggcatttaactttgctcaaattgttgaagaatggtggcttgttgcatggtttttgtatttgtgtctagtgcacattttaacatggtagatgagatgcattgtgtagctagttttctggaaaagtcaatcttttaggaattatttttcaaatcttcaataaattttttctttaaattttaaataaataaatgagtcaaaagtcattgaggaaccaatatgacatgtgaaaggataacataagattagaaaaattcagaaatgactcacgcctataatcccagcactttggaaggccaaggcaggcgggtcacctgaggtcaggagttcgagaccagccttgccaacatggtgaaaccccgtctctactaaaaatacaaaaatttgct

SEQ ID NO: 224642 - DNA, 267 bp, Homo sapiens
ttgggaatctgtggtgtcaccaaaggggaagggaagggagattccacaacatttgaagatagtggtgaggaaagaaaaagttgtttctggattatacactagagtccagcccattcactaaaccaattcccccagttgtaactcggacggagatagagctggacgggtgtgaaactgctctttgtcagaaaggcagaaagacagacatggaggaagggaggtgaatattcaggaaagagcaggcaggaggcaaaaagaccaagcacc

SEQ ID NO: 224643 - DNA, 347 bp, Homo sapiens
agccacctgtatccctggttaatgagcattggccacctggcagaaccccactaccacgaagatacagtttcacttttaccgtttgtcacatccaattaaaggttttggcattcttgcctacttaaaaaacattctgtaaacattagaaatagtttttatatttatttatttatttattttcttcttttagacacaggatctctatcttccaggttggagtgcagtggcaccatcacaacttactgcagccctgaactctgcaactcaggtggtccttccgtctcagcctcgggagtagctggaattataggcacatgccaccaacacccagctcatttaaaaaattt

SEQ ID NO: 224644 - DNA, 521 bp, Homo sapiens
cacagtctgtgtcttggtgtcctgtcacagtgtagaatgtagccttgtaacctcgtcttgtctcatctctcatgctcttttaattgggatgcacagttaacaaaccctaaattgcaggatctgacctagggggcctttcaaaagttttatgtgttaaatgccaggattatgttgaaggtttatgttttctaaaataatttttgaagagtgtgggtgatgggtaaaagcagttgggttgttttgttttgttttttactaaaattttaattgtacctttttatcattgccttctgagatatctttctgtggtttgctgtcattgactaattatggcaatggcaatctagttatcttctcatcctaaagactgaaccacagtatcacctgagagaatacttttatatttcctgtttttctctaatgtggagactttctccaaggacttttcagagagatgtagaattgggtgaattggttggtctttctgcagcgcataacagactagccatctccatagcccg

SEQ ID NO: 224645 - DNA, 208 bp, Homo sapiens
tctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgt

SEQ ID NO: 224646 - DNA, 372 bp, Homo sapiens
gacattttatattactggagaaaaagtgaatgttttaaaatataatttcaaattagaaagaatttcttaagctgaaacaaaggcctgatgccaaaggaaaaatttttactgatcctttgcgtctgtcaagcaaagccatacagaataatgtactataagtagttaaaaacggcaagagactaggaaaaaacttgcatgtgaaaaagcaatagtttttttttgttttttgttttgttttgagatagagtctcgctctgttgcccaggttgaaggacagtagcgctactttggctcactgcaacctccgcctcctaggttcaagcgattctcctgcctcagcctcctgagtagctggaactacacccggctaat

SEQ ID NO: 224647 - DNA, 429 bp, Homo sapiens
gccctcttcgcgctgaagctgcggagggtctttttcttcagcccccaaatcctctgctctgtggcttaagattcccaggcttaaacccataactgctagggtcatcactcctcaaacttctccctcacttgttttgctgatgacggacacaggggcctcacagactcagaagcatctggagtcatttcgaaggacagaactgtggcaatatcctctttcccccttctaatctctgagaacagtgtctgtatatggcacgggggtccctagtgtcatataaaaggactcggagatgtcctcatgggctgtaacggcccccggtgctattcagggatctctgttctttaaagaaatatcatttccccttatttctctacctttgtgccctcacctcgccctgaattgtttcttaaactgggctttttggga

SEQ ID NO: 224648 - DNA, 659 bp, Homo sapiens
gtcatttcttaaatatatcaaggatattttggaaatctgaatagaagagtacgcgcaccaaggcttagaggcagaagcatgacctttaaagtgaggccagctgggatttgaacatcttctctttctgtcaccttcaattccgtagctttctcctgccgtctataaaatgggaatgatacctacctcacatggttgtcatgtaaactgagtcagtgaaaggctgttagccctgttcttggcagccatgatgatgtttatgaaaaagaaaagatgttggagtctaaagagcagtttgaagaaatatccactttaaactgatgaaagaaatatcaataggagcctgacaattatgattgccagagagtgtttcccaagaaaaggaggattgttaatgaagaaaaacggggtgggttcattggctcacacttgtaatcccagcaccttgagaggctgagatgggcggatcacttgagaccaggagttccggaccagcctgagcaacatagcgagaccctggctctacaaaaataaaataattaatcaggcatgatggggcacacttgtattcctagtaactcaggaggctgaggcaggaggctagcaccctgggagtttgaggctgcactctagcctgggtgacagcgtgagatcctgtctca

SEQ ID NO: 224649 - DNA, 624 bp, Homo sapiens
gtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagataa

SEQ ID NO: 224650 - DNA, 491 bp, Homo sapiens
tctagatggaatataattaattatgcattgctttgtgatagatcttatattgtttcaaattgttatttatttcttgcattgttgtttaacttgtcatctactttctttccccttctcaactaaattataaattccttgaggcagggaccaggttttaaattcatctccttaagcatggtatgcgatgaataagcattttattctgcagaaatattctaatatttcctcattttaaaattttactagtagtgtgatccagagctaatgttacagttaacatttgatgaatacttgactaattttaaggaattaccatatttttccattttaggacctcagaatttaagatataagtatatataatgaaatcctttaaacattatcttccgtctattgggtgtaatcagtagaaagcgattagaaaatttttttaaatctgtttttagaggcagtaatgttcttttttctttcttttttcctgtgacgggttt

SEQ ID NO: 224651 - DNA, 248 bp, Homo sapiens
ctgtgtgtgtgtgtgagagtgtgtgtgagagagagtgtgtgtgtgcacatgtgtatgtgtgcatgcacgtgctggcccagagtgtgtcattctaacagaacctgcccggtgatggcctctgctttctggtctgctcgtcttggaggccccacttgtgtcacataggtactgagacacctgcattaacccttctgacggagtcataagaacccctgacattgaattagaatctttctctcgtctacatc

SEQ ID NO: 224652 - DNA, 146 bp, Homo sapiens
caagtacctcaaaccacagtgacatcactgccacctgtgacatcactacacgccacagtggaaaaagactgtgggtcccagagaggtgggtcctgagcatcagagccccagccccgcagtcagctactcagcagaggtgatcaagg

SEQ ID NO: 224653 - DNA, 495 bp, Homo sapiens
cgtgctctgcagaagatgcctgccaggagtcctattctccacccagccaggcctcatggccatctacacactgacccaactcttcactgctggacttctacccaggtgtttcatagaatgcccccttctttcagaaagggaactgtcctgggccaggtcaaattaagccagtcaggtccttcctgctcaggggcccccaatttatctgggagccccactttacaggttcagcctactctagacatagtccccccctgtaggcctagcctcagaggcttcctgaggacacggccaataaggccagtggccctgacctggctttctgcctgccaagtaaagagcttttccaggcagtaactctccctccgagcagcctgggtgacagagcgagactccgagaaagaaagaaaggaagaaagaaaagaaagaaggcactccgtgctctgcagaagatgcctgccaggagtcctattctccacccagccaggcctcatg

SEQ ID NO: 224654 - DNA, 420 bp, Homo sapiens
ccagtaatgatgcagaatttttaaaagcttatctttctctattcaggaagaatttaatttggtggcatgttaagatattaaaattaataattaaaagaagataattataatagaccactttttaaaatgctctaaaatatttttgtgattttgtactcccataccttactttgcttgttcttaacttggatcagagcgcttgtgtggacaacttatcattttcttctctcttggctaccttatttggctctctgtgatttttaagcataccaaaattgtaataatctgacgtatatgagcaatgaagaatttttttttttgagatagggtgtcactctgtcacccaggctggaggtttcggtgagccgagatcaccccattgcactccagcctggacaacaagaacaaaattccatctca

SEQ ID NO: 224655 - DNA, 400 bp, Homo sapiens
tgtacttctatattcccaccttctctccaaccaagactcttcaccttggcacactgcatcaagaagacacccgggcagctggaaaaacaagcaagcagatgagcccacacactgaacctagatggtcatctggaaggcaggcagggcctaccttagtccttctggtactcgaaatccaagagccatagccctgagactggggagcagaggcttgagtgccttgctcacaaggattagtgaggatgcggtcagaaagctcggaggtacgggggctcacacctgtgatcccagcactttgggaggtgagggtgagatgactgctgaacccaggagttcgagaccagcctgggcaatgcagtgagaccccgtctctacaacaattagctgggtgtggtagtgt

SEQ ID NO: 224656 - DNA, 453 bp, Homo sapiens
cagtgagatgctgggtctccatgaagccaggattaagcagaaatagtggagatgttttgccctgaaggcagttccaagcctaattgtcacacagcaagaagcactgctcttaggatgactgggaacctccctttcaaagttccccatcctcctaccctttagaaaactttggagatacagcaaggcaaaacggaacaatgttagccttttgatttgcctctggggacagctcttgccagggcaaattttggtgaagtggacatggccattctcaaagagaactaaactcattacattgttttgtgtgtaattaaggcaaagcttcttattcataaattgggcactgtttgtgaagcataatgttaattaagtgctttttgttccctgagaaccttatctttgttctgtaagaataagaataatttacttctttctagaagagcaaactgtaaa

SEQ ID NO: 224657 - DNA, 536 bp, Homo sapiens
gggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgactggtgtccttataaaaggagattaagagcacaccaacatggcacacgtatacatatgtaacaaacctgcacattgtgcacatgtaccctagaacttaaagtataataaaag

SEQ ID NO: 224658 - DNA, 483 bp, Homo sapiens
gggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaagccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgactggtgtccttataaaaggagattaagagcacaccaacatggcacacgtatacatatgtaacaaacctgcacattgtgcacatgtaccctagaacttaaagtataataaaag

SEQ ID NO: 224659 - DNA, 762 bp, Homo sapiens
cggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacgaatgggacaacagaagaagtgacttcaaaagaagacgaagaggaagagatggatgaagatatagaagacttagatcactatgagatgaaagaagagcctattagtgagaagaagttggaggatgaaggaactgaaaaagaaaattgggcaatattagagaaaattaggaagactgaaaggcaaggccatttaaatgtgttgaccctgatagtcctttgcacagtgatctttagatcttaaaaagaagcgataggagacattttgcttatctttcaagtgttcctgacagcatctcagaggatggtgtcctctggcttactctctgggaaatgctgctctgttggaaatccggagttctgagtgatccccatgcgttttctgctgcagagcaggacatgctgaagtgattccttcgtgagcagatgttagaggtctccctttgacagcttgttacaaagttgatcacgaatatactattacggtgagtggaagtcccaggttgg

SEQ ID NO: 224660 - DNA, 894 bp, Homo sapiens
cggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcttcggcccatgccgaacatcccaggggacctggagagccgggaggccatggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagggagaaagtacatcagccagggggcagtgtcagagacgcagcactgggagaggaggacatcgtcaggctggcccaggaccaggaggagatgaaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctc

SEQ ID NO: 224661 - DNA, 755 bp, Homo sapiens
cggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagggagaaagtacatcagccagggggcagtgtcagagacgcagcactgggagaggaggacatcgtcaggctggcccaggaccaggaggagatgaaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctc

SEQ ID NO: 224662 - DNA, 2180 bp, Homo sapiens
  misc_feature (1532)..(1532): n is a, c, g, or t
cctcaatgtgcctgaataaatgcttgttcagacactggatgtgaagtccgattctccactggatacccaaactgcaggaggtaggtggttcccatctggacccgagttgcctaccagaccattgtcagaaacacagctggacgtgagttaaagtggtgaaaaaacagattttattcagtaactactgaaagtagggaaggagctgagcttattccgatttcggcagaggtgatttgggtgttttaaagaaagaatgagggagacgggaataaaggagctccgaagtgtcggggaagtgaaaaagtgcaaaggggagcttccggatagcgaagcacgtggaggttcctggagggtgtcctcccagagaggacgtggaaccttcccgctcccaccgcgcacttgccctgtgtatctcttccctttggctgttcatctacatacgtggtagtttcctttatagtaaactaataaacggaaatttgcagcagctgtgaaaaacttcaattttctgaatccacttttgatttttagtggcgattgcttaaatgcctcagttttaagtatcataacgaaaggaaagcatacgattcctatattaatgaatcggaagtaccttttgcagtttttgttttgctttttcagacaaggtcttattctgtcatccaggctggagtgcattggtgggaacacagctcgctgcctactcagcctcctgggctcaagcgatcctcccgcctcagcctctcaagtggctaggaccacaggcacccacgcactacaccgcctaactaatgttttgttttatattatattattttattttatagagacagaggtctcaccatgtcgaccaggctagttttgaactcctggcctcaagcaatcctcctcccacctcagcctcccaaagtgctaaaatgataggtgtgagccactgcacccggtgattttgcagtttttggaaaccacaagtttgatttcggtgtgaatattttggaagaatctatgaaacaaatgcacttcatctgatttctcagtaatgttgatgatagatttacttctgaacctcttggacgtgtgtatgttagaagttctccacccaattgatacggaattaaatagctgtgaaattactgtaagaagaaccgaagcaacgttggaaatttggtaactaatgccacgttggaagctattcatgccaatgtagcattgcttcatacaggtacttccagatctaattgaatacatccagtgggaaatttcgctttgcgtgattttttggctatccttctcataatggaccccagttttagttgtcagagtaacacaggcacagctgcttgaaggtcttgaaaatgaggttaacaaatattcagcttttggtgggagtttttctcaagttgttggaatagaatttggactcaattcagatgcggaactgggacactgaatgatagataacagatactgtgaaagttcaaggaccatacgaaaaaaatttaccttcttgctgctataaacaatatattgcncatgggaaagatagttacgttatgcctgatagttgttcttgaatgtttgacacagaaactgtacaagtaccttccacagtcatcatgaatcacttttaatcgataaaaattttgtagggaaggaagcagtgtctttcaggccattgaatgaatttgattactactacgaacaaatcatcattattaacagccttcgaggaagaatcagataagccatcagcagtaattgcagtacctggcatagaagggtgaatttgccatatttctcagcacatgaaagaacatttgtaccaacttagagccggaggggaacaaggtttaagaacttttcccgttattagtggtaatgcatctgaaaattttgattctgattgaaatactatatgggtaatatataatcaatgcccaactgaatggagaaaacctacactttttgcattgttaagcacagtaatataattttggctctttggcattgttctagaattaattttaattctagggatattgctctaaatgtgcttcttatcacttttgactcttcagtgtgttatccaggaaacaatatatatacacttgtgaactgttgtttgtgatttaagcatatatattgaataatgtttccagattaaatgacttccaagctcc

SEQ ID NO: 224663 - DNA, 551 bp, Homo sapiens
tctcaacctcaccactattcgcatttggggctacattttggttgctgtggagtctgtcctgtgcactgtagaatgtttagcagcgtctctggcctttacccgctgcatgtcaggggcacccccggccctgacaattacgaaaaaaaccctggccctgacaggaaacacaagttcccagacattgtcagatgttacctgggggacaaaagtcacctccggttgagagccagtgctctagaggaacagctttgatgtttgatcacttgttcatttactcagtgaacatttagagcacacccgtgacatgccatgtctgcatttatggagaaacagtcgcagggcattttcagtgacatccctcagtgtcctacgtgtaaaactctagtcctgagaaaaaccgctgcttttgaggaacgggtataggagatgcttcttagtgttttcttttttgccttgagtgccaggaatctctgctagttttaaaaaatacccttgatacatgttttcttttagtttaatacatgtcaactgtgaaaagtacagataaggca

SEQ ID NO: 224664 - DNA, 400 bp, Homo sapiens
aaggatcacttgagtccaggagttcaacaccagcctgggcaacataacaagagcctgcctccacaacaacaacaaaaaaaaaaaatggaaaagaaggaaaaaacccatcaagttgcccctaccttgcatatggctaggttgtgaagcaacacagccgcgaaacttctttgcaaagcacaagtgctagagccccttctctctgctatcgacctctgctccctctccaagcagctttcagggtgaaaagccttggatgacacatggggaagccaccacagctgcaggctgcttgcaaggctgaggacagcacagctctctagctgggcacttccctccacacccaggagtcagtcagtcagccagccagctgctctctgaccccctcaccacggggtcttct

SEQ ID NO: 224665 - DNA, 717 bp, Homo sapiens
gataaacatgagtgggaaaatgttgagatttcttttacataaagaatcttttaaaaccttactttaccataatccttttataatagatgttttattttattacaacaaccaaaatgtcattaaaacagtttattagtttagaataagaattattgtatcaataatagactatttagatgtcaaactgtaggaaaaatatgttatcaaaaatagagtagcagtttaagctactatttttttctgtaaaaccaaatttgtcagaaaatgcttctacagaaaaatttgaagtttgcaacattaccaaaaaaaaaactatattttctcaaaatatttttatttttgatgccttttaataagaaaccaaattatatagactttgtatgagaaagcattctttaatatatgtttttttgtttgtttttaaaaacggagtcttgatcttgtcacccaggctggagtgcaatggcgcaatttcggctcactgcaacctccgcctcctggattcaagtgattctcctgcctcagcctggccaacatggtgaaacccccgtctctaactacaaaaattagttgggcgtggtggtgcatacctgtaatcccagctactagggaggctgaggcacaataattgcttaaacctaggaggcagaggttgcagtaagtcgagatcacagcactgcactccaagcctgggcaactgagtgagactctgtctcc

SEQ ID NO: 224666 - DNA, 315 bp, Homo sapiens
ataagtttactggtgaattctaccaaatatttaaggaagatatgccaatttacaatagaagccaagggagtatttttcaggtctttttataagcaacattaccctattactaaaagcaaaaagacattatacaaaccagaaaactacagatcaatatctctcatgaacatagacacaaaaataattaacaaaatattagcaaatgaaacccaataatgtataaaaataattacacaccacagctgtgagatttgtttcaagtggcaaggatagttcagcattcaaaaatcaattaatgtaatctatcacatcaac

SEQ ID NO: 224667 - DNA, 859 bp, Homo sapiens
tcattctggatgcctgagaacttgtaatccaatgagtagaaagtttggtaccccatttatggctgtcaacctgccagttctcaggagtttgtataagcctaaatctgaaaggatctcatcccattaggacccttgtctccttttctgttgcctttgcccactggctatggcaacaggggtctttctttctccttggctatctttggatatgggggctccgtcttctgtgccaccttagggaatgccttttgcaggcatggctaagtcattaaaaagcctacagtttcagtaacattttgagtgagcactctctgaagctgcgttggaatctcaggcttctttgtctggaagataactcttgggctacaagtttcttatcctagctttggttttgaggcctctctgttctcctcttgggttggaagttattcctggctttttgtttcaaggggtctctgtgatcttgatcttgctgctttcatgggaacttctcagttcactgaattctcccttctcaaacctctgctgactatgtgttccaccaatatggaactaattctacttcttttcctgtttgcatgactttactaagaattatttacaactttaatggctcctttgagaaaatttttatcttccaaattgcctccttttagacctttcctttcccagttgagtctctcaactccctataatcactgaaacttcaggcaccccactccatgccttggaggctctcaatgtgctcaagaatctgcaaaagcaaacacctggggctgaagaataaaatagaaaaaaaattatttctcagcctccataagattctatgtcaaaaaaaagaaaatctttaaaatctcca

SEQ ID NO: 224668 - DNA, 440 bp, Homo sapiens
aacatggccaacgtgaactctgacctctgggtcctgaggctttccaaaggcatactacatccagtcttaaacctagactagggaaagcactagatccaagacataaatgtccaatggcaaaggctgttgtacacaaggaacaggctgctgtacactacctaggatgctgctgtttgcagcccttgcacaccaggtcccatgtggcttaattgattgtagaaattattttatatattaagtttttggggattcgtatcttttattcaggatagctaaatgcaatttatattagaccatatacagtaagttgtaaattatagaagttgtgcttatcaaaatcatattcagtgggcaatatggcctttaatataatgaagtttattgataaaaattaaaataaaataatgtggttttgtagtgctcttgtatgttaactaaaa

SEQ ID NO: 224669 - DNA, 381 bp, Homo sapiens
atgaaatatttgcttgagtatttgcttgaatgtgaaatattttgaacattttctgtggattctgtggattatagagattccataaagaaaatacttaatagatgaagcatttcatctgagctcagttatacttaaattatcattttcttaggatcctgacagaagattaaactaggaattattaaaaaacaaaacaaaacaaaacaaaaaactaccttaaagaatctatttctgctaccatgtatcttggctttatcacttaatagctgtgtgatcctttgcctagttgcttaactttcctatgtgttttttcatctataaaatggtgacaataatgttgcctacctcacagcattgttataaggattaagtaagtaatta

SEQ ID NO: 224670 - DNA, 281 bp, Homo sapiens
tgcaccacaggggggcagcggcagggggtaccagaggtaggtctccttgctggtcagcccccaaatcttcttagttctgtaaaatatgctgcttgaagcaaaagccttgtgtacagcacttagcttcatgcagcctctgtgaatcacaggttacacagagcatttccccacccttctgggaatgtggaaccaacccctgtgttgttattgttgttttaaccattctcaggatcctatcttgctcttaaatcttaaaatcaggcagatgaagagctttatcc

SEQ ID NO: 224671 - DNA, 513 bp, Homo sapiens
ggagatacaggagtatttgtgtacagccaaaaattatatcatcttttgacacatgctattgttgtataaataaatttatacaacaattacttatatagtgtatacataaaaactgtattgtttttattctgtcttattactttactactagttaaattttacctcagtttgagagggtgttctcagcttggtattgaatgtaccacctgtagagttcaagaccagcctgggcaacatatggagacctttcgtccctacaaaaaaataaaaaattagccaagcatggtggtgtgtgcttgtagtcccagctactctggagactgagatgggaggattgcttgagcctttgagattgaggccgcactgagccatgttcacaccactgctctccagcctgggtgacagagtaagaccctgtcaaaaaaacaaaacaaaaaacacctgtagcaatcattctagaggcattgctcgatgtcacagatatgaaatatccagttgggccggcaaagcaga

SEQ ID NO: 224672 - DNA, 163 bp, Homo sapiens
ggggggttcctagcctggagaagccccagggagagctggggaatgggtggtgcctctaaagtagtgtcgggggctggttgtgttctggggccctggggatagggcagggccttgggcagagttatgcctggcatatagagaactcttagagtcagctgtgagc

SEQ ID NO: 224673 - DNA, 424 bp, Homo sapiens
caataaaccatgcttttatgatttataacaacacatactatagtatttccatattaaaagactagagtgattttacaaaggaaactcttggtagacagtacttaattactacatatgatatgtatttcatatgcataattctgacatatttataaatcatgttacatgatatattcagaaactctttataagtgataactgtattttcttttcttttttttctttttttttttttttgagatggagtcttgctctgttgccaggctggagtgcagtggtgtgatctcagctcactgcaacctcggcctcccaggctcaagcgattctcctgcctcagcctccccagtaactgggattacaggcacacgccaccatgcccagctaatttttgtatttttagtagagacagggtttcaccatgttg

SEQ ID NO: 224674 - DNA, 95 bp, Homo sapiens
atcttgatgctacactaagcttagatttcagtgaatgtgagtctcagccactagctcagagccacctcccaaagaccaaatcatgtagggacaat

SEQ ID NO: 224675 - DNA, 458 bp, Homo sapiens
attcctggggcattatgagggttcccatgggggccaaagaagagaagatttaatatggtgatgtgttgtcataaaacatttgattgtttttgctcggattctttgaagatttagtctattatcgataagagaaacactaaagaactcttggttgtgtatttggccgctctcatttcggcaagtgtttaaatgtgtcattagacaaaaggtgctctgcaacagttggctctgactggagaccaaatttctctcaaatcaatccataaaccacttctgtcagagacgctctctgcacgcaccaatctggccagctcacaagccagaaattagatgtataactggatttcctctgagtcagccaatgctttgggttacatttaagcacaatctttctatgttatagcaagttccaaaggttgcagttctttttccttttctttccttccttcctttttttt

SEQ ID NO: 224676 - DNA, 364 bp, Homo sapiens
agatacagttctgtcctcatcttgacttttgtgtgggtcagagtgagttactaattttagaagtgttctcgtgaagacatctgactactcagcacacacaatcttaaggtctttgctgtaagaagctcaaccatcctttagcctccctggccagggaccctggcctctgcttttgtgtttcaagaattcttggttctggccctgtccttgattccctaatttccacagtttgacagcaccgaatgttgtgttaagcttcttgctaccatgtaaaaatttcctgacacctcttgcaataataattgttattatataatatataattatgtaagatataataaatatataataatcgtcattgtaa

SEQ ID NO: 224677 - DNA, 352 bp, Homo sapiens
ctcctataacatttttgggtgaaggagaactcaagactttttacagagaactgtgggctcagttatgatctcagcatctgaatggtctaggtagtatcaccattatctctggccctaggtttgccaagtaggatgaagactctaagtgttcctgctgagttgtccaaaggtcctgctccttagtcacctgtgcgaaatgagcagggagagttaaggcatagaaccaaactctttgggttattgtatgggtatgccagtaaattcagacacagagctggggtctgactgaatagaggcccaaaccagcaacttgtaggcagagcccagaatctcttgtgatagaaatacccct

SEQ ID NO: 224678 - DNA, 477 bp, Homo sapiens
taggttgttacagtggcgatgctttattatattttaagggatgaaaatccctcctctcctaccctggttattttctcttgcaaaaaatccaagtgaagaaacactgaactgaaatctggactagcctaatagactctaaagctcaatttttatatgtatatgtgtgtatttttgtctgtacctgaaatgactgctgtcaccatgcagtgattttaccccccttccctggcctcaggaataagccaagaaattctagttgtgcagaactgagcttgttgccccttcttgtactgatggaaatagtgccatgtccaaacaaaataaagaagctcatagctaattacatatcctaataccaccttcctataaaactttgccttaatctgtagtcattcctgcccccagctcataccctcctgtgggcagcttttgtttgctttacctcatcccactgttttgtgatcaccccccgggaga

SEQ ID NO: 224679 - DNA, 191 bp, Homo sapiens
ttattggtactgttctctttcaaacacatacctacatattagatttagttactttgggaatattgggctatttgtactatctttacttagggtgttttggaaaataaatattttgtgggttattagaattctgcttaaaacacctgtgaagtttgaagcttttgctgaatttattgattttttttcccatt

SEQ ID NO: 224680 - DNA, 502 bp, Homo sapiens
gaggcactgaacagccaaatacacagaagaacttgttcggttgacatccttccatcagcttctgctattggccacctggatgctggtaaaatgggcagagaggtatatcagccacaactgtaaactggagagaacaagagcctcctatcctctaggattgctgaaaaaggatatagtctctaatctgactttcatcagtaatgaagatcgtttttatttttaaatttgatctgcctactatgtctagtgctcctttgattccaaactcaaataggaacaacaccaaaaaacagtatgagttactgtccactccctaaacctgcaacactaacagaagagtgctatttcctccaataactgttcacttccttcctatgacacgtaagatacctatgagcaacccagaagggggctacaatagagatactgttagggctgattatgtatgattctcgaagcgctagcttgacctctaccttaaataaaacgtaaagatatacct

SEQ ID NO: 224681 - DNA, 228 bp, Homo sapiens
gaggcactgaacagccaaatacacagaagaacttgttcggttgacatccttccatcagcttctgctattggccacctggatgctggtaaaatgggcagagaggtatatcagccacaactgtaaactggagagaacaagagcctcctatcctctaggattgctgtatgtatcagatgaattagttcacgtacacagtaaagcctcagtaacttttagctatgataatta

SEQ ID NO: 224682 - DNA, 342 bp, Homo sapiens
tcacagacactattctgtcaccgcactcctgcccgcggacctgcaggcctgccgggtctagctgctccgcgggggtccgggaggggtcctgccctcggggacaaggtccaagggagctcgccggccacggcggagggtgggcgcgccggctgccacctcgccggagcccccacggactccccagccctgccggagtcggagcccgccactcgcgcctctcccgggacccgcgccgggctgcgcgcccgcttctcccggcccggccaaccccgagcccgcgcggggaaagttcctgcaacttcgcaggggggaggcggcgggggctccgggcctcggcctccc

SEQ ID NO: 224683 - DNA, 1374 bp, Homo sapiens
aagatgtcacctttgctaactctcctgcccccatcctgcccctctgctgggagggtgtctgcttctccccgccagccctcgatcccctaaacctccttctttcagaaggctggggaagcgaggcctggggagggaagggactcacctgcccggcagatggggtcctcacctgcccgctgctgccagctacacctccgttgcccaggccctgggatcaaaccctgcccaccagctcccctcgtccaaccagctgccacgtcctgtaaccaaaagtgaccgggatgaatgcctggctcccccttctttccagccctagctcaggcccatcgtccccagctgatgtcgccctgtctgcacgatgcctgggcgcctactccacactcctcactggcctcaggccccaccagccctgcctcgagctagcccctccacccgtcatcactcctgccagactccagatgtccaaggtgctccttggctcccacaagctctcctccagcaccccatcttcccctggttgcccctcggttccccacttccccagtttcccctcccaggttcaagcaattctcctgcctcagcctcccaagtagctgggattacaggtgcctgccaccacgcacagctaatttttgtatttttagtagagacagggttttaccatgttggcctggctggtctcgaactcctgacctttagtgatccatccgtcttggcctcccactgcgcccggccataaacttttaaactaaagcatgatctatcgatacattgcagagcttctttcctttagtatctgaaggtttgagtcaaagctgttttcccatctggaatcagttgcccatttggctatccgcccgagcgttgtggtttcctctcctgttcctggcctgcctttgtgactcactctggagatcaccttcgaggttaatggcttgtggaagagttccaagttttatctctgtcctagttggttaaacatcattttctctttttcaagcaagtgaaaagctttcaatagatagatgtttatttcctaagcactaaatgactcataaattaagtccctgtagatttggaaaaactccttaaactgtatctagaggtctagcacttcctagtaggatagacagtcctttctagatactgtaacttttttctgtaccgctttggagtacagtctttatgaagttgtttgtaagcaaaagggaatagaatttaagcctaaaggctgggcgcgatggctcacatctgtaatcccaatgctttgggaggccaaggcaggtggatcacctgaggtcaggagttcgagaccagcctgaccaacatggtgaaaccccatctcaaaatacaaaaaattatctgggtgtggtg

SEQ ID NO: 224684 - DNA, 540 bp, Homo sapiens
ctgttcaatatggttgcacgtagctatgtgtggccattgagcgtgaaaatgtgactcctgtaagttgattatagactaccatgtaatatagtcacccctcagtgtccgaggggtattggttccaggaccccctgcacataccaaaatccacagatgctcaagttcctcatataaaaatggcatcgtatttttatgtgatctacatacagcctcctgtatactttaaatcatctctggataatttataatacctaatacaatataaatgctttgtaaatagttgttatattgtttgtttgttttcttaacgttttttttaatggttgtattgttattgtttatttaaaaaatattttcaattcaaggttggctgaatctgcatatacagaacctggggatacagagggctgactatatcatacacattagatttcaaagacttagtatgaaaaaataatgtaaatatctcatgatttattttgaatatctgttgaaatgatatttttgatatattgggttacataaaatatattaaaatta

SEQ ID NO: 224685 - DNA, 725 bp, Homo sapiens
cacgcgggcgcacacacacacaccatcctggacggcgttcaagtcaagcacgagaaacagccttctgcaagggagaggaaagaaagctggaaatccagacagactgaagggctgcctgcttttagacttgactttgaccgccttttcttctcgggccaagaactgtggcagtgcagaaattacaattaaaaaatacataagactactcccggattgcttttttttttttttttttttttttttaactaaacacaaaaagcgacaccaaaacaacccctgagaaaatccacaaatctgtacctgagacacgtcaagtcagcggcccagggttctgttacagactcaagatctcttttatttaatgcaatacagtgcgatggtatgtggctttgaactgatgggttttgtttgcttcttttattcgttctttgcaccccctcctatccctggcacagtttttcttttcctgtttgtggattgcaaagtggctgttttacccctttcctaaatgtcatttttgttttacaggttgtgggctatagtgctgcatttgcagaactaatttgcaaatatgcattattatttagcgttggcaactttagtacatgtgacacactcttatgacgggaatcagtgagtaacattgtggtccaaacggtgcagaatctagcattttgttctgctttaactctctgctttatgcccctctcccctcagtggtggaa

SEQ ID NO: 224686 - DNA, 414 bp, Homo sapiens
caagctctctagcatgtattcttgtaagggcactaaccccattatgagggccccactctcatgacctctaaacttcattacctcccaaagatcccatctctaaatagcatcacattgggggtcaggacttgaatatataaaggaggtgggggacaccattcagtccatagaaaaatgcttcttatctctatctttaataccttcactctctaacacaattggaaacctccccaggggctccatgaaccgtggctgcaggctctcaggtactctatcccaggaccacaaggagttaatttgatatttccaccaatggagggtatcaggctctcattaagccattgtaaaatggatgtaataaaacaactgttttctaagattactgtaacaataaaaatatttgttaaaactaaa

SEQ ID NO: 224687 - DNA, 534 bp, Homo sapiens
cgtggctggagtggtggcttatggatcctctctctttttcctgtcttagggacataatgcttctgggaatgtcctggtgtcatagcaatactctttagggaccatttctgtgctttctgtaactttgtttaagcaacaaaaaagcaaaaaagctttggacttgctcaaagggtggctaatctgatacagataaagtgtggatgaaactcatttttagcctgtaactatgttgtaggatggaaaagaaaacttgcttgtgggtcaaaattttgtgggttagactctcaaatgaatcagttattcaccatgtgtccattgtcaaaacttatccttttagttgcagtttcttctctggaaagtgagcctaaaatattaatttgaaagcttattttgggattagaaaaggagagtgaattagatggtatctacgtcgtaaagggtcaggcacgtgagcagtgctcagtacataggacctattattaaaatatgatgaaaatactggttatggtgatttgacaaaacaaccttcttttg

SEQ ID NO: 224688 - DNA, 489 bp, Homo sapiens
aattttttttaaataatccaaatttagccaaacgtagttgacactgccttctaaaatgtcctgtatttcttagttctaggacaggcaattacaaggactataaatatggggtccagggctttcaatgcccttttaaccttttacaattaaaattaactgaatcttaaacattcagtttttcattccataattgtgagctggttgtgtgctttgtattgtgttggcaccagggatataaatgtgaaaaagcagacctggactctctctccttgcagcttacagtctagaggtggatacttcattacaccaaaacaacaaaaacaaaaaccgaatcacaccaaaccttgacacttcttgccatacgggggttttcacatttgcatcaatactattctaatagtcactttttgttggaccaatcagccttgaacttactgagaagggccacattgatcttaatatttgttgtgtagctttaagccttggcag

SEQ ID NO: 224689 - DNA, 394 bp, Homo sapiens
accatgccttgtgctgggcagtgggaaggtggggataattagataccgtcaaagaagtcaaataagtaatagctaagaggctgagacttatttactgagggcttagtatgggcaggccgggccctagtgctctgcgtgaagacacacatccagcacttgcagccctcctgttaaggactgtgtctcacacccctccaccacccatttttcagatggcgaagcagatcttcagggtggttgggaagtcaccttggttgcacagttgtggaagggtggagaagggatgaggtcctactgtggacagggcggggcagggtccagtgtgcattctggagcagctgtccctagagcctgccctcttcacctgccctgtccattagacacccccacagca

SEQ ID NO: 224690 - DNA, 719 bp, Homo sapiens
  misc_feature (447)..(447): n is a, c, g, or t
  misc_feature (643)..(643): n is a, c, g, or t
aattagcaagagcgtttaacaggttttctagatagaatacccatataggggaatcatgttcctgtttatatgccagcaaatagccactagaaaatgtaattttaaaaagttactaaaataatttattcaggaaaagttcattagtgcatggagccattaggtgaaaggttgataaaaggtgaactctacacacagaagagaccaggctgtcactgccttgatgcactagttaatcttagcctctttaagagtgagaaaaccaaggaccaggcatgaaccactgtgcccagcaacaactttcttatgtataatattcttggctggcagtttttgtctattagcactttgactatatcatctcattccctcctgatctgcaaggtttctgctgagaaatccactgattgccttggtggtggtggtaatggtggtgccgtatgttatgcnatcggcaccgtactggatcctggccaccgactatgatagctatgccctcgtgtattcctggtcctgcattatccaactttttacgtggattttgctggatcttggcaagaaacccaatcttcctcaaaaacagtggattctctatatccgattctaatacatggtgccagaggtgccccctccatgccttctgcgnaatgttcctaaccaaccctcgcattggcaaccaatcaccctccacagcgggtgcctacactgcccttgccctccct

SEQ ID NO: 224691 - DNA, 385 bp, Homo sapiens
aattagcaagagcgtttaacaggttttctagatagaatacccatataggggaatcatgttcctgtttatatgccagcaaatagccactagaaaatgtaattttaaaaagttactaaaataatttattcaggaaaagttcattagtgcatggagccattaggtgaaaggttgataaaaggtgaactctacacacagaagagaccaggctgtcactgccttgatgcactagttaatcttagcctctttaagagtgagaaaaccaaggaccaggcacagtggctcatgcctgtaatcccagcactttgggaggctgaggcgggtgggtcacttgaggccaggagtttgagaccagcttggcccacatggtgaaaccccttctctacta

SEQ ID NO: 224692 - DNA, 378 bp, Homo sapiens
aaaatgtgatccctttgacaagataacaagccttccattacctgctgcaggtgacccagtttgctggctgttgtgggtagctcagaacaggaccctaaggcaccttggccctccctctgctttaaaactcaacaccaaactgtattcattcttgtggtactgcctgtgtcttaacatgcatcccaacatctggcacagagcctggcactggcaacctcttaggaaatttgttaaatgaactgatagtgtagcattctgtcactttcctcagcgataaaattctcattcttcaaaaaattttccttttgcaactgaatttaaaaatgaaatacctaccacctaccacttcaagctttgctaggtgacggcttactaaaa

SEQ ID NO: 224693 - DNA, 467 bp, Homo sapiens
agctgctcgcctggtgttcctcttccctcactaactgttccttctcagtttctcttgccgctcactctcagctcccagagttggaacacgtcgtatcattgtctgcctttccctttctagaatgtaagggcctgcaggttagggtgtttgcgtcctgcactataatatctgcggtaaccagaacagtgcctggcacagcgtaggcccggcttatgtgtttggtgaatgagtacgtgcttaagtatccgcagccgtgggtcagtgtcggtactcgctccctgggagatctcatccaggttcacagctttcaatgacatgtgtgtgctcataatgcccaccttggctgctccttcctggttccatcctcttttccagttgcccaggtggcgtctctacatgggtgtctaaaagatctcaaacattgtgccaccgcactccagcctggcgacagagcgagactccatctc

SEQ ID NO: 224694 - DNA, 464 bp, Homo sapiens
ctctgtagcataaatggtgaatttctggatagcaagattctgaagcttttcaagtttattatagatgctttctcatctcaaataactcatcaactatggcatttttaagtaccatgaaagtgtgtgttatgttggtgtgtgtgtgtgtgtataaacttcagacctttaaaaaagtgatttctggccgggcgcggtggctcacgcctgtaatcccagcactttgggaggccgaggcaggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcccgccactgcactccagcctgggcgacagagcgagactccgtctca

SEQ ID NO: 224695 - DNA, 807 bp, Homo sapiens
taaaagggacagaggtgaaattttgagtgacttgagtctcttgcagtccctgattacacagaacctttctgggctacttggagcatcacgaatagtctttcctgtacttaccagatttcaagtattcataacttgactccctaagtgtacaagttgggaatagtacagggccaagttcaagtcgcatatgctgtactgttcctcctgcaaatgtggggaaagaagagggagatactagaggaactgaggctccacccattcattcagttgctctaagcaccagaggacttgtttcagaaaaggggagtgggaacgccctcgactttgccctcctccggagcatctctgggacgcagggagtctggctagcgttaataggaaaggttgctcggcagagctgccctggagtactgacttgtctctccctcctttgtcaaggtccatgtttttctggctcttcctgcacactcatccctagattatgagcgttaatgtacgaaatgtgcagagcaaattgaggccaactgtggcatcaatactgcaacttaaacttgacaatcatggtttgctggtcctcaaacaggcactgaaatctcagtatgggtatacgatttaataatcggcccctcccttctatttgtcggttttatgtttctatccttcaatagctgcactgttttctaatgtgctgtagagtttttgaaataatttatgcaagtatttggtttccatgtttacaatttatacagctttcctagcattttaaatggaaatgtcaataaatgctatgaattggtgtcaaagtga

SEQ ID NO: 224696 - DNA, 422 bp, Homo sapiens
gcccccccccacccctgcattacctgggccatggcacccacagagccaggtcttcccctttctgctcaatacccaggggcttgcagtaagaggaagggaagcccgtgacacagaagccagagtttgttaaatatctggggccaggtgagcagcagagtttgcaacacgctctagtagcacattactgtgaactccacaggccctgaccaggctgagggccccagggtggcctggggactaccttgggcttgaaccctccacccctcagcagaaggaggcttttatagaccagggcccaggggttatcgatatttatagagcctcagaggcagctgcttacatatgcaaaaaagacacgttcctggagctacactttactggtctctttcttgaaatacaaacttagttggcagtctctgagg

SEQ ID NO: 224697 - DNA, 263 bp, Homo sapiens
agcagttgtatttgtgattttctcagcctgattttaagttattctgttataattttgaatgttctgttatgcttccctctgtggtgagcatacgtcgaaagctgtacatttccttcagggtaacctttgtttccaacaggagagagttctcactaccacatccagccttgatctctttaacctaaattggaataagccagacagagctggggttcatgggacagatgggagcatctcaagtttagggttggggagtctcagtg

SEQ ID NO: 224698 - DNA, 343 bp, Homo sapiens
aatatcagttacttgattggtatcttctcctttgatatattaagtggacaaacatctaatgttttcctctcgaaatcatgagtttcctgcaagtgtttggggcttggtatccacgtttctgtaatcttctaagacaagccagaatctttttctgtttttatatttacacaggttttattgtgaaattgtcaggaaggatgaggcatgtttcactcattaattttcattgtcatcaaaacatcagagttacagtgcagtatcctgctattccagggcccacaggagctctgattgataacattctaccttcacaaaggttgtaatctaaatggaagaggctgga

SEQ ID NO: 224699 - DNA, 359 bp, Homo sapiens
gaatcagtaataatgcaacaattcccattagagctattttattttattttattatttttgagacagagcccactgtcacccaggctatcttggctcactgcagcctccacctcccaggttcaagcaatttttcttatgcctcagcctcccaagtagctggtgttacaggcatgcaccaccacattcggctaatttttgtatttttagtagagatggggtttcactgtgttggccaggctggtctcaaactcctggcctccagtgatccacctgcctaggcctcccaaagtcctgggattacaggagatctattttaaaaacctaataaggtatcatctttttggaccaacaaaggactt

SEQ ID NO: 224700 - DNA, 418 bp, Homo sapiens
agacacatcatttctcatgctccattgatgagaatttaagtcacatggctttatctcgactgtaaaggaggtgggaaatgtgatcaagtggtcagtcatgggtctctacagagctgttatcatggaagaaaggaaaacaggttttgatagacaactaggagtctaccacaagccgcttgcagtgcatagcgccatttttccttacttctcagcccaagagctggactctcccagtccccaggcctgtcattttaaaagaagaggaggagataagactgtacttatctgccatagtagccacctggccctacttcttggctttgtatagtagtttctccaggagatggagcttgcagtgagctgagatagcgccacggcactccagcctgggcgacagcgagactctgtctcaaaaaaa

SEQ ID NO: 224701 - DNA, 377 bp, Homo sapiens
ccatctaatgtcctacctgcacacggagatgatgtcatctgtctaggtattaggtagctatttgttagacgctcccccattcaacttccagaaggcctagatcatactgaagacaagatgggaaataaacccaggcaggtattaaggatcagcaaatcttgtttactattttaaaaaaatcaaaacaggaaattctgttcatcaaaaatatgatacactaggtggaaaagatgaaccacataatagtagaagatatttgctacatttttttaaagtactcatgttcagaatttataaagaaatgctattcatcagaagttggccaatccagcccactacctgtttttgtaaataaagttttattggaacacagtcac

SEQ ID NO: 224702 - DNA, 516 bp, Homo sapiens
ctgtaatcccaacactttgggaggccaaggcgggtggatcatgaggtcaggagttcatgaacagcctggccaacatggtgaaacccccgtctctactaaaaatacaaaaattagctgggcatggtggtgcacgtaatcctagctactcaggaggctgaggcaggagaatctcttgaaaccaggaggcggaggttgcagtgagtcgagatcgcaccactgcagtccagcctgggccacagagcaagactctgtgtcaaaaaaataaaatagaataaaaaattgtagcttgtttttcttcacttcataatatgaaggcagcaaacctgaaaaaccacaaatcatcttgaagcaaagttgtcagggttcccatagacacagatgagctgatggcacgtgctagagtacccacagataaagacctgggatgcgtgccaagctcatctcaactcagcagaaagcatgatgctgggttaggtgctgcatttccccacatctttctctctttgccgtattccc

SEQ ID NO: 224703 - DNA, 327 bp, Homo sapiens
tccgcattttcacgtgttagtgttgaaatcatttttacttcaggaaaccaagggttggacaatggcttccagactttctcctttcgttatgctccttcagcgccttatgcaaataccggttgtcttatgctgccattcgtctcctctgccagaatgtgaggtccgcgacagcagggataagaatgcattcatttttatatctgcagtgccttggagagtgtctgacacatagtgggcactcatttagaaaccaccaattgaatcattaaggtgaccaaaaacagggtgggggaaatacgtccatcagacaacagggaaatatttctt

SEQ ID NO: 224704 - DNA, 464 bp, Homo sapiens
aaaagaaaaaagaaaaattatctaaattttaaaagcagaagatagccaaagaaaatttatattacctcccgaagagctgtgactacaggtgtgcaccaccacgcccaactaatcttttgtatttttagtagacaaagcattttgccatgttagccaggctgatgttgaactcctgtcctcaagtgatctgcctgcctcagcctcccaaagtgtagggattacaggcgtagccatcacacccggctgacatgctatactaacatttgatacctaattaaaaatcagactcatcttccacaggaaattcctacaaattctccatcactagggtcagttcccagggactagaagcttaaaatatgtcccccaaaacagcccctacatgacccttaggcaactactaatctgctttctcattatactttgtagttttgtgattttaaataaatagaagcatacagtat

SEQ ID NO: 224705 - DNA, 451 bp, Homo sapiens
gcagatgaggaaaataagcagatcttctgatatcagaggagtatgatagagagcagggagaaccaagaagtcctgggagagagatgtcagtctgaactccatagaaatagctgcatttagtcttaggcctcttatttgcctgagaggccttaggcagtagacacatcactcacacctgtaatcccagcactttgagaggctgaagtgggtggatcacctgcggtcgggagtttgagaccagcctgaccaatatgatgaaacctcgtgtttactaaaaatacaaaaattagccgggtgtggtggcacgtgcctgagagaggaggctgagacaggggaatcacttgaacctgggaggtggaggttgcagtgagcctagattgtgccactgcactctagcctgggcgacaagatcgaaactctgtttcaaaaaaaaaaaagaaacattgttatg

SEQ ID NO: 224706 - DNA, 307 bp, Homo sapiens
gtagatttgtggtagcctagggatggggaaatgacagggaaggagtcgtgactgctaatgagcccagggtttcttttagaggtgataattgcacagttctgaatataccagaaaccactgaataatagtcgttgggtgaattatatgtgcagttaaaaaaaatcaaacctagccaggtgggcgtggtggcacatgcctgtagtaatcccctgtagtaatctcgggaggctgacaggagaattgcttgaaccctggaggcagaggttgcagtgagctgagattgccccactgcattccagcctgggcg

SEQ ID NO: 224707 - DNA, 411 bp, Homo sapiens
ccaagaacaaggggggaataagttacaaataagcagttagtgaaataagtttatcttcattttcttgtactggaaaagcatattcatgagaaatagtgacctgatacagtgctcaacagatactgaactaatcaaatggatttttttttttttgcctcgaagaagttatgttcatacctttatatttctttgtatttctgccacatggtagtggtatcttttaaagtttcatttattcataggctttgagcctgtttctccatgcaaacctagaaggtttattgcattctctcaacaaatacttactcagtgtcttgtatgggccagatactatgcttgatactgtggacacaccagtgaataaaacacacacacatccctaccctcttgttgataacagtctatagggaa

SEQ ID NO: 224708 - DNA, 427 bp, Homo sapiens
acagccctagcatgcatcatatttaatggtacagtattgaaaagttttcccctgagctattagcaatgttgttttccacagagatggcctggcaggtggcccagggctgtgtcccttgtggggacctggggctgcgccacccccctgtggccacgggagacacagggtaggagccgtacaagggaaaaacgacaaatcagactgcgctgaaattcagaagttctgttcaccaaaaacgccctgccgagagtcaaggggcagccacagagaatgagaagatattgacactaggttgccgacacagtaaataatggctgaccagcatgagggcagtactgtcagaaatttctttgagctgtgagatggatttatttttaaatgctactttgcaaaggtgacctttaaaaaataaaaggaaaataaagaa

SEQ ID NO: 224709 - DNA, 391 bp, Homo sapiens
tagagattaatttggggaaagttgacatatttacagatggtcaatatttcatattagttataactataaattagattctagaaatctgggttttcttaacatgttaaagaatatattaaaaattaaattttttatatttttccatgtcccatgtttttaaaaatatttttccatgttcaaataaagttgaataatgaagtataacatcgttcctaaaaaaataaatgtaaacggttactttgaaaacaagctgaaacaaagtatttagattgctgtttatctcaaaaagtgtttgtgtcttaagcacatactcaaatgcaaaatgggaaacagaacctgccaaactctatgcttagtgtttgtcccacccaataaaccatccacaaaaatc

SEQ ID NO: 224710 - DNA, 453 bp, Homo sapiens
ctgtggtaaatttctagtgtatgaatgaatggataaatgaatgaatgaatgaaaaaggaaggaaggaaagaaggaagaaaggatggaggaagggacagagggaaagaagaacaaaggaagagagtagggaaggaaggaaggaaggaagacatggttttgaaaatgggaaaaaaatgctgccagtatgattttcttgatgtagtttgtaatgtggtaggagggagagatttgattgagcactcttctatttctgaataaagaaggttatggtaacaataatgtaaatggatgggtgggagatgaatagaggaagtggaatgataatcagatactataatgaggaagtcacattaaaaataatgtgtattgattgtttcctttattacagaaatgtttgttgtagaaaataaataaaaattctctatgatcccattactatcaaataaccactgt

SEQ ID NO: 224711 - DNA, 270 bp, Homo sapiens
cttgcactttgcacttcatgaatctcctacagccaggtctcagagccaatgccaaaatgttgacatggtccagcccattatcataaactgtggggtacacactatctttaaaagacttccagcaaataagagtcaagcccattgatcctttgggcattggtttcagagaaccttgggttactgagaaatgtacttctgcagaacctggccctgtgtattagtctgttctcatgctgctaataaagacatacccgagactgggtaatttat

SEQ ID NO: 224712 - DNA, 567 bp, Homo sapiens
tgcagtaacacacagaaagccttattcaaacaaataagctacctccgattgttcattcaacaagcatgtattaagaacctagggtacaggaacccctccaagggctttaattcggctgaccagttgctcacttgcctagaagtctcagtgtatgcctatcaccctgcatcctgtctggtttattttgtcctggatttttcatttctttattcaaaatacaagtagttattactaagacttattaaaatgagatggaagaattggatagactttcactttctatttcagtggtctcatctaggaacatatgaggttatgtgcagtgaacagagttagcactttaagacataatgtcaggagttcaagaccagcctggccaatatggtgaaaccccatctatactaaaaacaaaaaaaattagccaagtgtggtggcacctgcctgtaatcccagccacttgggaggctgagggaggagaattgcttaaacccaggaggcagaggtgcagtgagctgagattgcaccactgcactccagcctgggcgacagagagagactccgtctcaa

SEQ ID NO: 224713 - DNA, 401 bp, Homo sapiens
acaggtgtgagccactgagcccggccaagatctgaaagttttttaaggggcttccccttcgctgggcactcattctctctccttctgccctgtgaagatgtgccttctgccatgattgttaagtttcctgaggccttccaagccatgctgaactgtgagtcaattacacctctttcctttataaattacccagtcttgggcagttctttatagcagtgtgagaacagactaatacagtgggtttatagttttcatcaagtttcatctaaatttccagctatttttttgagattttttttctgtgttcctctactacttctcctctgaggattccaattttaagtatttttggctacttgaagtaagatctaatatttgatagtacaacagtgtgatgatag

SEQ ID NO: 224714 - DNA, 419 bp, Homo sapiens
ggaattatttactggtagtattgagtctgtgagattgtagtatatactgaaacaatcttctggatggtggtaaggtcttttttagcaaacacagtaaagagcttatttcatttctgatgctttcaagggcatattccaaagtatcacagatgtcaaatagaatatgctatataaaccaaaaatgtgcatttcagatgacctattacagcaatctcagccaatatgtaatatcacaaaatgtgtcaagtcaatcatataagaggatctaatcattcggctgtatttcatgtaccttcatgttgttgatatattgtgaccacaggaaataggtgccagagcatatgcagttaagttacaggctccacgttgcctaggagggaatcataactacatcagaaaatttttaacagttatatctt

SEQ ID NO: 224715 - DNA, 408 bp, Homo sapiens
tgagatctgcttctccccaagcactgactcctggggcctcaggaggttagagagtatgagtgaggttttgggagggccagcaagccccgggctggggaagtgcagcagcccagcacgaagccgcctaggcagtggtactgtcctggtgctgtgaggtgagccgaggactctgaacactgtcgaggatgccaggagcctcaacctgggacaggcaaccgccccagcccatgcgggtgcatagggggtgcagagaaatgtttaaacatagaaagttgtcacttggggctgggcacggtggctcactcctgtaatcccagcactttgggaggccgaggcgggcggatcacttgaggtcaggagttcgagaccagcctggccaacacagtgaaaccccatctctacgaaaaa

SEQ ID NO: 224716 - DNA, 446 bp, Homo sapiens
acttaagcaaaaataatgatatagagtggggtttttaatatagataaaatgaacatttatgacagtagcataaagggtgacatgagagaatcagaaatatacttggccctccatatacttggattccacatctgtggatgcagtcaaccacagatcaaaaatatttgcggcagggcatggtggcttacacctgtaatatcccagcactttgggaggccaatgcagaaggactgcttgagcccaggagcttgagaccagcctatgcaacacagcaagaccccatctctacaaaaaataaaaaagttagccacgcatggtgcacttgtagtcccagctgctcaggagacagatgggaggatcgcttgagccctggaggttgaggctgcagtgatccaagattgtgccactgcactccagcctgggcaacagagggagaccctgtctca

SEQ ID NO: 224717 - DNA, 485 bp, Homo sapiens
cttcccttcagccctgcgtattttaccacggataaacggtgttccattatgcgcctgctctgtcccatttccgtagtgtcttttttttatgacaaagcacagctggtcaaggtgttatcatgggtctgagtgcacgagtgtttgttgctgcacgttccccatccagtcactaagcaagacacagaactgtatgaaagcttatttttacttagtttcatcttagagtcacatttgaacttgtgagtttcttttaaatgaaactgtgtttaattttgagatttgctgctagggggaggactccttacgctttttgaagttagtaacagccctctctagtagaatgtgcacaaaaacggttaatgtgaattggtgggcttgtttctgtgctttgttttgagtgataatacaagggcctacatcatagggggttttcagggttaaattcattcatttcaaataaaatatttagaatgatgtctagcaca

SEQ ID NO: 224718 - DNA, 330 bp, Homo sapiens
gtattggtttcttttcattagtaagaatgaaaatagaattttaagaaatgaacttgtacattgtaaatcacatttattttaagaagtattgggtctcatgtttcgttttcttaggctgtcagtatagtggtggttcttcaccttttagggagtcagagacctctttgagaatctatagaccatttctccagaaaactggacttatgtagataggcacaaaattttgcttataattctaaagcattccgtggacctctgaagttcttctgtggaacttctgagcctctgattaagaatccttgaggtaataaaaatgtattggtctcgtat

SEQ ID NO: 224719 - DNA, 526 bp, Homo sapiens
gggagattccgttttgaacacattgcaaattagatgcctggaggcatccaggcaacgagagacacctcccttcgaagcgtgtatttagcctgtcccccatcttcctttaattcttattgctgtcctatttcataacctcataattgcagtttctaaacaaacattttttagatttatagaacagtttcaaagatcatacagaaagtcctcgtatccccttcacccagttttccctaatgttcacatcttacatatcatgatatatatttgtcgaaagtaaaaaaattgacattgagccaggcacagtggcacgtgcctgtaatccaagctactcaggaggttgaggccagagggaggatcgcttgggtccaggagttcaaggccagcctgggcattgtggtgagactgcatctcgcaaaaaagatattaacatcagccacatactgttatctaaaccatacacttttatttggattagttttcttttccaggatccaatccaggatactacattgcatttaacata

SEQ ID NO: 224720 - DNA, 193 bp, Homo sapiens
ccgggcatccagaacccataccggggcaccgtggtgtggatggtacctgagaatgtggacatctctgtgaccctctacagggtgagtctctagccctccagcatggatggcaattgcaacacaggcagttgcaacaattgcaacacaggtctcctggtaggttgttcatccagatagaagaggatgcgggggg

SEQ ID NO: 224721 - DNA, 690 bp, Homo sapiens
gggaatataggacaagtcagaaagtccaagcatgttgtagatgacctatgtaagtcacgataaagtttatacaagagaatttattaaaatttagatgtaattagccataactgaaaggaaatttatttatttatttatttatttatttatttatttatgatttattttgagaaggagttttgctcttgttgcccaggctggagtgcaatgtcatgatcttggttcactgcagcctccgcatcctgggttcaggcatttctcctgtctcagcctcctgagtagctaggattacaggcatgcaccaccacacctggctaattttgtatttttagtagagatggggtttcatcatgtttgtcaggctggtctcaaactcctgacctcagttgatccacccaccttggcctcccaaggtgctgggattacaggcatgagccacctcatgcacccagccaggaaatttatatataatactctatctaaattttggtgccctatgttaaaacaagtttttcttcaagtattggtttgctttcagtaagattgcaagaaatattgacttttaattctagaatctgtttcctttgaaggcctctcagatttatatcttttccttttcccttgaaaaggtatagcctttgcaagttcaaaactgacttccctagactccttttaggaaaagcaatacag

SEQ ID NO: 224722 - DNA, 155 bp, Homo sapiens
tctaatgctgtgtatatccattaagggtaatttaaagcaattaaatgctaacctggctggacagccaggtgtaggtttgtggcatccagaaagaggagatggacttggtggattctgaattggtcagttccacctcttcgtgttttggaggcttt

SEQ ID NO: 224723 - DNA, 726 bp, Homo sapiens
actaagaggcaacgtcaagggaagggtgacattctggtaaaactgatttgacaggattcttgctgaaggcagaccaggatgatcgaatgtcatctggaggatggtggaggatgatgaatttgattagatgtcaagagtggaggattcttgctaaaactgcaagaaatagttttgtgatgcaaagatgaatacaggagctcaaaggtcaagtcctggttaagtagagggttcagaggaatctgactaaagtgtggccaaggagagattatttgtcaccctacctattatccctagcacactgtggtataattggaagaaaatttccaatcctcttctccctcaagagagaaaaagagaagggaaccaaccatgagtccaatgcgcaggccttttgacagttcgcccaaggagcagatttctatctctcctgacttggagtgctgatggaaacagcggtttaaatgccaggctggggtcactgagatcaaaggtgagtgccacagcttgttatggcaacaataagactgtagtaccacagacagacaccaaggggagcaagagattatgggctgcagaaaagaggcaagcaaacctttgaggaattatatccacagcccagaaaagacttattgccaaaaagaagttagaaaaagccctagaatctctagcgggttgactggtgaaggtcttaccctgtataaagccagcctgaaatgcccaacgctt

SEQ ID NO: 224724 - DNA, 562 bp, Homo sapiens
ggttacggattgaacactgaccttttctttcactcttctgcaagacaaccccataagaaagctgaaacctgcttttgtgaaagcctatgattactataagacaggtgagcaaaacagaatcctagataaactcagttctttccagtgtggtgtctttgatggaaaaataaaataaaagccaatgtgtttggggtttttttcttttttactttatatagatttagggggtacaagtatggttttgttacatggctacattgcacagtggtgaagtctgggctttgagtgtagccatcacccaattagagtacattgtacccattaagtgatttcccatccctcttgccctgtcaccctcccacccttctgagtctccagtatctgttatcccactctctatgtccatgtgtacaaattatttagctcccacttataagtgagaatgtgaagtatttgacctcctgtttctgagttatttcacttgagatagtagcaacaagggtggaagtggaggccaaacctcaattcttaaagcaataaaagtgtggtaaacccttgtaca

SEQ ID NO: 224725 - DNA, 786 bp, Homo sapiens
gatggtagagaaaaagcctgattggcatgggttcaacagaagatgggaggaaaagaactcggagcagtgaatagagacaacattttcagaattttttttgaaagaggggcagaggattggaataggagctggagagttgtatgggtttaatgaagatttctttttttcttttagcttaagactagatatattttgacatgcttgtatgatgatgagaataatctagtagaaagagatcattgatgatgcataagagaggtgacaattgctagagcaatgtccttgggtagataagagagcatgaaacctagagctaagtagggttgaccttcaataggagcatggacaaatcaggcatcgttgcaggagtaaagacaaactatccggattcagctgtaagtatattggaaaatatgatggtagaagcctgtgatgctcttatctgattgcctctattttctcagttcaataaggaagcaaattcttcaactaagactaggttagggaagcaggaggtttggagacttcaaggcaacagaggatgtttggacttgggaaacagcagacttgccaggtagcactaaggacccagttgacattactggtaacaaattttaagtaaaagcacttagcttagctgcgtgttttcctccagctggatttagcttcctgtctgcttgctacatggagagcagtgtttagagtgatgaatcaggggatgtcagctggtaaaggacggtgggtggctgaggcatgtgggaacacaagatcattggaggacagaag

SEQ ID NO: 224726 - DNA, 420 bp, Homo sapiens
tgcatatgggaaatgttgaagcaaaagcagtgaacaatgactcaagtttctggccccaggggtctggattgcagtgctgttcaagaggtaagagttacatgaggagagacaactttggggtagaagatgcatcacttctagacaaattgtgttcaggtgatgtctagcagatagttggatatgtgagtatggaggatgggagagaaagctgagatgagcggcacactgaagcttttgagcctcagtttcttcattcgtaaagtagacttcatttgtaaatacccttgcagagctttagtgaggattaaattagcttatgtaaagtgcttacacattgtctgacagtaattttaacaatgatcattatatgttaatttataagctctacagtatgataataaatgttggaaattagtgtta

SEQ ID NO: 224727 - DNA, 410 bp, Homo sapiens
aatgagagggaaaaagaaaggaaggaggataggaagaatggaattagaagctggtacagaaaagtacaaggtaatttagaatttctgaagtagttgactaagtggaagtactactgtgacatggggtaagattattctctaagcctcagtttgcttatctggaaactgaggaatatggagataaaaatatttgctttgataggcctaaaagagatattgtgaggaccagttgaagtagtgaataggaaagggactttagttaaaaagggaattgctgttctttcagctgaagagtcctgtcagtttgttcacggtttttaaatagatggtctgaaggattaggatctttccctctttctatttaattttggagcaccacccagggcaacatactgagacttggtctgtac

SEQ ID NO: 224728 - DNA, 445 bp, Homo sapiens
gactgcttcattggaataatctgaattacacaccacacctctccacagattttataattaagctcaaacttgtaacagtttgtaatattcttttgtaagaaatcaattttcctggaagaaagagatgtttagttttgggcaccagtgttgtgagatcactggaattaaggcaaacagcaaaacccatagtatttgtataccatgatgagacagccaaatgcctaggcagataaaacagtgtccccagagaacctccgacccaccccacaagtgttgacatcagatgcttttgtgcagatgagggaacctgcccagggcctcgtctgagcctgcccacacgtgcactgggggaacggggtggagccacaggcagcgggaggagcctggctcttcagttcttgtgtggtgacctgggattcaatctgtgaggtgggggacttgttag

SEQ ID NO: 224729 - DNA, 638 bp, Homo sapiens
gaagtgaaggaggagaaagagatgagaggaaaggatttgtttcctgtggccacagctgtagccctggtcctcaggaagccatattcaggagggaaggggacatggagtcaatagccctccttgtgccagctttacccatctgcaggagctcgcggtggctgtgtgcagaccgtgaattgacactgctagcttccagtccccaccctaacactttccagctgtgtgatcttgggaaggttatttgatctttttttgcctgtttcctcatctacaagaattaaataataaaatatccctggttaggcattcactaagtgttaattatttatatggagttgattgcttaactagtgtaaggggccatctggtatatttctgttgcttcagcgtaattattaataatgacctcaaaagagccctgctttggttgatttggtcattctaccagccctcagaccccagtttccttgtctgaaatggaaggagtttgcttgagcagtgattctcaaagttggtcctggggccagcagcctcagcatcacttgagggtggggccagcagcctgtgtcttctgaaacgtgcccaggtttgaggactgttcccttcatcttttatagctactgctttaaagttcacta

SEQ ID NO: 224730 - DNA, 539 bp, Homo sapiens
catgttgggcatccccgtaattgcttattgtttattatccgtctctattaaaaatgcccaaattagctgggtgtggtgggacaagcccatagttccccgccacttgggaggctgaggcaggagaattgcttgaaccctggaggcagaggttgcagtgagccgagatcatgccactgcactccagcctgactgacagagtgagactctgtctcaaaaaaaaaaaaactcagggccaacagcactataattcgtgtctgaatgaagcttatctaacacctcccatagttcttgcacttagcaacactagaaagcacttcagtactacacgtggggacccaagaaaatgtacaaaaatgaaaaaaatgtggcactaactgcatcacgagaaagccttgtttagtgtgtgtcaagcaactcaatattcttgccactcttaattttgatttgaaagtaccacaaatactgatttgggggttacagataaattttagtgagtaggcagattcacagataaagactgaacagtgaagactatttgc

SEQ ID NO: 224731 - DNA, 496 bp, Homo sapiens
caaaccccggcctcgaaggtcccactccgtccctttccttcctttgtgttcctggcctttttacttcccttgcttttcctcttgggcattagagtgggttcagcccaagcagaggaatttatatttttattccacctgggcgacagcaagactctgtctcaaaaaaaaaaaaaaaaaaaaaactcagggccaacagcactataattcgtgtctgaatgaagcttatctaacacctcccatagttcttgcacttagcaacactagaaagcacttcagtactacacgtggggacccaagaaaatgtacaaaaatgaaaaaaatgtggcactaactgcatcacgagaaagccttgtttagtgtgtgtcaagcaactcaatattcttgccactcttaattttgatttgaaagtaccacaaatactgatttgggggttacagataaattttagtgagtaggcagattcacagataaagactgaacagtgaagactatttgc

SEQ ID NO: 224732 - DNA, 566 bp, Homo sapiens
gattctggatcttgcctggctgggaatgagggctccagcagcaaggcttagggtttgaaggggaaatagtgtgtgtgttttaaggggctcagggggagatgtctttggatatacatgaagagtgcttagaatagtgctaagcactcaataaattttagctattaacatatataatgtactgtgccttttgttataaaacgcagacctttaaatagaaactagaagggccacgttcttggaaaaaatgttcagtgttagaagcagtaattatgtattaataattatgtaagtgccaaatttggagcatgcacataatgttgatctctctctacccctcaccctttcattcccttaggccattttggaggaatacattttaaggcgggaacctcggatgtgttacgtaacaaaggccttcttgtgttactgtctagtggatcagtaggcaaaaggaagaaacacattctcaaagcatggtcagattccttaaaatgtacttagataagggggaaaagggtaagaaatctagtaaaggtgtggtgcatgctaattgatggggaagacaa

SEQ ID NO: 224733 - DNA, 234 bp, Homo sapiens
ttggaggggttcttatgcaggaatatgtaatgagaacacccctaatgacctgagctcaaaccagaagtattatttaatcccttttctgtaaaaaagtagaaatttaggttcttgatgtgctctttatggcagacagaaatgacaagtcagagtgttttaaactctttgtttccaggctactgggtgaatataacacaggagatatttattcagggcctctgggaagctagagaa

SEQ ID NO: 224734 - DNA, 497 bp, Homo sapiens
gagacagtcagattccacagagcatgttttggtgtggattggatgagttaggttctgtattgccccacatgaccttttacagacatggggacttaaacagtgtattttctttgtctctctgcgttagcttcatcttcagtgatgaaatcttgttgcttcctgaagcattaaattcagtgagttgagagtggccaaaatgtcttttcagagccaccaggtgtaggtcacacagaggggacagaactcttcaggtggctcaagtctcaggagcaatctagatacagggagaagccatttgtatcccactgagtcctgtgatgctgcacacacacagctgagatttacagaggccgggcggggagggctgctgagagggggtaatggcatgacctgccatgctgcttcagatgcctgggagactgggtctgtgccatttgcatatgtcctctgtacccattcctgatgaaggatgcaattgactcaactcaagcaggtca

SEQ ID NO: 224735 - DNA, 374 bp, Homo sapiens
aacgaaagaggaacagggcctgacaatgttcagagaaggaaaaccgaagaagtaaccatccccaagttaaaaatgacgtggggatgaaaaaataggttgcctgttgtatttgtcattgaaatgcacaatcttgtttactgtttatcttgagactctgggagctctcctgctgcttaggaaaaaagaggcaaaggtttaggaagaaatgctagtcataagaaagagaggcattagaaaccctagagagaatgggaggtgtaaatagtatgtgggcatttggcaatcaccacaaagaaatgggagacaaaggcaagtgtctgatgccagaaatcctaaaaacttgagtggaaaacccagacacaataaaaatgtcc

SEQ ID NO: 224736 - DNA, 427 bp, Homo sapiens
tcagcaaaggggcagggcctggctttgctacaagatagaggactagacaccaggcccagggtgtgagtctgcctctgctgtttaccagatgagagagacctcagccaatcagcagcctccttcctggatggttgctgctcctccagacctgctgcgtttcatcacctctccagcacccaggctcaggacgtgcagacacaggggtgctctgaccggccctgccgagtacagtctctcctgtagcatgccggcctccacctgcgcacacctacgtgacatgaccagaaccctccttggcccagccccgcccatctgcaaggaaggccccaggatacaatggaacatcgggcccttttatttccaagtctttctttttgtcttctctaaaataaagcaaatagctattatatagctagaaatagtacaa

SEQ ID NO: 224737 - DNA, 395 bp, Homo sapiens
ataactcctttgctcggatttcttgctgacatttctttttggtgggagtcaggggtgggagttcactctgaatgcttactatacctcctgctacagctctgtggcattttcataaaataccaaccaccaaaattctagtaatcacaaaaacatgtgctttctcctcatatccactgaaattctttctctcattaaaaaatagaagtctcagaaatgtaattagaaagctaaactcgatatctttacattcctttggtttcaaggcgggggaagaaagctgcagtttttctaatttcccttcagttcaatgctactcttgaatggggaaaatgatacaaaacgtctgaagaattgagagtctgacaagaggggaggatttgtatttccttgttatt

SEQ ID NO: 224738 - DNA, 759 bp, Homo sapiens
  misc_feature (674)..(674): n is a, c, g, or t
  misc_feature (682)..(682): n is a, c, g, or t
  misc_feature (737)..(737): n is a, c, g, or t
gagagtccgtcagtccgggacgaggtactgagaaacttttttttttgtacctttaattggtgcgttcggctgaaaggcggggcctggtaaaaaaaaaaaaacagaactgctgctgaggcggaggagaggacttaaggactatgggtttatcctctggccggaccaaagagaagatatttactccagtgagtgcgaagtgagtgcctcgttcacacccacagtcgcgccgtcccctcttcccgctctggggccagcaactcttgttagaatgcagatgccttttgtccatggactgtgaggcagcagacactctctgcgtaggatcatcatgccgagcataaactggactttcccacttgcctggcaggagtcacacagatccctgcgtgctaaatgaacatctgaggtctttgaggaatcgccacactgttttccacaaaggtcaaactaatttacactcccaccaacaatgtacccttgaatcctgactattggagaaacagcaccatattttggatactgattcagaccatatacagccttctggagaatcttgccccagtcctgaaagttctggctcattgtataagagaagtttgctgccttagtgagatttgttttggtatcaggatgatgctggcatcataaaatgagtatttttcttcagacttcanactgctgngctggaagcaagaatttcaagcattggatcttagcttgctgggctccataggggnggggatccactggagctagacc

SEQ ID NO: 224739 - DNA, 393 bp, Homo sapiens
gagagatgaattcttgctctgtcacccagactgtagcgcagtggtgtaatcatggctcactgcagcctccaactcctgagttcaagcgatcatcctgagtcccagggattacaggcgtgaatcactgcacctggctacctctgagattcttggtcagtttctgcagccaggctgacaggcacctcaggtgaacaaaagggtaaaaacctggatttggccatgagactagccctgggattcctggaacacttgaggctcctaaggacttcaacactgtcttccccaggggagtggggagctcacaggcagctcttaggtgaatggaccatgccctgcaaggcctctcccaaagtggaaagaaacccacagaggtacctgcagctctctgatccc

SEQ ID NO: 224740 - DNA, 411 bp, Homo sapiens
aaaaccattgactagtacactttaaatgggtgaactatatggtatatgaattatatcttaataaatctcttggaaaaaataaagaatacatctaacaaaaaaaaatttaagggatatttattccttttccaattgttataataaaaccaggtggaagagaatggttgtagcagttagaaaaaaaaagaatacaaatctggggtttggccattaaaagttattcataaaaatgagagaagaaaaggcaagaagaagttatttcacattacagacctctccctggccccaaagcctaacatgtgcttaccgagtcaaaaaagagacacagttgattcacaagctgaaggttggaacttgaatagaaccctaggcagggcagtgcccccctgcccggcccaggtgccactaggc

SEQ ID NO: 224741 - DNA, 400 bp, Homo sapiens
tcttcagaccctgcctgtaactgctgtgagaggaaggtggtgttatcctgatccacagggcaagaaacagtgctcagagaagtgcaataacttatcaaaggccacacagcaagtaagggggcaggcagagctggaacccacttagctacagattccaggcccctcttctctttccttttcggcccctgttctctttccttttcgcctagaaagttgcacttttagaaaaatctaatttaaaaaacatgagaataatattatatatagtgtaactgagaagctcaagatgtaacatatttttcaaattgtcttttccaatcaagacaagaaaagctaaggttgtgagatgacaatactttggccagtttgattgaataaaaggatattcaacccactaaag

SEQ ID NO: 224742 - DNA, 390 bp, Homo sapiens
gcacgagtgaagagtatatggaattgcttctttctattaaagccaacctacattggcaaaaagtgtggagaaaatcagtgtgctcaattctttttgtagagtttcatctaaaatgttgcaggtaaaaaagaaaactttaattggtactttctacggtgtgattagaaaaattagtatctatctctgttggttctgctgacttgcttctttccaccgaatctaaatgcaatgtcataggaggaggtttgctgtaaaaacatgtctttttctttggtgtattcattgtaattatggctggcagtgagaaggttcggtaagtctcaatttctctacctcctttacttggagaaaatttgtaaatgtaccctgtgaataaaatgattttttata

SEQ ID NO: 224743 - DNA, 332 bp, Homo sapiens
tctgtgtgccacgaaacgaaaaagtttaccttcgagttgcagactaaagccagctttggaatgagtgaaaaacaattcacattaactctaggaaatttttaaaggccaaaaatatcttgataatttcagctgctaagtaacaggataggttttttccccctctcctcaatatcttttctcttcctattcccattgttttcctagagggtctctctggtaagcccgagagaaaagagatggtaaggcgctaacacactgaagttctgctgcaagtgtcaatgttaacaatataaaggtctgtttgtcttgcagataatttacatggaaaggcc

SEQ ID NO: 224744 - DNA, 1416 bp, Homo sapiens
atttaataattaatggttattgatttattacaattttataaattaatttactaatttacaaataactttctgagctcttacatgtgcaggcactgtgctaggcctgttacaaactctggagaactgagttatccccatatacagatgcagatactgaggccctttggggtgggtgacagctcagatcccacagctagtgtggcacaggcaggaacgaagcccggggtcttttgatggtagctgaaccgcacccagacacccacccgtgtctgccagcactccgtattggctgggaaacactccctgaatccaaaggtgcctgtttagtcagttaccagccagtggtcctcaagtgtccccacctgtaagatgggggcgccctgccccagtactgcagcctcgcgaccccctggagggtgggggacggtagctcaggcgagagtcttccggctgccccggggagggaggaaatgagccggcggcaggggcgggttttcggcggggccaacccacggtggggggagcgcggccatggcgctcctgctttcggtgctgcgtgtactgctgggcggcttcttcgcgctcgtggggttggccaagctctcggaggagatctcggctccagtttcggagcggatgaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactgtaaaaaaaatc

SEQ ID NO: 224745 - DNA, 4219 bp, Homo sapiens
  misc_feature (382)..(382): n is a, c, g, or t
  misc_feature (407)..(407): n is a, c, g, or t
  misc_feature (439)..(439): n is a, c, g, or t
  misc_feature (459)..(459): n is a, c, g, or t
  misc_feature (488)..(488): n is a, c, g, or t
  misc_feature (537)..(537): n is a, c, g, or t
  misc_feature (543)..(543): n is a, c, g, or t
  misc_feature (562)..(562): n is a, c, g, or t
  misc_feature (635)..(635): n is a, c, g, or t
  misc_feature (638)..(638): n is a, c, g, or t
gttttctaacaatcgaaattactttttcatttgacattgcattggaaacattattccacaacaatataaatttaaatatacattgagattatttttttccaatttttattttattatgtttattttattttattcgggggtacatgtgcagatttgttacctgggtatgagattcttaacatagatttcagtgtatataatataaccaactccgttaagattggaaatttagatatttgtattataagcaatgttgggttaagctatgttaatggatctttgtccacttgcctaattatgtccttaggataaatcctaatcagtggaagtgttgattcaaagactatcatctttttttttgtttgtttttgtttttgagacngagtctatctctgtcacccaggctngagtgtagtggcgcgatctcggctcactgcancctccacctgccaggttcangcgattctcctacctcagcctcctgagtngctgggattacaggcacctgccaccatgcccagctaattttcttttgtntttttngtagagacgggatttcacngtgttggcaacgctggtctcaaactcgtgacctcatgatgtgcccgcctcagcctcccaaagtgctgggattncangcgtgagccaccgcgccggcctatcatctattcttaagtattttgatacctgttgcctaaattgccctcctgaaaagttacatcaatgtatgctccaaccagcagtgttcaggaggatccatttctctacaacctcactgacactgagtatcaaaattcagaaaggttgaatatacagtacagtcaatactagtatactcttcatccagattaatgaaatgttaactttttgcaatatttattttctttttttttctggattgtttgaaagtaaaacattatttttctgtctctttttcttccttttctttcttttttttgagatggagtttcactcttgtctcccaggccggagtgcaatgacatgatctcggcacattgcaacctccgcctcccgggttcaagcgattctcctgcctcagcctctcaagtagctgagattataggcatgtaccaccatgcctggctaattttgtgtttttagtagagacggggtttcaccacgttggcctggctggtctcgaactcctgacctcaggtgatctgcccgccttggcctcccaaagtgctgggattacaggtgtgagccccatgcctggccttttttttctttttctttaaaaaaattttttgacaccagtgtcactcaccaataaaaaatttattctttttgtttttttttgagacgtagtctcaagagtgcagtggtgtgatcatggctctctgcaggctcaacctcctgggctcaggcaatcctcttgctttagctacccaagtagctgggactataggtgtgtgccattgcatccagccaattttttttcttcttctttttttttttttaatgtagagatggagtttcgccatgttgcccgggctggtctctaactccagggctcaagtgacccacccaccttggtgtcccaaagcactgggattataggtgtgagccaccctgctcagccaaaaagtttattgttaatttgatgtgtatcatggtcttcagccctaatttcaataacctattgggtgcttgggattacttgtacatgtaccacatcctacagttttattatacctagtgatcaagctttgggcaaaggagaaattcagttttcagtagcatcattggaagtattatgacttgtgcttaaacttttaccagtgcattcttttgataaatagaaatagtaacaaaatatgaattttaaatatgtggggagatacataaagaacattgcttatttgttcttgaaaataacagtgattcaaatatttcattcagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaaccagtagatttttttgaacaaaaatctttagaaatggaatgtcaaaatagttctttaaaaaagtgtttactagttgaaaagtcacttgtgaaagcttcttatttaattgctttccaaactgctgcaagcaagaagccattctccattgctgaagaattaattaaaccatatttagtagaaatgtgttcagaagttttgggttcaagtgctggagacaaaatgaaaactattccactttctaatgttacaattcaacacaggattgatgaactatctgcagacattgaagaccagctgattcaaaaggtcagagagtcaaagtggtttgcccttcagatagatgagtcatcagaaatctcaaatatcacacttcttttgtgctatattcgtttcattgattatgattgtcgtgatgtaaaagaagaattattattttgcattgaaatgcctactcaaataactggctttgaaatatttgaactaataaataaatatattgatagtaaatctctgaattggaaacattgtgttggtctctgtaccgatggggctgcaagcatgactggcaggtattctggtttaaaagcaaaaattcaagaagttgccatgaatacagcggcatttacacattgttttattcaccgtgaacgtttagtggcagaaaagttgtctccatgtttacataaaattcttttgcagtcagcacaaattttaagttttataaagagcaatgcattaaattcacgtatgttaacaattttgtgtgaagagatgggatctgagcatgtgagtttaccgcttcatgctgaagtacgttggatatcaagagggagaatgttaaaaagattatttgaattacgacatgagattgaaatatttttaagtcaaaagcattcagatttggccaagtattttcatgatgaggaatgggttggaaagctggcctacttatcagatatattttcacttataaatgaattaaatttaagtctccaaggaactttgactactttcttcaatttgtgtaataaaattgatgtatttaagagaaagttaaaaatgtggttgaagcgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatttttccctttttgttgaggaatttaataattatgattgttataaataattatgtataattataatctagggtagaaaatttagttatttcattaaatttggactagtgacaaagactgcaggtaatgagaagcccagtttataatgtaacagcacaacctggatgttgaaacagcttggcctttagaagcaagtggaacatttcagtcttctagccaaccagctacttacccctgcaaggttgtgagtaggtggaaaagatagatcttttttttgagatggagttttgctcttgttgcccaggctggagtgcaatggcgtgatcttggctcactggaacctctgc

SEQ ID NO: 224746 - DNA, 1473 bp, Homo sapiens
aagggacgcgttgacattcactggctagtccaccgctctcagtcggagaccacattgcctcgaaggcgattgtgaagcggggctctgaggggcttgatgccccccacccctcacacggagaccttgaaagaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaagtataaaattcttaacatccctttttactttacctttttttagtgtgtatattgtttagttcaaacatactgttgatactttaaatctcttcagcatgtatctgtagaaataactttttagttaatggaagaattcaccaattttaaagttttgcaacattaaataagtgacttggtgttagaatattgcctaaaccagttttctatcactttaaattttactatggaaagaaataacaaatgacatgtgggaattgcaggactatcctgtaattgtagacacccaccatttaaatttatttaacagttatcttgaaagctattgggtatagcataaaataatatcactcttttaatagtatacaaaagctatttaattctttaaaaagtaaaaactctacatggtcgcaaaaatgtgtttatttctaatgtccttgtggggtcattgttgctttacaataatgcttagatgcagagagaggaaaaaacagcaacaaagtcacataaatctttccctgacttagtacatttgaaggatttggcatattttgcctatttctgtggtagtgtaatttgaggaatacagtgtgttgttaatagtcactacaggcaaaaaacagtaagagcttgcttttaaattgtggctctgtcatttatctctgtgacttcgggctagatgtttaactttctaagcctccatttctcatcagtaaataatagttgcttcctaggactttaatgagacagtgttagcaaatggcctagcacatagcaagtacttaaaaaatggaatcctgttattattaataataaaaattatatcgtgcgattatttataa

SEQ ID NO: 224747 - DNA, 1060 bp, Homo sapiens
  misc_feature (28)..(28): n is a, c, g, or t
agcgggagggcggagaccaacgctgcgnaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaaatcctcccactgcctccgg

SEQ ID NO: 224748 - DNA, 449 bp, Homo sapiens
tgcggtgatctagaggatcccgcgatgctctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatt

SEQ ID NO: 224749 - DNA, 3156 bp, Homo sapiens
  misc_feature (28)..(28): n is a, c, g, or t
agcgggagggcggagaccaacgctgcgnaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactgtaaaaaaaatc

SEQ ID NO: 224750 - DNA, 3105 bp, Homo sapiens
tcgttagtcctcaatgatgggagtgggaattcttggtgggaaggagaatttcggaaagcgtgcggttctcagaggagggatgagcgcccgtagatatttagtaggcgagtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactgtaaaaaaaatc

SEQ ID NO: 224751 - DNA, 3129 bp, Homo sapiens
aagggacgcgttgacattcactggctagtccaccgctctcagtcggagaccacattgcctcgaaggcgattgtgaagcggggctctgaggggcttgatgccccccacccctcacacggagaccttgaaagaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactgtaaaaaaaatc

SEQ ID NO: 224752 - DNA, 3116 bp, Homo sapiens
  misc_feature (28)..(28): n is a, c, g, or t
agcgggagggcggagaccaacgctgcgnaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaatggataaagcatcagctaagcagccaggtgttcttt

SEQ ID NO: 224753 - DNA, 3821 bp, Homo sapiens
  misc_feature (382)..(382): n is a, c, g, or t
  misc_feature (407)..(407): n is a, c, g, or t
  misc_feature (439)..(439): n is a, c, g, or t
  misc_feature (459)..(459): n is a, c, g, or t
  misc_feature (488)..(488): n is a, c, g, or t
  misc_feature (537)..(537): n is a, c, g, or t
  misc_feature (543)..(543): n is a, c, g, or t
  misc_feature (562)..(562): n is a, c, g, or t
  misc_feature (635)..(635): n is a, c, g, or t
  misc_feature (638)..(638): n is a, c, g, or t
gttttctaacaatcgaaattactttttcatttgacattgcattggaaacattattccacaacaatataaatttaaatatacattgagattatttttttccaatttttattttattatgtttattttattttattcgggggtacatgtgcagatttgttacctgggtatgagattcttaacatagatttcagtgtatataatataaccaactccgttaagattggaaatttagatatttgtattataagcaatgttgggttaagctatgttaatggatctttgtccacttgcctaattatgtccttaggataaatcctaatcagtggaagtgttgattcaaagactatcatctttttttttgtttgtttttgtttttgagacngagtctatctctgtcacccaggctngagtgtagtggcgcgatctcggctcactgcancctccacctgccaggttcangcgattctcctacctcagcctcctgagtngctgggattacaggcacctgccaccatgcccagctaattttcttttgtntttttngtagagacgggatttcacngtgttggcaacgctggtctcaaactcgtgacctcatgatgtgcccgcctcagcctcccaaagtgctgggattncangcgtgagccaccgcgccggcctatcatctattcttaagtattttgatacctgttgcctaaattgccctcctgaaaagttacatcaatgtatgctccaaccagcagtgttcaggaggatccatttctctacaacctcactgacactgagtatcaaaattcagaaaggttgaatatacagtacagtcaatactagtatactcttcatccagattaatgaaatgttaactttttgcaatatttattttctttttttttctggattgtttgaaagtaaaacattatttttctgtctctttttcttccttttctttcttttttttgagatggagtttcactcttgtctcccaggccggagtgcaatgacatgatctcggcacattgcaacctccgcctcccgggttcaagcgattctcctgcctcagcctctcaagtagctgagattataggcatgtaccaccatgcctggctaattttgtgtttttagtagagacggggtttcaccacgttggcctggctggtctcgaactcctgacctcaggtgatctgcccgccttggcctcccaaagtgctgggattacaggtgtgagccccatgcctggccttttttttctttttctttaaaaaaattttttgacaccagtgtcactcaccaataaaaaatttattctttttgtttttttttgagacgtagtctcaagagtgcagtggtgtgatcatggctctctgcaggctcaacctcctgggctcaggcaatcctcttgctttagctacccaagtagctgggactataggtgtgtgccattgcatccagccaattttttttcttcttctttttttttttttaatgtagagatggagtttcgccatgttgcccgggctggtctctaactccagggctcaagtgacccacccaccttggtgtcccaaagcactgggattataggtgtgagccaccctgctcagccaaactattgggtgcttgggattacttgtacatgtaccacatcctacagttttattatacctagtgatcaagctttgggcaaaggagaaattcagttttcagtagcatcattggaagtattatgacttgtgcttaaacttttaccagtgcattcttttgataaatagaaatagtaacaaaatatgaattttaaatatgtggggagatacataaagaacattgcttatttgttcttgaaaataacagtgattcaaatatttcattcagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaaccagtagatttttttgaacaaaaatctttagaaatggaatgtcaaaatagttctttaaaaaagtgtttactagttgaaaagtcacttgtgaaagcttcttatttaattgctttccaaactgctgcaagcaagaagccattctccattgctgaagaattaattaaaccatatttagtagaaatgtgttcagaagttttgggttcaagtgctggagacaaaatgaaaactattccactttctaatgttacaattcaacacaggattgatgaactatctgcagacattgaagaccagctgattcaaaaggtcagagagtcaaagtggtttgcccttcagatagatgagtcatcagaaatctcaaatatcacacttcttttgtgctatattcgtttcattgattatgattgtcgtgatgtaaaagaagaattattattttgcattgaaatgcctactcaaataactggctttgaaatatttgaactaataaataaatatattgatagtaaatctctgaattggaaacattgtgttggtctctgtaccgatggggctgcaagcatgactggcaggtattctggtttaaaagcaaaaattcaagaagttgccatgaatacagcggcatttacacattgttttattcaccgtgaacgtttagtggcagaaaagttgtctccatgtttacataaaattcttttgcagtcagcacaaattttaagttttataaagagcaatgcattaaattcacgtatgttaacaattttgtgtgaagagatgggatctgagcatgtgagtttaccgcttcatgctgaagtacgttggatatcaagagggagaatgttaaaaagattatttgaattacgacatgagattgaaatatttttaagtcaaaagcattcagatttggccaagtattttcatgatgaggaatgggttggaaagctggcctacttatcagatatattttcacttataaatgaattaaatttaagtctccaaggaactttgactactttcttcaatttgtgtaataaaattgatgtatttaagagaaagttaaaaatgtggttgaagcgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatt

SEQ ID NO: 224754 - DNA, 3316 bp, Homo sapiens
  misc_feature (28)..(28): n is a, c, g, or t
agcgggagggcggagaccaacgctgcgnaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaaggtaaagagagatcatgaaagggattgtatataaactcatccagtagaaacacttttgtgttttcaattttgatcactcaatttgctttgacatgaaaaggagttcttaaagataaagcaactgtttagttggctcttaatggactgttgtttctctgcagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactgtaaaaaaaatc

SEQ ID NO: 224755 - DNA, 4491 bp, Homo sapiens
  misc_feature (28)..(28): n is a, c, g, or t
agcgggagggcggagaccaacgctgcgnaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaaggtaaagagagatcatgaaagggattgtatataaactcatccagtagaaacacttttgtgttttcaattttgatcactcaatttgctttgacatgaaaaggagttcttaaagataaagcaactgtttagttggctcttaatggactgttgtttctctgcagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaaccagtagatttttttgaacaaaaatctttagaaatggaatgtcaaaatagttctttaaaaaagtgtttactagttgaaaagtcacttgtgaaagcttcttatttaattgctttccaaactgctgcaagcaagaagccattctccattgctgaagaattaattaaaccatatttagtagaaatgtgttcagaagttttgggttcaagtgctggagacaaaatgaaaactattccactttctaatgttacaattcaacacaggattgatgaactatctgcagacattgaagaccagctgattcaaaaggtcagagagtcaaagtggtttgcccttcagatagatgagtcatcagaaatctcaaatatcacacttcttttgtgctatattcgtttcattgattatgattgtcgtgatgtaaaagaagaattattattttgcattgaaatgcctactcaaataactggctttgaaatatttgaactaataaataaatatattgatagtaaatctctgaattggaaacattgtgttggtctctgtaccgatggggctgcaagcatgactggcaggtattctggtttaaaagcaaaaattcaagaagttgccatgaatacagcggcatttacacattgttttattcaccgtgaacgtttagtggcagaaaagttgtctccatgtttacataaaattcttttgcagtcagcacaaattttaagttttataaagagcaatgcattaaattcacgtatgttaacaattttgtgtgaagagatgggatctgagcatgtgagtttaccgcttcatgctgaagtacgttggatatcaagagggagaatgttaaaaagattatttgaattacgacatgagattgaaatatttttaagtcaaaagcattcagatttggccaagtattttcatgatgaggaatgggttggaaagctggcctacttatcagatatattttcacttataaatgaattaaatttaagtctccaaggaactttgactactttcttcaatttgtgtaataaaattgatgtatttaagagaaagttaaaaatgtggttgaagcgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatt

SEQ ID NO: 224756 - DNA, 1065 bp, Homo sapiens
  misc_feature (11)..(11): n is a, c, g, or t
  misc_feature (19)..(19): n is a, c, g, or t
gtcgctctagnggatcccnatatatccggcctatccctcctgttacataaaattcttttgcagtcagcacaaattttaagttttataaagagcaatgcattaaattcacgtatgttaacaattttgtgtgaagagatgggatctgagcatgtgagtttaccgcttcatgctgaagtacgttggatatcaagagggagaatgttaaaaagattatttgaattacgacatgagattgaaatatttttaagtcaaaagcattcagatttggccaagtattttcatgatgaggaatgggttggaaagctggcctacttatcagatatattttcacttataaatgaattaaatttaagtctccaaggaactttgactactttcttcaatttgtgtaataaaattgatgtatttaagagaaagttaaaaatgtggttgaagcgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatt

SEQ ID NO: 224757 - DNA, 3134 bp, Homo sapiens
  misc_feature (28)..(28): n is a, c, g, or t
agcgggagggcggagaccaacgctgcgnaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaagtataaaattcttaacatccctttttactttacctttttttagtgtgtatattgtttagttcaaacatactgttgatactttaaatctcttcagcatgtatctgtagaaataactttttagttaatggaagaattcaccaattttaaagttttgcaacattaaataagtgacttggtgttagaatattgcctaaaccagttttctatcactttaaattttactatggaaagaaataacaaatgacatgtgggaattgcaggactatcctgtaattgtagacacccaccatttaaatttatttaacagttatcttgaaagctattgggtatagcataaaataatatcactcttttaatagtatacaaaagctatttaattctttaaaaagtaaaaactctacatggtcgcaaaaatgtgtttatttctaatgtccttgtggggtcattgttgctttacaataatgcttagatgcagagagaggaaaaaacagcaacaaagtcacataaatctttccctgacttagtacatttgaaggatttggcatattttgcctatttctgtggtagtgtaatttgaggaatacagtgtgttgttaatagtcactacaggcaaaaaacagtaagagcttgcttttaaattgtggctctgtcatttatctctgtgacttcgggctagatgtttaactttctaagcctccatttctcatcagtaaataatagttgcttcctaggactttaatgagacagtgttagcaaatggcctagcacatagcaagtacttaaaaaatggaatcctgttattattaataataaaaattatatcgtgcgattatttataattaacataaataaatataataaatatatgtgtatataatacatattactatgtatacttaacatatcacttgtaggcccctattttgtctttggctgtgtttatctgctttgtgtcttgacttaaactatttaaaagtagatcctgctatatggaaatttccaagtaaagaggagagaggatttttttttttctttgttgcccatggtagagtgatcacagctcactgcagccttgaactccccgggctcagatgatcctcccacctcagcctttcaaatagctgggaccacaggcgcataccaccatgcccgactaatttttgtatttttttgtagagatggttttgctatgttgcccaggctggtctcaaactcctgggctcaagcaattagcctgcctcagcctcctaaagtgctgggactattggtgtgagccatcacatgtggccaggagagaggaattttaaaatatttatatactctaaattagtttgttgcaaaataccattctaattaatgcttttatgtcattctcatgaaactaatctgaaagagtaaacttagttttctatttttagatattgtttcaacataccaaataccaaaataaaattaaataattttaaagaacataacacaacttatacatccaaatgcctattgttttcttaaaagtagtcacccccgtcagtgactttttagcataaggttaggagacagattcttatcttttcagcatgcatttgatttttacaaattttcaaaggctgcttgataccttaatcaggccaatatattagctaattaaattaagtcatactgttaaaacatgatatttataaaattaaaagttaaaaaatagtctaagggtttatcttaagttttatcttaaaaaaattagaaaaatgttttgagctatgttattgttggaaggtgtggtttttctacggtaaatgttacgatataacactcatttgcatgtgtaaggttcagagtacacttataatttatgtgcacagattttcattataaagtcattctctttgatttacatatttttacttgctatttttgtacttattatgccactggcagattcaccttattaagtgaaactctttattgctctgttttcagtagaaaaatcacttttcaaaattaatacttcatctgtgtataagcatattcttttggtttctaagatttgctgtcatatttttaaagttgagttttaaagaattaaaataatttttgttgttgttattttctcatggtttaccattgaatatacctgtataataaaggtgcaggatgggaggcaggatagtggaataattaattccatagactagaatcagattgcctggattagtatttcagctttattgcctactagcaatatgactttgacaagctatttaacctctcattcagtttcctcatctgtaaagtggcagttacagtaatacttaaccttatagtggtttggggattttttttttttttttgagacacggtctcactctgtcacccaggctgggttgcagtgagctgagattgtgccactgcagtccagcctgggtgacagagcaagactgtctcaaaaacaaacaaacaaacaaacaaaaaaaaa

SEQ ID NO: 224758 - DNA, 2411 bp, Homo sapiens
  misc_feature (28)..(28): n is a, c, g, or t
agcgggagggcggagaccaacgctgcgnaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaaggtaaagagagatcatgaaagggattgtatataaactcatccagtagaaacacttttgtgttttcaattttgatcactcaatttgctttgacatgaaaaggagttcttaaagataaagcaactgtttagttggctcttaatggactgttgtttctctgcagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttaccatagaggacagcaactggtgattgtttcagagaaataaactttggtggaaata

SEQ ID NO: 224759 - DNA, 2487 bp, Homo sapiens
  misc_feature (28)..(28): n is a, c, g, or t
agcgggagggcggagaccaacgctgcgnaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaaggtaaagagagatcatgaaagggattgtatataaactcatccagtagaaacacttttgtgttttcaattttgatcactcaatttgctttgacatgaaaaggagttcttaaagataaagcaactgtttagttggctcttaatggactgttgtttctctgcagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgtgagtttaattgttaatacttttcttgataatgccacttgggcttattttcactttggatatggcattctaatatatctgaatacttttctttttgctgga

SEQ ID NO: 224760 - DNA, 2691 bp, Homo sapiens
  misc_feature (28)..(28): n is a, c, g, or t
agcgggagggcggagaccaacgctgcgnaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaagtataaaattcttaacatccctttttactttacctttttttagtgtgtatattgtttagttcaaacatactgttgatactttaaatctcttcagcatgtatctgtagaaataactttttagttaatggaagaattcaccaattttaaagttttgcaacattaaataagtgacttggtgttagaatattgcctaaaccagttttctatcactttaaattttactatggaaagaaataacaaatgacatgtgggaattgcaggactatcctgtaattgtagacacccaccatttaaatttatttaacagttatcttgaaagctattgggtatagcataaaataatatcactcttttaatagtatacaaaagctatttaattctttaaaaagtaaaaactctacatggtcgcaaaaatgtgtttatttctaatgtccttgtggggtcattgttgctttacaataatgcttagatgcagagagaggaaaaaacagcaacaaagtcacataaatctttccctgacttagtacatttgaaggatttggcatattttgcctatttctgtggtagtgtaatttgaggaatacagtgtgttgttaatagtcactacaggcaaaaaacagtaagagcttgcttttaaattgtggctctgtcatttatctctgtgacttcgggctagatgtttaactttctaagcctccatttctcatcagtaaataatagttgcttcctaggactttaatgagacagtgttagcaaatggcctagcacatagcaagtacttaaaaaatggaatcctgttattattaataataaaaattatatcgtgcgattatttataattaacataaataaatataataaatatatgtgtatataatacatattactatgtatacttaacatatcacttgtaggcccctattttgtctttggctgtgtttatctgctttgtgtcttgacttaaactatttaaaagtagatcctgctatatggaaatttccaagtaaagaggagagaggatttttttttttctttgttgcccatggtagagtgatcacagctcactgcagccttgaactccccgggctcagatgatcctcccacctcagcctttcaaatagctgggaccacaggcgcataccaccatgcccgactaatttttgtatttttttgtagagatggttttgctatgttgcccaggctggtctcaaactcctgggctcaagcaattagcctgcctcagcctcctaaagtgctgggactattggtgtgagccatcacatgtggccaggagagaggaattttaaaatatttatatactctaaattagtttgttgcaaaataccattctaattaatgcttttatgtcattctcatgaaactaatctgaaagagtaaacttagttttctatttttagatattgtttcaacataccaaataccaaaataaaattaaataattttaaagaacataacacaacttatacatccaaatgcctattgttttcttaaaagtagtcacccccgtcagtgactttttagcataaggttaggagacagattcttatcttttcagcatgcatttgatttttacaaattttcaaaggctgcttgataccttaatcaggccaatatattagctaattaaattaagtcatactgttaaaacatgatatttataaaattaaaagttaaaaaatagtctaagggtttatcttaagttttatcttaaaaaaaaaaaaaaaaaaactcgaggttttttttttttttttttttacaattttatttataacaatatctgtgttatttagttgtaaaggaattcagcaaaaattattaaaacgttcacgtccccaaaacggggctgcccgctttcccttcctgggtgtggcccacctccttggcgtccccaggggaggggaggctggaggatgtttaccagaggaagtctccagccctgggaacctcggtgggggccctggagacagggagggcctgtctgggaggggggttgagcatggccatctcat

SEQ ID NO: 224761 - DNA, 478 bp, Homo sapiens
cttggttgcaatatatacagtattttataatttcatatgtgagaggaaagaaaaaacacttaaaatttccaagttagtttttgtgtaagtgggacttaatagaggttagttgtggttagatttcagatttttataaagttccttgatttttttggtatattattgattatttaattttttcattctcccaatacatttttgtattgtttgttcattggtataacttaatcattgtttttaattttttgtcaccaaggtgtccaggtttcatgtcatagttgtaaaacctcagcaatccctcagtatcacctagccatgtcaaatggaactatatacagcttctgcagctccagttgtgtggttgctttccaggtatgatctaaggtagcacattatgcatgtggttctgttaggcatcgatctgtggcacagtgttaactgctgaaggcctgttcttatgaaagtttaaatttgaatt

SEQ ID NO: 224762 - DNA, 438 bp, Homo sapiens
tctgcagaaaggaatgcagccatgccaacaccttgattttagtccagtaggacctgtgtcagatttctcagctgatacggccaaagtgcagttaaagtagaaaaaaaaattatatatatatatttgtgtggatagtagttcatttagaagttgctggccggggacggtggctcatgcctgtaatcccagcactttgggaggccaaggcaggccgatcacctgagttcaggagttcaagacaagcctggccaacgtggtgaaacctcgtctctactaaaaatacaaaaattagctgggtgtggtggtgggtgcctgtaatcccagctacttgggaggctgggtcaggagaattgcttgaagctgggaggcggaggttgcagtaagccgagatggcgccattgcacttcagcctgggcaacaggagtgaaactccatctc

SEQ ID NO: 224763 - DNA, 451 bp, Homo sapiens
gggatgacacagtttgcctaattagaaataccttttgtgactgtcgtttgtttacctctattttgcagcagcatagcacttctgagatgtttaacttcttttttcatcaaaattattttgaacatgctgacatatctttgagatttaattcctagtcatttaaagaaaataaggggctaggggtggtggctcacttctgtaatcccaacacttggaggccaacgctggaggatcacttgagtccaggagtttgagaccagcctggacaacatagagacctgtctctacaaaaaaaaaaaaagttagctgggcgtggtggtgcacgtctatagccccagctactctggaggctaaggtgagaggattgcttgagcctgggaggtccgtgtctgcagtgagctgtgatcctgccaatgcactcagcctcggctcagtgagaccttgttaaaaa

SEQ ID NO: 224764 - DNA, 507 bp, Homo sapiens
ctgccagcaccctgctcctgagccaacaccaccaccagcgagaccaaacacacagccatcagcagggaccccctgtctccccctaactacactgtctctgccactgtagtgaatgcccgcagggaggcaagcaccccaggactcatgagcactctgccacagctgatgagtgtgcaccccactgcactgccactactgctgctgctggcatgcacaaacaagaatggatcctgctatcactgcactactgaacactttggctgacacaacccatctgagtatagtgaccagcagtctgggagcaccttggcacccccagcacagtggattcctaaccttgaggggccagagaacaaaactggggcctgatacaagtcccccagagttacagcacacagtccaggagttgggaacagagcgttggcccttaaaatcttccagaaatgaagctagtcagatgaatccacctaatataacaatcaaaccctcaagatcatcaaataggat

SEQ ID NO: 224765 - DNA, 552 bp, Homo sapiens
tttcagggattaaggagaagatcaaaacagtttcagattaagaaaagctaaggacatctctgaccagcagttctaccctaaaagaagggctaaggggagttctctagacggaaaggaaatgattaaagaaggaaccttgggacatcggaaagaaagaaaacagcaaaataggccttccttctcctcttgagttttctaaactatgcttgacggtttcagaaaaaaatcatagcaccattcaatgtggttctaactctccataaagaaaatgtttgaaatggttataaactgggagggtaaagagacctacaagggaggtaactcgtctatcattcactcaaattggtaaaacaatgacaccagtataccgtgtggttaagatatagatgcacagatatacgaatgtctggaaaaaccaagagggctatacaaacagacatactcaaaagcactatggataaggcaaaacaccattctcaaagatgttcaagtcatgacaggaaggtaagaaaaagaaagcatatccagaaaacgaaaccagggagaacaaac

SEQ ID NO: 224766 - DNA, 278 bp, Homo sapiens
gtggttcaagaatgaggaaaggtttagatgatttagataagggtagggcatgaacaaagttcctaaagcagaagtgagcatatgctgtgtgtggagctcataagatggggttgaagaggctgacctgacacttgcatgtaggggagggatagaaaaagaaaactggatagaggtggtggaggcagagtcaattgactttaagagccacatggtgtgatctgtaactgagaggaccttgttgctgagcagcgagattaagaacttaatcctctgtgaga

SEQ ID NO: 224767 - DNA, 372 bp, Homo sapiens
ctactcaggaggctgaggcaggagaatcacttaaacccgggaggcagaggtcgcagcgagccaagattgcaccattgcactccagcctgggcgataagagtgaaactcggtctcaaaaaaatgaatagataaataaataacttttctagattcaggcaagttggacaagaatagaaagtctttataccacagaaatgtataggggaaataatgaaaaggttagctttgcttcctgcatcagctaattgaagttcgtcagtgctttgaatgtgtcttctgcaactctagaatgctccttctagtataaagttctaagattttgttaccttcaaactgtgaattgagtctattcaataaaatatgtaaataata

SEQ ID NO: 224768 - DNA, 312 bp, Homo sapiens
gggaaaggaacggaaaggaaaggaaactgatcacagtaatcggcacttggaaagtgctcagtgaatgtgggcttctaccatgctggggactggtggtctccattgccctcccaggtaccggagtagatccactggccccttttccagctctgctgtttacacagctcaaagcagggcttgcagccttgtcacatttttgtgatatctgccaaagcaggcctagggaagcaggggccttggtatccctagctacacagctttctctcagcccccaccacaagagttatcatgcacctgtatccccttatccta

SEQ ID NO: 224769 - DNA, 351 bp, Homo sapiens
atttcgatcctggacctgaaaaagaacattagtggcacaactggtaaaatttgaataagaattataaattagttactaatattcttgtcaaggttaatttcacgattttgttaattgtgctatggctatgtaagatgttaaaacttgagaaagttatgagaagggtatacaggaattctctgtactgtttatacaacttttttgtaagtctgaagttatttcaaaacaaaagttaaaataaattataaataaacaggctttctagtatagccaggccaatttttatccccaatgacaatgtacataagcttcaaaactcaatgttaatcaaaataaatagtccattaatct

SEQ ID NO: 224770 - DNA, 323 bp, Homo sapiens
atatatgggatgatttaaattgcaacataatcatctcaataagagtctagaatcttttgctgatctccatgttcttcaatggacgtcaacaattaggttgacatagtggagaatctaaaatggtctgatactgaaaatctaaattttgcttttacaaacagagtttttaaagagaagaatttaatcccaacgattgagacctctacaaaacttaaacttcataaagagttaaaattttttctgatgtttagagatgatcaaaacaagcatttgtatcccatgtgtggagacaacctgggtctccacatttatcatagatcata

SEQ ID NO: 224771 - DNA, 546 bp, Homo sapiens
ccataatgtggaatgtgtgctgaagcgagactcaggctaagaagatgtagaagagagcttagaaaggtaactttgactagcctgctgtcaggagcccgtgaaacacaaaaagctttgctcctttaattcaaagaatccagccatgtatacccaaaatccccacaatgtcacatgtgagtctgtttgtccattttgctatatgcaaaacagaaatgatagacgcattttggagtcactttaaagaacagtggtccaggctgggcgtggtggttcatgcctgtaatcccaacactttgggaggccgaggcaggaggagtgcttgatgcaaggagttcaagaccaggctgggcaacagagcaagaccctgtctctatagaaaatttaaaaattagccaagcatggtggtgcgcagctgtagtcccagctactcaggaggaggctaaggtggagagatcacttgagcctaggagggtgaggctgcagtgagttatgatcacaccactgcactccagtcttggtgagacacagtgagaccctgtcttttca

SEQ ID NO: 224772 - DNA, 583 bp, Homo sapiens
tgattgatcaccgttccggtaaaaagctggaagatggccctaaattcttaaagtctggtgatgctgccattgttggtatggttcctggcaagcccatgtgtgttgagagcttctcagactatccacctttgggtcgcttgctgttcgtgatatgagatagacagttgctgtgggtgtcatcaaagcagtggacaagaaggctgctggagctggcaaagtcaccaagtcttcccagaaagctcagaaggctaaatgaatattatcttattcattattcaatgaataatacctgccaccctggtcttaatcagtggtggaagaatggtctcagaactgtttgtttcaattggccatttaagtttagtagtaaaagactggttaatgaatcataacaatgcatcgtaaaaccttcagaaggaaaggagaatgttttgtggaccactttggttttcttttttgcgtgtggcagttttaagttattagttttaaaaatcagtactttttaatggaaacaacttgaccaaaaatctgtcacagaattttgagacccattaaaaaaatttaatgagaaaaaaaaagtgac

SEQ ID NO: 224773 - DNA, 166 bp, Homo sapiens
tctagcaggacacaagatttgtggttgacagtcccccctgccccctacccccagcactttgaaaacagaatcctacagagggagcaggactgtaaaaaaagaaaaaacaaaatgccagtctctactagcttataaggtacctgctgtgaaatctgctgttagtcta

SEQ ID NO: 224774 - DNA, 438 bp, Homo sapiens
atatgattccattatataaagtttaaaaagaagcaaaagcaagcaatatattatttgggaatatacatgtgaaaacttatcaaaatgcaagggaataataaagcccaaatataggatagtggttacctctgaggggaggctgggagtgatggtaagaggaaagaggatataagtagatttatgctcttatttttaaaatattgactaagctcctattatgtggctgacactcctctaggtcctggggatatagcagtgaacaaaatggacaaaaatccatgccttcacagagcttccattctaatagggttgatgcaatcatgatgttaatgttgttgattctttaatctgggctcatcaacattaattttattgttatgacatataaattatatattacatgtattctttgatattactaaaacagcacataatgaa

SEQ ID NO: 224775 - DNA, 385 bp, Homo sapiens
tggcttcatgcaatcctcccacctcagcctcccgagtagatgggagtacaggtatgtgccaccatacccagctaatttttgtattttctgtagagctggagtctcatgagccaccatgcccagcctgccttacttcttcctttccttctttcctttcctttcctttctttcttttttctgagactatcccgtagaaccttccatgacctgccccacctgtcttatgtataatgttcatggtgttgatatcatgataggtgttcctagatgtgatggtatctttctttctttctttctttctttctttcttttctctttctttctttcctttcttccttccttccttcctccctcccttccctttccttcccttccctccttcctt

SEQ ID NO: 224776 - DNA, 739 bp, Homo sapiens
gggaaaaaaatctttaactgttttcagtagtcatattattctgacactattttgtgtgtaatatgggataaagcaaatgagtaattatgtgattctctaatttcatcatctgctgattcaaccaaggaataattctccagtggaagaatgagtaagatgtagtcctgtatgtgaactggaaatatctatatgagctctcctggttcaggtcactgagaaggcctagaagtaatgaccaactcatggcagtagcattcctatgcctaggctgtcacgttgaaataccatttcctactaaaagaaatcaggatttcttatgggtgattccaagcgctctctcatatcatagagcaagaattgataaagaatgactatgattgtaacataaggactcaggagctggtgtgcacagactcttacaggccacaggtgggataaagaggagcttcaataagggataacaggtgcaggagcacaaggcacatcaactacatttatatccatgacatcacagtgaaacttacaaacaagtatcctttggagaatcactccacaaactgattaaaaaatcaagcatgggctgggtgcagtggctcacacctgtaatcccagcactttgggaggccgaggcacgtggctcaggaggtcaggagttcgagaccagcctgaccaacgtggtgaaaccccatctctactaaaaatgcaaaaaaattagctgggcctagtggtgggcgcctgt

SEQ ID NO: 224777 - DNA, 539 bp, Homo sapiens
gatgccagtgtctctacatcgtgacaactttgaatgtgaccattgtatcacctactaagtccggcagaactagaaattatggctgaagttccagaaagttccagaaagcacatttggccttataatagataattactaactgcaagagctgtgcatttactaaatgatatgctctgccaaggagcgagttccccatcacagagagcagcagaagccatcatcaggaatgctgcgtgtggatttctgagttgagtatgcggttaaaacacaagacgctaggtttagtccaatcttaaaattctacgattttaatcttttaaaaatagtgtttgcatagtatttttaagtttttgatgaacctcacatacatgatctcattgattcttttttaaaaaatggaggtcactttttcttggcttaaacaaatgaaaataaatataaacaatatagacttctgaagaaggatggcagaataaaggcaaaataaagactctcctcctccaacatctaaaatatgaataaaaataataaaaatcagc

SEQ ID NO: 224778 - DNA, 513 bp, Homo sapiens
cagcaaatggatggataaacaaactgtggtacatccacgtgatagaatattacttggtaataaaaggaataagtactgatatatggtacaaagtggatgaaccctgaaaatattacaataagtgaaagaagctagtcataaaggaccttgtattatatgattccatttatacaaaatgtcccaaataggcgaatccatagagacagaaagatcaggggttgccaggggctgtgggttggagggatgttgggaggaagatgacagctaaagagcacaacatttcttttctggggtgatgaaagtgttctgaattggttgtggtgataactgcacaattctgtaaatatactagaaactgttgaagtgtgccctttaaatgagagaaccatctggtatatgaattatatatcaataaagatactatatatttatattttaaaactgtaccatgaaaaaaaacaaattatgcatttggtaggctctcaataaatatccactgaatgaatgcaccaa

SEQ ID NO: 224779 - DNA, 552 bp, Homo sapiens
taatatctgttgaatgaatgaatcaatcctctttggttcaataatgcaaattaagacttagagaggaggtccaaattttggtcttaaacagaatacatcgtgacaattgggtctcagctggaaagacttactaatcaaggctagtaataaatacataaagaagaatattttcatatcccttctgactttgatctagtcagataatcgcccactttaccaaatgctaatcttatattttgtatcagcaggcaatttctctgaactttctagaataaacaatttttaaagccttcttacaatcaagttttgtgcatgtataaatcagaaaaccaaagttacccacattttgttttttgttttgagatggagtttcgttattgttgcccaggtattcattcatttatatattcattcatttactcactcattaacttttattgagccactactatgtgacaaggtctacaacactgactgtgatgaacaaaattggagtgacctttgcccataattaataacctttatgaaaacttttctggttatttgtccttt

SEQ ID NO: 224780 - DNA, 265 bp, Homo sapiens
gagttctcaaccctggttacatcctaatgtaatttttttctttgttcttggaaatcttttattgagccacctattctgcttctttgcaacaaaatatgttcttacattgaatttttaatttcttgttgtaagtgtaaaagttatatgggctgggtgcagtggcccacacctgtactcccagcactttgtgaggctgaagcaggaggattacttgagcccaggagttcaagaccagcctaggcacatagggaaacctcatctctac

SEQ ID NO: 224781 - DNA, 536 bp, Homo sapiens
tctgcatattgcatatcttattgtgtgactttgccaaagttgtttattactagtagattgtatgtgtagtggtgggggacatgtattccttatcatttaatatacatacaggattatattttctgtaattaaaatacttttactcttcttttaaatattgatatactttatttttcatttttttcttgcttgattgcttgacaagaacatccagtgcagtgttgaattgagtagcaagagtgaatatccttgtcttgtttatgacattagaaagaaggcattctgtcaactttaagtagatgttaactgtaagtttttcatatatatcctttataaggtaaaggaagtttccttctattacaagtttgttgagagcttttgtcataaaagagttttgaattttatcaaatatctttctccgtttattgagatgattacattttttatatttactctatgtggcatattactttattgattttcagatgttaatctatcttgcattgtttaataaatcccatttgtattatggtgca

SEQ ID NO: 224782 - DNA, 435 bp, Homo sapiens
atttttgtgtttttagtagagacagggtttcaccgtgttggccaggtttgtctcgttctcttgattacaggcgtgagccaccacgcctggcctctttattttttaatagcagtgatgaggttgattcaggctatttgaaaccttctttcattggttaatttagcaaacattaagtgctgttgtatgctggatactggacattggagtaggctttggagactgagataagcatgttgacaacttacatttactgactgtttactgctttccacatactatgctacgtgcttgatgtgtcattcagtcctctcaacaactttactataattatcagcatttttttatgaggaagtaaagttacttgcccaagttacacagctcataaattttgaatctggtgagcagtttgaattaaaagccattacaatatgttcc

SEQ ID NO: 224783 - DNA, 444 bp, Homo sapiens
tcaaattagagacctctttactttatagctccattggagagccacacactacgtgcccttatattagcacattacttcttttttcttttttttgcatgaatgaattaaaaagtttgaggaaaagattgcttaccctttttatagtatgttcaaactattgttcctttcatagtttcatggatgcattcctattgataatgtctgttttttgtagaaaagagtaatactgacattttagttctaaaattgacttttcctgttgtaaaccaggagtcagcaaactttttctgtaaaagcccacactgtaaatattttacactgtgagtcattttgtctctgttgttgctacttaactccgctcttgaaatgtgaaaatagtcataggcattgtgtagaaaattataagcatggctgtgttccaataaagcattatttacaaaagca

SEQ ID NO: 224784 - DNA, 214 bp, Homo sapiens
ctgtagcatctttccacaccttctactgacaacactttagtgccagctccaaagaaaacatacttccaggggccagatccgttttcactgagcaattagaaacgatgaatttggagctgaatatcaatccactgaaaactggtacactggctgaccctccacgccaaggccaggaaacaacgtgtttgaaggccttctaagcagggctggcaga

SEQ ID NO: 224785 - DNA, 442 bp, Homo sapiens
ttttctctagactactttattgtaagaatacagtgtataatacatatatgctattcaactgtttatgttactggtaaggcttccagtcaacattaagtaggctattactagttaagtttttggggagtcaaaagtcatacatagattttctgctgcacaaagtattagtgtctctaactcctgtgttgttcaacggttaactggagttatgatcttcatggccatgtatacagtatttaacttctctgagactcaattttcccacctatgaaataggggtggtaatcttgcttatcttatacagtgacatgaagatgtattgagataatgcatgtcaagtgcttgactcagtgtctgactcatatgtatattaaatagctattattattccattgctgtttattaaatcacatttttataaaagattactgtgtggcaatga

SEQ ID NO: 224786 - DNA, 368 bp, Homo sapiens
catagatacaaaaattgttgaatataggaaagagaaaagagtacattagtttgtatttactgcagattgctggagtagaaaatgatcttagtgtttttcctttgaactctacatcactcatcttaatgcttaaaaaaatggatagcagaaaatgtgaaaggcactaagcaacatttttacactcaaaattttgaagacaattcatagctagtatctggatttatcatttattttctgggatagaaatatataagttgggtgtttgattaggaaacctaaaggactgtattttaagccaaagcattttctatatacttaagggcctataaagcaggctttcattaaatattaagtatagctccaccaca

SEQ ID NO: 224787 - DNA, 961 bp, Homo sapiens
ccgcattgcccatctcatagatccataaatcggtcttactctctgtcatcttatctcccataagagggtgttttctgtccttatcctcaccaccaccttctgtttttaaatcacttttttttgtgctgacagatagagagagcttatcactgagaggtctacagacactttcctagtaatggcctggatgaccccatcagccaggccttgaaggacacagtgagagccattcagactggacatcgtggtcaaatcagatgctgctggccagccatgcgaccttggctgagttatgccacccctctgactttatttctttatttgtgaaacacttagggggctgttatgaggatcgagtgagatggcatcttgtgcctgcatctagtaggcattcaggaaaaatctgatgctggcaacgttcttacgatgtgagcggtatctttctttctttatttttaattgtaattttttttttttgagatggagtttcactcttgttgcccaggctggagtgcaatggcatgatctcggctcactgcaacctccgcctcctgggttcaagcaattctcctgcctcagcctcccatgtagctgggattacaggcatacgccatcacacccagctaatttttgtatttttagtagagacggggtttcaccatgttggtcaggctggtctcgaactcctgacctctggtgatccacccgcctcagcctcccaaagtgctgggattacaggtgtgagccactgcgcctggcctatgtgagcagtatcaaccccagcagctcatgagctcacatcttctgagactctactatgtgccaagcacgggtcccagcttttgatatgtgttaagtaatttaatcctctcaatgctgatggcgatactaccattatcctcatgtgagagatgaagaaatgaggcacagagaggagaggtgaagtcactaaacaagtgag

SEQ ID NO: 224788 - DNA, 526 bp, Homo sapiens
cctcaatccactccagtgtggctcctacccaccctagacacaagagcactgaaaactttaatcaaatcaattattgacattttcctaaaacataagtacttgtaaattcttcccttgacctgttagcagtacttagcattgttaaccagtaggatgtacgtgcttagtacatgaaggggttcggtagataatttcccaatcctgtacatccatatgtatttgttcctaaattgatctgccttaagacaactacctcttatttcacagcctttctcccactagaggaaaggcaatacctctcagccatgccagacctactgtgtttaattgtcccagggaataaaatatttcatgggtccaaacaaagggacaatttgaaacattcatgtttatgttgaggcctgaatgactccctttgcaagtcagatggtttctgtcatctgtcagatgccctcaatgaaactagcagacaagtgaattgtcagctaatttattaaaaataaattttgatgcaagatcactatga

SEQ ID NO: 224789 - DNA, 439 bp, Homo sapiens
cctattccaatatcgaacatttggaacaattgaaactcccatacactgtagataggaatgtagaatgatacaaccaccgtagaaaagttttggcagtttcttataaagttaattatatacctgccctgtgaccagtaataccccttctaggtatttactcaaggaaaatgaatacatatatggccacaaaaaagactgtacaagaatgtcataacagccttatgagggttcttcaaaaagtttgtgggaaatgtgtgttatgaaaaaatatccatggagtttgtattagtccattttcatactgctataaagatactacctgaggccaggcacagtgcctcacacctgtaatcccagcactatgggtggctgaggtggggcggatcactttaggtcaggagtttgagaccagcctggccaacatggggaaaccccatat

SEQ ID NO: 224790 - DNA, 629 bp, Homo sapiens
aaacattgttcagtgaatggattcttgccctttgctagagtcctgttagcagtaatgaatcttcagagtccctaaaccaggatcccaggatctggttagtcttctgtacccgttatatggtccctttcttgaagaagaataagaattaaagtaagattttttatataatatatttaaacctgtgtggagatatgctgttttctgttttttaagatttacctccaaaattttagtaggtagttgttaaagctgcacaaaattgaaatattctaaaattttagatatgaggtaattaagaagaaaaagcatacgcatatatcctttaaaaacataatagttactatatataattgaactcaaatatgtgaaattattcttgaaagagttttaagtcgtttttttcttttgaatactgttacaattactatttcagaacattataaaacatcactaatagtttctatgccaataatgtttcctaagtgaaatatttttatgtatactttttcatgccatccaatatgttgatgtatggcatttccacctaaattttaaagaaaattcttcttagaagactgctcattccccagactgaacattgggtttgtaagacctgataatttcagatg

SEQ ID NO: 224791 - DNA, 277 bp, Homo sapiens
ggcccgggacgccccccgactagcccgacagccgtccagaccccaggctccgccccaggcctggctagagccccagtcctcgtcaggggacccccaggattgtccctgctgtctctccttctcagagtctctctctgtctctctctgtctctctgtctctctctctctgcctctgtctctgtctcttctccaagctcaaggtctctgggtctcagcatctctcagccccaggcctctgggcgtccccctgtcgggctagtcgggaaggatcctctag

SEQ ID NO: 224792 - DNA, 275 bp, Homo sapiens
ggcccgggacgccccccgactagcccgacagccgtccagaccccaggctccgccccaggcctggctagagccccagtcctcgtcaggggacccccaggattgtccctgctgtctctccttctcagagtctctctctgtctctctctgtctctctgtctctctctctctgcctctgtctctgtctcttctccaagctcaaggtcttgagaggctctcagagcgctccagtcctccttctcagtagctctgtcgggctagtcgggggagatcctcta

SEQ ID NO: 224793 - DNA, 366 bp, Homo sapiens
catctctcagccccaggcctctgggcgtccccctgtctctttctgtctcttcctggtctctgacctctccacttcccaggcctcagaatctctgcgcctaggtggtgaggggtggtcttaaactctgtctctctccctctttgtctctctctgtctctgtgtctccttcagtctccagacctgagtccctggatttctcggcctcaaggtctcggcgtgactttctctctctgccctgtctctctttgtgcctctgcccctctcgggctctctgcctctgtttctattctctctccctctctgcctcccccatcctcaaggcccatctccctccctcgctgcatccttccccccttccctccccgc

SEQ ID NO: 224794 - DNA, 570 bp, Homo sapiens
cagttttaagtttgtgcaagtttatttggttttatacttacaatatatacactcaataaaatatgatatacctcaataaaaataaagcaatgccttccctgcctccaaaaacaaaaccaacctgggaatacaaagatcaaataacagtgcctgcagaagcttagaaaatcggcacagatgtgacatttgactcagttcagcacacattatggagggttactatacaagggagactgcacacagagaccatactcaggagcctgaggatcctgaatcactgacctagagggaagaagtaccagcccctatcttgaggacctcatattacaaggcagtaatagacatgcaaaaattaatagcaacagtctgattctggcaattggctgatatgccaactcttaccacttttcaacattgtgctagatatgtaagtggcagaaagactgaaaaggaataaacagattattatttgcattctatgctcttatttacttagaaaatccaggagaatctatacactattagaaaaaaattacacttataaaacttactagataaaagatcagtatc

SEQ ID NO: 224795 - DNA, 313 bp, Homo sapiens
agaatcagtaataaatacatttgccagccatttttccctcttgtatcctgaagcataacaggcatttccaatggaaaagactcaactctgtaagaactgtatttttggttttgaaaaatcagatcaatatttacagcttcaagaagaacaagaagaaatgctcctctcaataataaacatacataaattccaaagagtcaccataatttccatacaaattcatcctacacacccccaccgccctatttttttaagataatgactgaacaattctaaagtacattttctgtatctccaaggtgattcagttggg

SEQ ID NO: 224796 - DNA, 459 bp, Homo sapiens
aatcatggcagaagttgaaaggcatatcttacgtggcagccggcaagagagaatgagaagaaatattgggccaagcaaaaagggaaaaccccttataaaaccatcagatctcgtgaaactttttcactaccacaagaatagtatggaggaaactgccccatgattcaattatctcccaccgggtacctcctataacacgtgggaattatgggagctacaattcaagatgagatttgggtgaggacacagccaaaccacatcagcatattcctacagtgtaaaagtactcagaagtaagaaagaaacaacctctgatatataataatgtgaatggttctcaaaaattttatgttgagcaaaagaagccagatacacaagagtagacactgtatgaccatttgtgtgaagttccagaacactgaaaataagctttgatgaataaaaatcataatagaggct

SEQ ID NO: 224797 - DNA, 420 bp, Homo sapiens
cattgctatatggaaatacttgatgctgggtaatttataaagcaaagaaatttaattgactcatggttttgtaggctctacaggaagcatggtactgacattggctaagcccctggtgaggactcaggaagttttgattcatagcagaaggaaaagtgggagcagtcacatcacacggccagagcaggagcaagggtgggaagaggtgccacacattttcaaacaaccagatcttgcaagaactcactattgcaaggacagcaccaagccatgaaggatccacttccatgatccaatcatctcccacccggccctacctccaacactggggattacatttcaacatgagatttagatgggatacatacccaaacgctatcatttactaaaccaaaataatgaaaaattctagtgtgtaag

SEQ ID NO: 224798 - DNA, 443 bp, Homo sapiens
gctgccccctggagcgtggcttcgtgtttgatgagtgcggcccaccctgtccccgcacctgcttcaatcagcatatccccctgggggagctggcagcccactgcgtgaggccctgcgtgcccggctgccagtgccctgcaggcctggtggagcatgaggcccactgcatcccacccgaggcctgcccccaagtcctgctcactggagaccagccacttggtgctcggcccagccccagccgggagccccaggagacaccctgagccaggacagtgcctgataagggttcatcaggccaggagtctccccttggcgagcagttcccaccctggttagggctatggagagaatgccctgcctggacactggagcctgggcccctgccctgcaaagacccccgccatgttgagtcaccagcagtaaactctaggcctgcccgaaag

SEQ ID NO: 224799 - DNA, 588 bp, Homo sapiens
tgtttggataacaagtgaaagaaatagccaataaacagtagatgatattattattacagggtttcatcacaatgaaacactttaaagaggtttttcaatttgttagtaccattttacaccagtagtcagtgaagaaacactgagctttctacagtctttaacatgggacacccagcaactgatacagtaccctgcatataccagacaccattggtgctaattaatttaaactaactcttaattacacataggaacagagtaactccgaaagcaatcatacattcactagaatataaagtccttgaaaagatcttttgtctattttgttcactgatgaatcccaagtgtctaaagtgtctagaacagtgcctggtacatagtcggcattcagtaagtatttgtcaaatgagtttgggaacttgttttttagtactttaatactttgattaaggcttttcaaaagacaataatcttgacactcaaggacaacttttactcttcatataccagcctatacagaggtacctctcctcactctaaaagtaactacatgagccaggcacggtggctcacgcctataatcccagc

SEQ ID NO: 224800 - DNA, 195 bp, Homo sapiens
gccatgacaggacaattgtgcatagtgtgtgctggtaactgtgtgcacagctgtgtgtgctgctctcccacgacttggtcagcagcttccagtgctagagctccagatcttcacctccatctatagcctctcatattagttaaaatacatctacaatgtgaatggtatctccttagtaatggtgctcttgagcag

SEQ ID NO: 224801 - DNA, 383 bp, Homo sapiens
atgtttgataagctttataaattgatgacattttaatgataggtagatggattataattttaatttttcaaatcaaaaaattcaggcatggttatttttaataaagatttgatcaatttgattaaattaacaaactataagcattggcttataatgccattctttttgttattaagatcttacctgagccctaaaaatactcgcggtataaaaaaaataagaacactgtttttcctgtgtcaattgccctactaatttctcagctgtatggtgggaaacatgttgagagaaagtattaaaatatattaaagccacatgggattattaaaaactggaatgaatcctctaaatctttgagacaactattcatcagttgctctttt

SEQ ID NO: 224802 - DNA, 483 bp, Homo sapiens
ctagttacgtacccaagagaactgagagcagagactcagatatttgtaacgggaatgtccctgacagcacttttcgtaatcgccaaagggtggaaggcacccacatgtccgtccccagatgaacgggtgatggaacactattcacccctctcaggaacggggcctgttgcatgccacagtgtggaggagcccagaagacctcatgctgagtgacagaagccagacaaaggtccaggtgaaatgtcccgaagaggcgaggccacagagacagaacccaggggccgggggagtggggagcaaggagcaactgttgaatacgtatggggtttccttttggggccgtggaaatgtcttggaactacacagaggcgatgcctgtgctatgccgtgatggtgccgaatgccacaaatctcccactgaaaaatggataattttatgttacgtaaatttcatctcaataataaaagtaaactgtaactatt

SEQ ID NO: 224803 - DNA, 528 bp, Homo sapiens
acacacagggcaaacggtcagtaatctgtactatttcatcagacgactgagaaaaagaaaatttattgacacttttgttcttaatgctcacatataaagatttcactttacctcgtgttttcagaaacactccagacacatcaaataaactctcttgaattttaaaatagaaaaaggattgactgggctatgtgtgtgtctgggagtgggaacacagggatgggagtaattcaggatcaaaaaacagagtattaagtttaaagcagttgttactctctgccttccccctccttcctattctccagaaggcagggttcatagtgaaacactgtgtagtcttagatgcccctcctggaaaggcatatgaatcctagccccactccactctactgaaaactcagtgatttaaagcctcttgctttaaaaaaggacttctggttcaaaagactgctatgatcatgtgttaacattcatgtagaaaaagttctagtcatattaataatcaataaaaatgcaagtaaaaactat

SEQ ID NO: 224804 - DNA, 633 bp, Homo sapiens
gcacgagaaaattggctaatcagatttttgtgctgattaatgagggaaagtttttactctatttttgtggaaagtaatatacatattcatgttggaatataattattcccatttcttagattttaaattactacttttaaataaatacagtctcttttattaacctgtgttttttctttccaccgtgggtcttttcagtttcatgattttgctctcaaaactttttaattattgatttctgtcaaatctgttcattcattacattattttattatttattaaattgttttatctttttaagtcttattaatatgtactgaatttgtaacaatttggaaagtcaagtaactcctgttttatctttttcttggtttatgagtgtttttaaagttttacgtttcttgaagatcacagctgtagccccaattccatggttctggctacttacatttatcatacttattaatatcatgaatgtaattggaatacccctttgattttactggtgacgtatacccactagtgtactgagacggaaaaaaaagtctttagaactcagataaatatacagttcatatttactatttatgtatgtgtgatctcgttattaaattactctatcatgtttgtgga

SEQ ID NO: 224805 - DNA, 690 bp, Homo sapiens
tatggtgactccatggtcatgagaaacccatgttctttctgtccactgtgccatcttcatcctcatgctatgcagtgggatggagtaagagaagatgaaaatcctaaaagccatactccgagaaacagcacttctgctcacatttcaccatagcctagacacatgaccacacctagtagcaggagaagagggaacatatacccaactcaaaataggggtccttttactatagaaagaaaaaaacagacatttggaatctgactctggcacgtttccagaacagcttcttcctttggaattcattcattcatgcataaattactaagtgccaggaactgtagagtcttggaatatacagatgaataaggcaagaaactaagtaaagcacatagtcaagtgggaagatggcaaccgatagtgcagtgaggaggaaagtactgtcatggagatctatgcagatctccccactctgcctgggacagaagggaggaaggcttccagcgttacagcagacttcaaagtgtagtacttcaaaggacagggaaaagttaatacagttgcgtaaagaagattgtaatggttacttatagtcttatccagagatgacccctattaagatatgagtatatcctttagattactgtttctaaagaataacccctgcctctagctaatcatagcttccatagg

SEQ ID NO: 224806 - DNA, 540 bp, Homo sapiens
aaaagccattcaaaatgtgtgaattaaaacataaatatcatattcctaaaggcatctattaatggttttataggaaaagggaactttgagatctggaagtgtttccgttgagatcggtattgtacaactgttacttgggagtcactgttctaggagctgagaatacagggatgcataagacaaatagatgacatagagtctctcctggcagagacactgcattcttgtttagggggtagttaatctacaaacaaaatgaacaggagaaatgtcacctagtgataagtgctacgttgagaattaaaatagggcattaggattggctgactactttaggttgggttgtcagggagccctctcaaagacgatggcatgaacagtgtgatctgatgaatgaagaggagtcagctatgtgaagttgagagtgaggcgtcttctgggtagtagaacttccagaggaaagtccttaaggtaagaacttgcacagcatgttttgttcgaggaaataaaaggaagtctggtcactggtttaggagaggg

SEQ ID NO: 224807 - DNA, 345 bp, Homo sapiens
taatccctttggtacaatttggcaagatcttcttgggattgttataagaattttattgatcattctcctttcagatttcaataagacccagaaatgggtgtagttatggtgttgtgcatgtgtaacgtaactcacagttttttagggaggtatgcctaaattgcattataatgctttgaaaccagaaagaaaaatgaagccaggttttgtgcctcacacctgtaatcccagcacttcaagaggcttaggcaggaggatcacttgaggccaggagtttgagactgtaatgagccatgattgcatcatggcactccagcctgggcgacagggtgagaacttgtttcc

SEQ ID NO: 224808 - DNA, 402 bp, Homo sapiens
attctatacttttctaaataaagagaacacaagaatagagcaaacagggctctctcaatttgtaagggactgaagtagagagaacaggcaagtaagcaatgagcattttattcatttcctgattcttgactatgtacagaaagaaagacaaactcatctaaaggcagccacatgtcaaaataataaaacaatgagacttccatattccccaggaagagaaggtcttggctacctccaaaagagttaaaactaagcattggttctctaactgtactattttagcctctctctctctctctctctctctctctctctctctctctctctctcactctctctctctctgtgtgtgtgtgtgtgtgtgtgtgtgtgtgcatgtgtatgtgtacgttttgaactcag

SEQ ID NO: 224809 - DNA, 443 bp, Homo sapiens
agctgggagcaccttccgtagaaggcagggggtgcatccctgtgtgctgagatgaggctgtgagccacctgcaggatagagcctagctccttagtgtactacctggacttctgccaatgttccctggtcctattggctccttgtcccaggctgcacaaagtcacaggagcctgtcaggtccccactggctattcctgacagcttacgtattatgttctttctgcccccaaaaccaatatttacttatgaaattccaccttatccttccagaaaactcagttgtatgtaaaaaggagcagtttatgctccagtgaagtctgatgggaaggaaacagggtttggagcaagacagacatgtgcttgcatcctgaagccatcgctggatggcccgatgacttggggatgctatttacattttctgagtctcacatttcttgtataaa

SEQ ID NO: 224810 - DNA, 600 bp, Homo sapiens
gggcaagccctctgggaaaagataaagcctggaaaagaatagttttattctcacaatgtgtataacaagctctaaatgggtcaaagacttacatttttaaaatatgaaactaaaggaaaatatgagtatatcatttttaattttggaattgggaagccttttctttcaagttataattcaaaagccagatgcaaataataaataaacaaatgtgactatattttaaaagcacatgaaacagcagcaaaacttcggcatagcaaacaacaacaaaaatgaaaacaccacaaacaaaagcaaaagataaataacaaactaggaggccgggtgtggtcgctcacgcctgtaatctcagcctcccgagtagctgggattacaggcgcttgccaccatgcccagctaattttttgtgtgtgtttttagtagagacggggtttcaccgtgttagccaggatggtcctgatctcctgacctcgtgatctgcccgcctcagcctcccaaagtgctgagattacaggcgtgagccaccgcacccggcctagggttgattcttagtagctcgggctactaaatcaggggtgctccagccttggttaactc

SEQ ID NO: 224811 - DNA, 340 bp, Homo sapiens
gaaggtgttaactttctactctgattctgtctccataatggggtaaactgttgatagtttaccccatcaacagatggtcggtaaattattgattcgaagaatcgagagagtgcagcaacataaatctgttaatgtctgatcaagctcctgccctgttctccgaattcagcttcataattaagggaaggcctgttttctatcctcagatttaggttctagtagcagttgtgtaaccactagtgagtcacttaactcctctgggtccccatttctcatgtgcaacaagaaagaggggaactggagatgatcactctagttccagacaagggaacatttcaca

SEQ ID NO: 224812 - DNA, 542 bp, Homo sapiens
tcaggcatgatggtgcaggactgtggtcccagctactctggagagtgaggtaggaggatttcttggaccggggaggtcaaggctatactgatctatgtgattgtgccactgcactccagcactgggcaacaagagtgaaactctgtctcaaaataaaattaaaaaaaacaaaaaataaaaaacaatgtgtgcacaattctgttaatcatttataacaaaggtcataaactggtgacctggggttgggattcagctgatatgtggttttgacgtacattgtttaaacagtaacaaaaaattagtttcaaattgggagattttgagtaaaaaagcccaagttttggggagtcttttgaaaaactgaaaaatctggtgacactacatttttacattgggttttaattttatttttgtgagacagagtctcactctgtcacccaagtaggagtacagtggcttgatcatggcttactgcagcttcaacctcccaggctcaaacaatcttcctgcctcagtctcccaagtagctgggaccaacgcgt

SEQ ID NO: 224813 - DNA, 737 bp, Homo sapiens
ccaccccagaaagatactggttccacaagtttattaaaaaaataaaataaaatggccgggtgcggtagctcacgcctgtaatctcagcactttgggaggccaaggcgggtggatcacgaggtcaggagattgagatcaccctggccaacatggtgaaaccctgtctgtactaaaaatacaaaaaaaaaaaaaattagctgggcatggtggcccgtgcctgtaatcccagctactccggaggctgaggcaggagaatcgctggaaccccaagaagcagaggttgcagtgagccgagatcacgccattgcactccagactgggcaacaagagtgaaactctgtctcaaaataaaattaaaaaaaacaaaaaataaaaaacaatgtgtgcacaattctgttaatcatttataacaaaggtcataaactggtgacctggggttgggattcagctgatatgtggttttgacgtacattgtttaaacagtaacaaaaaattagtttcaaattgggagattttgagtaaaaaagcccaagttttggggagtcttttgaaaaactgaaaaatctggtgacactacatttttacattgggttttaattttatttttgtgagacagagtctcactctgtcacccaagtaggagtacagtggcttgatcatggcttactgcagcttcaacctcccaggctcaaacaatcttcctgcctcagtctcccaagtagctgggaccaacgcgt

SEQ ID NO: 224814 - DNA, 536 bp, Homo sapiens
ggatgaatgaatgaatggtcaggaaattggaatttgttggatatgtaatttgacagcagacttttaatgacacacttcaggttccattttccctttaaataaaataagaacagtgctacctatgaaacaggcagtacttaggaggattatttcccataatataactttgggtgtttaaaatgctattaaaaatataactaccatctatgaagctttgtatgtgttgagcactttattaagagctttatttttattacctcttttagtcctcaccgccacccactgtgagggaggaattattgatcctagtttatagatgacagagctgagtccagagaggctgagttacttgctgaggtcacagagctggtaaggcattgagcacagggtccaactccagggtgtctggttctaaaggcttcccatcatgccccattgcttctgagtgctgttaggtgcttcccaccacttttttaaataaaagagacagatatcaattttggagaggggtcttcaagatagaaacaaatggcaaa

SEQ ID NO: 224815 - DNA, 288 bp, Homo sapiens
tcaaaactccacataaagcatatggcaacctgttttgaactccttccaaggggtcattttattgaaataacttcctttttaccatcccatggagaagtatctgttacacttgggctgttcttttttttttctcttgacttttttcacaatcctactccagtatttatcccctctctttcatatttcagaagagaggaatgttcccaaacttgttgtttctttggttagaggctgggaaatctgttatttctgttgtaaaggaaatggctgtgctcacctttctttcat

SEQ ID NO: 224816 - DNA, 557 bp, Homo sapiens
gtgtcggttgcagatgtagaggacagcgagagaggatttagttctaggccattttggttttctcctgtcattgaaatctaaaaagtgaatagtgttaattatattgtgggaagctgaaataaataataaaatgacttcctatttagtgagggtcttgactagctctgtaacttgctagctgtagaactttaggcaagtaacttaattttgtacaccttagctccctcagttgtaaactaggtaacttgttgcttcttgtgaaagtttaataaaatagtctacttaaagggcatggctgaacatctgccatacaagtgtttaataaattatgactattattatttgtcactttaaaaataaaagagccacagcagaaactcagtttgcatgattctaattattttgtacatatctatcttccctgatgatttccagtaaggaaatgatttcagcaatgattgatttctttatccctgtaaccacggtatgatgtatcttcaaggatgcaattaaaaaagatatttaagaacgcttgtgaaataagaagtaatggaaaa

SEQ ID NO: 224817 - DNA, 569 bp, Homo sapiens
caaaatgaacagaaaccttggcagggattgtgctctctgcttcctctttccccagtctctccctagctgcccagggccaaaagccccatggccatgatccagcatcctcttgggaaagctgcactttagagggaacttatgagtttattttacctacagatttttctctgaggagtagaggtagcaaatgacttcaagggaaaacataaagaagtaacatggagatgaggaatgacacaagatagattatattgggttgccttccatggagtaagatttcagaccaaataaagccaggattactgggcctacatcccccagaggcattctctggcagtgtttgtgccatggcaagtcagagatgcaaagaagcagaatctgggaaaaggtacgacaaggactaaaaagttgaagcaatacagaaataagaatctaatccaatctgaaggacactccaatagaggcattcaaagaaggaataggctgaccatggaacgattagttcgctatcattagaggagttcacatacacactggtgtccattttctggggatgttcaacatgggca

SEQ ID NO: 224818 - DNA, 227 bp, Homo sapiens
tcagttgagcacacagtggacagctgtaggagtgtgctgagcccaaacacatcagtaacgtccgccctggcaggagagaggttacagaccccaggccctcacgtgccaggccagtgccagccctgccaacagctgtgtggtcttggacaagtctctccacccctcagtgcctcagttttatcacttggttgtttttgaggattaaatgagatcacgtgaaatcagga

SEQ ID NO: 224819 - DNA, 328 bp, Homo sapiens
tatttttcttaactcaatagatacaaaatattatttcaacatgtaatcaatatgaaaacattatcgagatgccttacattcctttttcccgttacttctttgggatccagcgtgtattttacctttagaacccatgaggtcccacgtggtgagtgccccgggtgggaaccgcctgcagctcggggaggaacgaagctaccagagaactacagctcccggcatgctccgggcgcgccccgtgacgcacttcctttgcggtggccacagcgcgcccccggcggcgggagcgaggcgcctgtccgagaaccacatctcccggcatgcgcca

SEQ ID NO: 224820 - DNA, 217 bp, Homo sapiens
ggtagaaatggagttttgctatgttatgcaggctggtcttgaactcctgggatcaagtgatcctcccgcctcagcctcccagagtgttgggattacaggtgtgagccaccacgcctggcctctttttaatttgaagtaccaagctttccaacttagatctaaactctagacctaccactggttatagtgaagacaaaggctttaggtttaatttgat

SEQ ID NO: 224821 - DNA, 334 bp, Homo sapiens
caaggccaatgatcccatctgctgtgggctgggtcatgctcccaatgcttacagaacctgggaggcagaggaaaactctgcccatcccatgggacgttacctgtaagctttgaacaccagaatcttgaggcctatctctttctggaaggctttgtcttcctctaaaccaggaagctggagcaattccaccagattctgtacaacagatgcaacaagaaaattcatgaagagtagatcttaggttgaatttttcacagaagaccttgtaagaacagacaatggtgagaaaaaaaaagcccgaggtcaatacaatggggaaaagcctgtgaagtga

SEQ ID NO: 224822 - DNA, 307 bp, Homo sapiens
agtcagtaattaattcattttagagtaagttcatcttggggctgacaaagaggtgtagtagctaattttaaaagatgagtgtaacatctttcccatgtcatacatgtcaagattaaacttaaattatgtattatatattaatgaccttaattttattcataaactactgtaagtacaacagaaatcaatttagttctatttcagccatcatttctgggtgtgaacttctagtttctataaggaataaagagataggcatgaactagtacctgacctcatgaagcatacactgtagttggagacgtat

SEQ ID NO: 224823 - DNA, 523 bp, Homo sapiens
tccttataaaaagaaagaacgttaaaaataaatacaataaactcagaatgatgctattaaattctagctacaaatacattttaaccaaagatctgttttctctttttgtcaaaaagaaattagcaagtattggagactgactagcaccaaactgggtcttttccttggtgaactcagtaggattggaatgggaactttttcaccatgtggttcaatgttgcttaatgccctatcaatgcactgtccaaaatcatgccttataacattttaattccatcctttgggaaagaatgggttaaaaccttttttctttttaattattattttctagaaagttttagttacatgtccatatgcatttgtgtcatcccagctggacaacatatgaagctattatcaccctggagttaatggccctggtgaagttggcatttgggcattcctgctgatgttaaagtaacagggcattcagcgtggtacatgagccctttttccccccagggtcagaaatgcatctattaaa

SEQ ID NO: 224824 - DNA, 441 bp, Homo sapiens
tcactttggtctaaaactgtggagcagatcttcacagagggtggaacatgagagtccaggagatgaataaggaatttttagggttagaggatgggaaacaggaaggcaaaactatgggaacacagctgtggtttcagactgaatgagacatccattttaaaagtttttgtctataaatttactcctaccagaagctcttttgattttaaaataccgagcagaatgtatgaagctaactgtggaaagttaatagggcaataccagggtagccttgttttacccatttcatttatggtcccacttgggctgctgaaaaggaacttggtcctgggatgggtgatgaaatctatggttcatctgcctctggctgaattccaaaatcaagcatggattcattcattattttcccttccattcatctagaaaatcaagagttgagta

SEQ ID NO: 224825 - DNA, 274 bp, Homo sapiens
cgccaagtcctcagactctcccccagaagctcctgcggcaagtccccagctggcaagtccccatcccggcccgggcactgggggaatgtcaggacttaggagagagagggtcttgccccttggatccattgatactgagacaagatttattcttgtagctggccatggtggctcatgcctgtaatcccagcactttgggaggccaagacaggaggatcactcgagcccaggaatttgagaccagcctgggcaacatagtgagaccctgtctcta

SEQ ID NO: 224826 - DNA, 461 bp, Homo sapiens
tgatgcacaattctttgaaatatacgacatattagaacaaatttcaaaagagccctgtgtgacatgccagagccatggagcctgattagaactggagttggaatcatttgtggcactggatataatttaagacaccatgttgttccttaggaggaagccttatttataacagcagtaccatgctgcacaacagatgccagtggaaagtgaaacgatgatgaaattaatttgacctttcttaagcctgcagaacataaatcagatctatttaataaagatcaagtttgcaagaaataacttcaactgcagatgtgtaaatgcttcaatgaaagaaatgatggcaacatttgtacagttctgaatatagtttaaattagacaaaaatgatgaaaaaatgtagttcagagatgtgcaacttttcttcattaaatgtatgtggcatactaagaaatttggtcatt

SEQ ID NO: 224827 - DNA, 764 bp, Homo sapiens
atttatccatttatcagttaagaacgtttgggtttttttcactttttgggtattgtgaataacacttctaagaacatttgtgtacaaggtttcctggggatgtatgtttccatttctcatggctacatacctaagagtgaaattggtgggccatatggaaactctatgtttaaccatttcagaaggtgccagactgtttccagtgtacatgaaccattttatatacccactagctgtgtgagggtcccagtgtctctccatattcgagccaacatttattatcaactctctttttgataaagtcatcctagtggttctgaagttgcatctcatcgtagtttgcatttgtgtttctctgatgttgaacctctttcacgtacctattcgccacttgtatatcttctttggagcaatgtgtactcaacatttagtaatttttaactggtttgtgttttgtcattgagttataagaattctttatatattccagataaaaatgctttacaagatataatttgcagaaatattctcccattctatgggttgtcctttactttcttgatggtactctttgaagcacaaaagtttttactttggatgaagtccaatttatctattttttcttttgttacttgtggttttgatgtcatgtttaagaaaccgttagctagtcttaggtcatgaaatttattcctatgctttttccttttttaaaaaccatcttaaacattttaaattgtacaatttagtaatgttatgtatat

SEQ ID NO: 224828 - DNA, 334 bp, Homo sapiens
cagaatttggagtgcacctatgttgagccctagctatttcacttactataaaatcaatgtatcctcactgtgtcttcagtgaaatgtaaaatggagtctgtataggggttaggaacacagactctagagtttgactgcctgagtttaaataccaactctactatttactagctgtgtgaccttaggtaaattactgaatccttctgtgtctcaattttctcattagtaaaatgggatcaatgtgaagattaaatgagttaatgcatataaagcccgtagaagagtgcctctctcaaagtaaccctatatacatgtttgctgtttcaactgcata

SEQ ID NO: 224829 - DNA, 452 bp, Homo sapiens
ccgcagaatgcagttgagatgcatagaaaaagtctgggactacttacacctatttgctagcatgtctttgaagaatgttactagagagaagcaggtacaaccttgtgattattatgctttgaacttgatgctgtgctgaacacataaaaagagccctcatgatgagagattggaaggagaatgaaagaaaggaagcaagatcatccagagaaccatgaagtagtgaccttcagtgaccttcagtgatgaggtgaaaagtgtccggacaggatgagacctgtatacttgtaattttttctagaaatatctggaaaacaaagcaagagaagtagaagtatttgtagcttttactggagaagatttttgtatttttctaagtagatatgttagttgcccatgttagtaaaattttaaaatgttttaaaagtcttaaacatttttatctctagtgt

SEQ ID NO: 224830 - DNA, 239 bp, Homo sapiens
ttcctagaaaattttcttgtcatttatctgtatgtagaagtatatttctttaacaaatttatacctgtgggatcatgctatacaaaattcctatttgcattttcagttaatattatattggagatgtctcaattttagcagatgtatatgtatttcattttaatgactacctattattccatagtgtgaatgttaccataatttacttaaataaatctcacatttctggacatttaggt

SEQ ID NO: 224831 - DNA, 300 bp, Homo sapiens
caatggctccagaacctacagaaaggagagaagcagagaccgtgaatgtgcaaactgaacgcagaccaggagggcgccctgctgtggcacctgacatcctcactaggtcaagggaggcaggagagaaggcaacatcctgggacactcccagttgaccccaggacagtcacatctggagtggctgtgcacccctgccccgagctgcgcttgaaggaccctgtccttagcacatcatctgccaaaactctgccttaggcaaagtcctggttcttatcagctccagcatgcctcaaacttctg

SEQ ID NO: 224832 - DNA, 132 bp, Homo sapiens
gagaaaacatttttatctttataacttcattttttggtactgagtgcatattgttttttacttctttattacacaaataatacatgaataaagtttcatcataaaaactcaaacaatacagagatatacaaa

SEQ ID NO: 224833 - DNA, 872 bp, Homo sapiens
tttattttcacagaatatatattatcctgttgatttaaaaaattccagtgaacacagaaaacatgtgtcatctattttatgtgaattaaaaccaaaagatctaggcatgaaatcaaaaacatcaagacatctcattcaaaaagatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttc

SEQ ID NO: 224834 - DNA, 1094 bp, Homo sapiens
tttattttcacagaatatatattatcctgttgatttaaaaaattccagtgaacacagaaaacatgtgtcatctattttatgtgaattaaaaccaaaagatctaggcatgaaatcaaaaacatcaagacatctcattcaaaaagatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttccttgaagactgtaagatttttgtatatttacttttgatgggtttgccctgtttggtatacatgtgaagacagggaaaagacagaggagagaagcaagagacaacccatataattatatattggaatcataaaatatacagaaatggtatatattaaccataagtctgtttaatacataccaatggtagaaaatttgaaaaataaactgttaaaaaagacaga

SEQ ID NO: 224835 - DNA, 1115 bp, Homo sapiens
tttattttcacagaatatatattatcctgttgatttaaaaaattccagtgaacacagaaaacatgtgtcatctattttatgtgaattaaaaccaaaagatctaggcatgaaatcaaaaacatcaagacatctcattcaaaaaggtcaggagtctgaagatgaaattgtggatgaaaaattggataccagttttaggatatcagttttcaaactacccatatacacttcaggttcattgaagaataatgcagtattgagagagaaaaaacaacatttttttcctgcatatcctcagccaatctatactactcatccaaagccaatcattaaaaaagacatacgattggagcggagtatgaaagagttttttgcaccacaaagagctgatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttc

SEQ ID NO: 224836 - DNA, 1096 bp, Homo sapiens
aaagagttagagtagctgttaatgaacatttgaatcagaaaaaatatgctacacaaaaactaattgaagaaaataaagagacaattcagaacagtttacgacaagtttggcaaaacagattcaactaccttgaaaaagctagagagagaaaagctctgtttctaaaagaaaaatcccaaaaggcttcagagcgtttattagttcaaaacttaaataatgagcgcactcttttgaccagaggactacttaaaattgacagactggagaagaatgaggctgtcctaaaagagaaaagcctgattgttaagcaaaaactaaaagcagaaaaatatagaaagaatttacttaaagaaatgaaaaaagttagatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttc

SEQ ID NO: 224837 - DNA, 478 bp, Homo sapiens
ttgttttttatttttcttctgtatatgttgatgaaaaattaagaaagaaacagaaactaaaaatttaaagttactgaaaatatcacacctttttaaatgtttattatgagttttacattaaaaaaacttttaggttcaggggtacatgtgcaggtttgttatataagtaaacttgtgtaatgagggtttgctgtacagattacttttctcacccaggtactaagtgtagtacctgaaaattattttttcctgattttctccttcctcccaccctccactctgaggtaggccccagtgtctcttgtttctctgcttgtatccatgtgttctcattatttagctcctacttataagtgagaatatgcagtatttttttttgttgttgttattgttcctgcattagtttgctaggaatattggccaccagcttcatccatgtttctgcaaaggacatgatcgtgttctttattattgctgc

SEQ ID NO: 224838 - DNA, 259 bp, Homo sapiens
caaaaaaaagaaaaaaaaaactcgggtttgaacagtgtggcctgcaaagggacttggctctcatttacttcacctttctatcttattgccttgctttattttcatttcagcatttaggaaattttcttgttcttttgtttattgtctgtgttcctatccagaatgtaagctcctgagagcagaggcctcttctgtcctcttctgtcttattccctgctgtgtccagcacatggtctgcactcaataagtatttgttgcg

SEQ ID NO: 224839 - DNA, 402 bp, Homo sapiens
tcagatctgggaactccagacatgcatctcttaatagtgatggttagctagagccaagaagcaaagtttatagataatgcacttgatataaaatttaaaggtattacgaaatactctgggctgggcatggtggctcatgcctctaatcctagcactttgggaggccaaggctggtggagtgcctgagctcaggagtttgagaccagcctgggcaacacggcgaaacctcatctctactaaaaatacaaaatctagcccggtgtggcaatgtgcgcctgtagtcccagctactctgggatgaggcaggaaaattgcttgaaccagggaggcagaggttgcagtgagctgaaatcgcgcgactgaattccagcctgggcgacagagcgagactctgtctcagga

SEQ ID NO: 224840 - DNA, 449 bp, Homo sapiens
cagtttagtacacagtgttctcaagtgcacatggaagattattcaggacagacaaaatgttgggccatgacacaaacctcaatagatttttaaaagatttaaattgtataaagtatattctttagccacagtgaaaataaattagaaattggtaacagaaggaaatttaggaaattcaaaactatgtgaaaattaaataagattatttattgattactcctgaataatcaacagggcaaagaagaaatcacaaaggaaattagaaaatgttttgagataaaggtaagagaaaaacacaacatattaaaatttgtggtatgcagctaaagcaataaagggaattttaaaaatttatttagtagaggaaaatttatagctacaggtatttaagtaaaaaaaaatcttaaataacataacatttcattttaagaaactgtaaaaagaaagag

SEQ ID NO: 224841 - DNA, 497 bp, Homo sapiens
cagcatttatggatgagcaaagtaagtggtttcttgggatggacggtgaacactgcagacagcagggtaaggtcacttctgtcaggtccaaaccaaccgaggccagagagtacacagcggcagggctcacgcctgcatggctgagatgaggacagtgtcaaagacattctaaaataaccccacaaggaattccttatcaggaatgcagcaattcagacaagatgctctaggaagaacactggcccagcagcggcatctcaaccagtgaacggctgccaactctggttttcagcctcagagccagtgaactctgtttccaagcagcttatgtgaacttctcagccagggagagcttccctgcccctccctctccggcacatgggtggctcgccacactggctcatctctcgatgagagtcccccaccctctggccacagtggttcatctctggttataatcctttcttctaattcccaaatacatttgacatgtgaaa

SEQ ID NO: 224842 - DNA, 509 bp, Homo sapiens
ctagacctcccgtaactggtcgcaagtccaaccaccccaaatggggatttgaaggaaaggttgcattcaggcaggcacagaagggctgaaggttggacttgccaggcaaaggagtggaggtaggaaagtatttaatagtgggtagtgtggagggagtttcgagtgttacagtttggttgtattgtggaattcatgaagaggggcagccggaaattatggcaacgtggtttggggccaagttctggggcacctgatttgtagataattgtaagtcattgaaagttttggagcagtgaagttacatgaagatgaatctggcagcaagataacaattgagggaggcaggcttattggccaggctataataagactttagacaaaattaatgagcatttaaatgagtggcataagtgaggaagagaggttgaaaaataaattatggtaggatgaacagtataaagcagttaatcagatttgaggacaagggagatgggagaaataaactagat

SEQ ID NO: 224843 - DNA, 1191 bp, Homo sapiens
tcagaatatagattcctattatatttttatataatgattacctgtgaaacaactctttaaatttggaaacctatgtgagtaaaggataagatctattccctgtgacctcagagggtcagtgaactaggactaaagtggaaactactgaaaggtgcctttctaccttgtcaacactctccagaacagtacaggcttccacttaatgtaaaaacattcttatgcttaattgaagaaactagtagtggagatgggattagactgtaccttttaatttctaacattaccattttgtaaaagtagtggattttgttagccagcttggtaagaaggtatgatgacattgttaatagagtccacatcataatcaacaatttacaaagactataaacaatttttacctagtatctctgatgtataaggtcctcggctaagttctgtggaggcatataaattggcagaggccctgtctgtctacatataacttaacagggaagatgatgaatgctgaggcaggagaatcgcttaaacctgggaggcggagattgcagtgagccaagatcgtgccactgcactcagcctttgagagcaaaactccatcccagaaaaaaaagaagaaagagacaagaaataaagattaaggactaatagctgcagtgtcagtacaggaggggagagatttgtaggaaattaggggaagacttcatagaggcaaccacagccaaatggggatttgaaggaaaggttgcattcaggcaggcacagaagggctgaaggttggacttgccaggcaaaggagtggaggtaggaaagtatttaatagtgggtagtgtggagggagtttcgagtgttacagtttggttgtattgtggaattcatgaagaggggcagccggaaattatggcaacgtggtttggggccaagttctggggcacctgatttgtagataattgtaagtcattgaaagttttggagcagtgaagttacatgaagatgaatctggcagcaagataacaattgagggaggcaggcttattggccaggctataataagactttagacaaaattaatgagcatttaaatgagtggcataagtgaggaagagaggttgaaaaataaattatggtaggatgaacagtataaagcagttaatcagatttgaggacaagggagatgggagaaataaactagat

SEQ ID NO: 224844 - DNA, 460 bp, Homo sapiens
agttcaagaccagcctggccaacatggtgaaaccctgtctctactaaaaatacaaaaattagctgggcatagtggcaggcgcctgtaatcccagctactcgggaggctgaggcaggagaatcgcttaaacctgggaggcggagattgcagtgagccaagatcgtgccactgcactcagcctttgagagcaaaactccatcccagaaaaaaaagaagaaagagacaagaaataaagattaaggactaatagctgcagtgtcagtacaggaggggagagatttgtaggaaattaggggaagacttcatagaggcaaccacagccaaatggggatttgaaggaaaggttgcattcaggcaggcacagaagggctgaaggttggacttgccaggcaaaggagtggaggtaggaaagtatttaatagtgggtagtgtggagggagtttcgagtgttacagtttgg

SEQ ID NO: 224845 - DNA, 725 bp, Homo sapiens
gcaattaactacttttttcttaatttctctaactttggcccaactaaatattttcccatcattcctgttttgccgccctcgagctaggacatggaacttacttgttcggaaaagcttctatctgattgaaagggcatgctaattctttctttatagtgtaattgtttcacatttaagagggaaggagaaacgcctaaagtaataccacagaagaaataccctcaactaatctttctaagcagtacgacaatgagtaatgattacagttaattaagttaggcaacctccatttccattcacttagtagcactgctaattatactcatgctacaaggtttctttagttcttctgtaatttggatgcagtactctttgtagacaagggaatacggtacgattaatgagatttttcccaccaacacctcctgttctctccaaatgaaatttccgcatctgaaaattgagagtagggaacggagaaaaaaaaaatcagtcacattttaacttactgccagcacggtccatgcttataattgccaaatattttatattaaagaaaacaaggtgtgggtttttttttttgtttgaaaccttgtaaaattgtggcttacgtaaaaatgaaataagtatagaacatggctttttaaaaatatcagtggcaatgataatgacactttatattgtatgcttttggtcgcattaaataaacatatgttgagcacata

SEQ ID NO: 224846 - DNA, 376 bp, Homo sapiens
tagagcatcattttgtttcacattgttgtatgctaaaaataattttaaacctataagtatctgatgtatattagatgcttaatagaaaatgggatctataacactggagggaatatcacttagtaagagcccaatagataggaattgccctttaaaaatggaatctaataggcaaacacaaagcattgctgcacagtagcccaaagtaatttcttagcccagtggacttcagtaagacaaacacatctcaaaaatcatatcgaagaggccatatgtgttggggactagaatcttaaaggtaagtctggttttcacccagtaggccctaatggtacagctagaccagagtttacagctggacttcattgagattgtc

SEQ ID NO: 224847 - DNA, 835 bp, Homo sapiens
tgtggtaatgtaaactttgatatatagtctttttatttttctcttattaatctgccaaagatgggaacagatacaagaatttttcaaattggcttttgtaagacaattgatgattgtaatagtgtttaatcttccagaaagctttatatgttgttccacaataaaattgatatttgtttcagcaaagttttcctgacactcacaaacccacaaactgttcctcttaatgcagatattgtagaatctacaaagttcaaatccatttttgatccaaagaaagtagaggagtatttgagacatgagtgtacccagccctttttttaatcacaggcaatgcatgggtctggctggttacactttgccaagaagacttgtcttatgaaacccaaggtatattttgttatgccattttatgtccttttcttttaacattgtggaaagtggtatgttgaatcaagtgtaagctgagttttccagacaactgaagtagctacatcatgaatgttattttgttattaaagggtttttactcagtgctttgtgccaatggatgtccttttccttggagacacataactacaaaattacctcagcttggcctggttttctctcctgccctcttggggaaacatgggcctggcctgggaaaaggcaggtcatgggctggaaggtaggttttggtactaggaagaaatctctgtatctgtcagctttaaagagaactgggccaaaaatctctaacctcactctctctggactccaacacttccctgcaatcctttggtcttgagcatgtgccagcatgaaggcagactccagttcatacatgaaaggc

SEQ ID NO: 224848 - DNA, 447 bp, Homo sapiens
ccctgtaagtgattattaaacctccgcagtcctgggctcaactttgatcacctgtatggtgatgctgtcatttggtgattagggagtatgaaggtcaagttggaacttcagcagtttcaaagaaactcaagttgaagagggatgataagaatgtgtttgggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccaggaagcggagcttgcagtgagcgagattgcgccactgcagtccgcagtccggcctgggagacagagcgagactccgtctc

SEQ ID NO: 224849 - DNA, 389 bp, Homo sapiens
gatgctctacaatctggcccaggctgaccatatcctgcctggagggccgggtaagtggggcactcaggcttagaacagccacatgccttcccctccctgtgggacccacttccaagggagccagcctgaggcttgcatcactgtttggtctcctcctacccttccagatcttcctggtgctggagttagtgcccccttttttctcagctgagtcatgaccctcacccagcccagcccagccccctaccctagatctgctcctacacctgattgatgccctggcctcaggcagggctggagcttggggctggtgcctcgggccttcagccttgcccagggcagcctgggcagaagctgagattggatgtcatttgtcaaccttggcagag

SEQ ID NO: 224850 - DNA, 335 bp, Homo sapiens
tattttaacatagggtcctgccttgtcacccaggctggagtatggtggtgtgatcatagttcactgtaacctagaactcctaggctcaaatgatcctcctgtctcagcctcccaagtagccaggactacaggggtgtgccatcacacctggctaattttgttttttaagagactgggtttcactatgttggtcatgaactcaaaaacactgaatactaaagtatactaacactgaattgtacacgttaaagggttgaattttatgttattcaaactgtatctcaattcaaaaattcacgtgaaaataagattgcattaaaatattctagttcact

SEQ ID NO: 224851 - DNA, 330 bp, Homo sapiens
tcagtaaaggaaatgggcttctcacgtagaaggtgatatgcatggacatttatttaccattgtctgtccatagattgtggaatgaattggcttgtgtggaaaatacagaatgacctatccctggatcccagacagagttttggatactacaggttgtctctgcaaggaaggttacccagctcccttaaaatcattctataggaagttcccctccatgcttcttcatgcagtttaactctaatacctaaaaagaagagttgttctttccccttgatgtcacatcctctgtgtatattaagagtttaacttaaaaatgttacccatttcatt

SEQ ID NO: 224852 - DNA, 506 bp, Homo sapiens
aaaaggctcagagactcccccttccataagcccttagactgcagtgcttgtgcctttccccatactgcctcacctcacaggagggccaggcaccacttgtatctctcagatgcaaaactgccaacccctttctcctgtcttgggttggctggcactggggcgggcacctagggtatagtctctgcccatggcactgggcctccatttcttccacatatgtgtacctccagcttggccaaccctcagcctggctgtgaggcccaaagcatcttcccttccccttggagtctctgggattgggatgagtgcctggctcccatctccttctccccttttgtggctattggcagctgctggctcaggggcatcccacttccaggctctgggttccactctcagggaagggctctaggacccattcctacacccacccacggccaggagggccaaggtcccatgctggatatttaaatttagaggctggcttccagggtgcatagataaat

SEQ ID NO: 224853 - DNA, 694 bp, Homo sapiens
tggtttgtttgtttgtttgcagagacagggtctcactttgttgcccaggctggtcttgaactccttgcttcaagtaatgttcctgccttggccaccaaaagtgctgggattacaggcatgagacactatgcctagctaagaattttatatcctaccaaatcaagcttcataagttaaggaaaataaattctttctcagacaaacaaatgctaaggacattcactgatactagaatgacccaacaagaaaagcccaaaggagttctaaacatgaaaactaaaggatgatacttgccatcataaaaggacatataagtacaaagctcataatcctagaaagcattgaaactccaacacaacaggctaaaaactttatgacaggtacaaaacctcacatatcaatattaatcttgaatccaaataacctaaatattctacacaaaagctacaaagtggcaaattgtatttaaagacagacacagactcaaaacaaaggggtgtgtgatggttaacactgagtgtcaacttgattggatcgaaggatgcaaagtattgatcctgggtgtgtctgtgagggtgttgccaaaggagattaacatttgagtcagtcgagtgggaagggcagatccacccttaatttgggtgggcacaatctactcagctgccagcatggccagaataaaaattgggcaaaa

SEQ ID NO: 224854 - DNA, 216 bp, Homo sapiens
cagaagtatttaattggtcttcctcccctagagctgtacattttgttgcattgaaggcaaccttctgggctaagtattccgtggtcagaagtgaacaacagaaatggccagctgagaatgtggtaatggtttatcttcttagctgtgtgatgacatctgggctcatctaaaatcatagcaggtgttccgaagatgctggcttgaactgtgaagctt

SEQ ID NO: 224855 - DNA, 506 bp, Homo sapiens
tcacccctttcagcagcatatctgagagccaggggtggcagtgcttgggaaagcagctcactatgcacgccagtcactgtgcccagcaaggctgtgactcgacgtcccacagggtcctctgtcaccttcccaaattgccctctctgcttttccttgcagggatggcctgtgactcccccctcaacctgcctcaagaccagcagggcagtgggaaccaagagaggcatctaaggattgcaccggtcacctagcccagtcctggatcaagcttttgggtgtggttcagcccaggagaaggaggagtgagcgaggggggcaggaagacagcaggcaggctggccagtggctgtgggagggctgaagacatcccaaaggccccacttggttcccatgtccacccctgcagcggaggagtggccggcaggattccgagatgcagcccccagagccgcgaggaggaaggagcagaccctgaaggagaggaggcaggacaaatacaaaaaaaa

SEQ ID NO: 224856 - DNA, 324 bp, Homo sapiens
gccagtttttcccagggcttctattggcttcataatgtcagcctccgttctgtaaagctgtctggtcatagatgaaaatatgacattccagtcaaggccttggtaaaataaccagtgtttccaattgtgttctgttacaagaagaacagattcttactgagcttatgcaaataactacattaccataaaataagaatattcatgaatttcaacattttggagggataaggtagagagaaaggcaaatgtttcaattttgttcacaaaactatacccaattgctgtaaactttaagaggaataaaaggaagctccttaactttgg

SEQ ID NO: 224857 - DNA, 464 bp, Homo sapiens
cttctgtgaacccatcacccaaatactgaatgtagtacccaacaggtagtttttcagtccatatccctgcccccagtgactattatttccatctttatgtccatgtgtacccattatttagctcccacttataagtaagaacatataatattagattttctgtttctgatttagttcccttaggataatgacttccagttccatctatgttgctaaaaaggacatgatttcattcttttttatggttgcataatgcacagtgtgtgtgtgtgtgtgtatgtgtatatatatatatatatatatatatatgcatatataatattttctttagtcaaccattgatggacagtaggttgattctctaactttactgttgtgaatagtgctgtgataaacaaaagcaatcagtaccaattccaaaccctgtatccagaaaaggtacattaaaaaaaaaattcctaaaa

SEQ ID NO: 224858 - DNA, 388 bp, Homo sapiens
tcggctcactgcaacctccgcctcacgggttcaggcaattctcctgcctcagcctcctgagtagctgagattacaggcacacgccacgcttggctaacatttctctttctaaatgttttcatgttttctgtatttttcataatgggtgtgttttacttttaaaaagaggaggaaaaggctttgtttttaaaattaaattaagaatgatattaaaagaccatgtataaatcaaatctatgctgagagttcggccgtgtcagaaagacgcgtccatatcacaggaacagagaggagcacacggaggggagaggagagaggtgaaggggcagagggagttgctttccttgctcaacttttccttgtatgatttcgatgctgtttatttagg

SEQ ID NO: 224859 - DNA, 206 bp, Homo sapiens
caaattttcccatgtaagcctcgcttctctttccacttttcctttgatacgtatctctattttttcaggtaaaagtaatttgcttccacttgaaaatttttgttaatcattttttagacatcatatattaacaacacgcacacaaacacataaaggaagcattatatactcactcacccaaccctacctccacctttcctgtctct

SEQ ID NO: 224860 - DNA, 368 bp, Homo sapiens
agcgtgtattctttgaccagctttgcgctggggcccagcgactgaagggtgaacccaaacaacaggcagccctccccgagctcagtccagtgggaacacagacctcgactgcagagcaacagaaagataagccgggctggaggctcccggcccccatcttcccacagtgaccccattttgggaacaggaacccccatccctcgtcttgtttcgggattaggcttctccaaatctggcaccctatcaccttgactcctctcttgcccccccgccacatccaaagtgtctggaaagcctgtcactctacatgacaatgtaacctggtgctgcgggctcctcttccttgtcactccccttcctcgtcatcc

SEQ ID NO: 224861 - DNA, 382 bp, Homo sapiens
agcaggactccaatcataattaatccttttgggccgtatttaaagaaaattacttttcttagccctgttcacttatttctaaaatgtagttatttgctttatgttccaggatatccttgatcaaataatccttttctaaatcaacttatttcgacatatgtggccaatgtggctgtcatcctaacctcccttggcattcacacccagctctattttatttactatcctacttttagcactgtgagcataaaccataggttcttctttttacaggagaggttggatgccagtagcctttagcctccttcagcccatcctgtaccttgaacctggacatgatgtatagagccccagcaaccacttgataataaaccaacttgcc

SEQ ID NO: 224862 - DNA, 426 bp, Homo sapiens
gtgcacacaaatcacctgtgcatgttaaaatgcagacggtgacttacagatcttgggggaggccaagtgtctgcatttccaacaagctcccagatgatggccacactgctgatctgaggaccacattttgaacagcaatccttaaaacacacaaggctgtgggaccgcactcctgagaagagacctcactcttggaagggattctaggaggctgcattcaaaccatcccagagacagctcacaattttgttagggacctgatactaaaaattaccaaatcacaatcgtgtgctgagggcttactttgtgcttttcagatgacatttcatttgatgctctcaataaccctgaagggatttcagagatggggattatgatggagcttcagaattaaactgattaaaactggcccagagtcacacaact

SEQ ID NO: 224863 - DNA, 476 bp, Homo sapiens
cttggtcttcaggttctcctcgtgcttgttgagccggcggcgcatggcgcgtgtcttcttaggccgcaggtccaggggcttgtacttcttgcccttgtagaatttcctgaggtgatcttctagaagatcacctcttaaatgccatattattgcccacagttgccaaatacaaaatatcaagtcctctgctgaagaagactgaggtcccatcgtttcctgtgtcgcaggtcacttcttcaccaggtggctgactgcatcattgtgaggcagagccatgctgtgcaagtgtcataagtcatcccactttcaactctcaggaacactcgcagccagtgccacgctgtcctcgccatccaatattgatagccaccccagttcctgccagccagcctggcacacataaccataggatcccctctggtcatgggtcaccatgccttttcttaaactgcgcttctagtgacatggccttaaac

SEQ ID NO: 224864 - DNA, 447 bp, Homo sapiens
ttccactatgatttgtagtttgcattagtgtggtaaatttgttacaactgatgagtcaatgttgatacattattattaataaaacccatacacaagggctcactctttgtgttgtgcattctataggttttgataaatgtataatgacatttatccataattatagtatcacacagaatagtttcactgtcctaaaaatcctctgtgttccacctatttacccattcctcctctctaatgcctgatattcattatctttgtactgtatctagttttgtctcatccaggatgtcatgcagttgtaatcataccatatgtagccatttcagattggcttctttcacttagtagtatatatttaagattcttccatgtcttttcacagtgattgttttatttttataagctaaaatcgttttccaaaataaatgaaaactcttaatttta

SEQ ID NO: 224865 - DNA, 346 bp, Homo sapiens
tcagagcatggacggcggtctgaggaggaggccgtggagaaaatgggaagaaataatgagaatttcatttgaaatacacatttgtacacatcattccccaaacccaggtcataaactccagcaccctggagccaggaggtccctggcaggtagtcactgccctgaggcacaagactgaggtctttcatggctgaggggttgagttctgttgggtggaggtgcctcagcctgccttgaattccctgtgacaccaaatccaaataaatccaatgttgatctttgaggctggtgtcttagtctgttttctgtagctataactggacaccagagactgggtaatttgtat

SEQ ID NO: 224866 - DNA, 435 bp, Homo sapiens
aaaagcagcttaataattcagttcactcccttctttgataccttagctagtagtttgtaatgggtatgagcagttattccgaaggaatgagtaaagttgttgaaccacttgcaatatggtggtttcattccttcaataaaaattttagtgggccaggcatggtggctcacccctgtgataccagtacttcggtaggccgagacgggcagactgagctcaggagtttgagaccagcctgggcaacatggcagaatcccatctccacaaaaaatacaaaaaattagctggatgtggtggtggtgcacacctgtaatcctagctacttcaggaaggctgaggtgggaggatggcttcaggctgggaggcggaggttcagtgagctgagatcatgccactgcactttagcctggataatagagtgagattgtctcaaaa

SEQ ID NO: 224867 - DNA, 490 bp, Homo sapiens
cagattgaggcaatgtgttcagttaggggtcaccgtgactcagcatcagctttgagtggatttatgatgtagtataccactaatataaatatgataataacaaaatagctgcatttattgatgaagttctgggtggtgtcctaagggctttaagtatattttcttatttaaccttcacaataaccaataattaggtgttataattgtccccacattgtaaatgaagatattgggacttgtaatggtaattggcagtactggaacaggaacgatattattctctggctaatgtcattagaatagtattctcatttaggttaatcttggtgcttccttcttcagtaaactcatgttaaatttgtaccctccattctcatcttcctctaaaataaaagggagaaatttgttctgagctagaaaagggatgacttcagattggtttattcataaaaactcaagcaaagcactgttttatgaagctatttttgtg

SEQ ID NO: 224868 - DNA, 581 bp, Homo sapiens
tcaagcaagtatatctttgggccaactgtaacctataactctatagggaagaggtttctgagaactctgtgtcacagcttaaccatacgaagacaatacaaaccatcccgatgatgatgatggttggtaataatgaagaaaataatatgagtgttttctcaaggaaggctacttcttgatggcagttctgggagacataagagaagttttatttttacccaaatggttggtaaataaattactgtgtgacatgacagagttcaagttatatgatatagtagattcacattatgccaaaaactataagcctcccagacacagcccaggaattcattttgagagctatcataggcttctgaatgtgctaccatctatgctcttaatttaaaccttaatttgctgtgtggacgacagactactctgaaaaaaaccccaaatgcttcagtgcaggactatgtgtcgtggataaagtaacaaaattacatattcaacccattatggccatcctcttgtatgggagatgcagattgttaccaatatttaactcttataattaacttgaataaatttccttacaaaat

SEQ ID NO: 224869 - DNA, 825 bp, Homo sapiens
gtagtaggttgaagggtcaatgcggtgggagatattacaaaaggaaacttttctttccagaaagaaagaacttagattacagacagggccacagatgggaatttgttcagcatttccaagctgctttgaaatcctgttggtggcagctgccgtttccccgagagttaccgttgtttagcattgcggtagactgttcctcccaggcagctgttgtgactgagtttcgattgatcccatttctacaaggctccattagcatcttcgacttattgattttttttttttcttagagctggaagagacttttagcaatcaactagttcaacctcttcattttacagatgagaaaagtgagaccaagacatgcagtgtttttccaaggtcacaagcagcatttctggtagagacagagctaaaatctaggactccaggctgctgtatccataccgatacccacagctctcagccacttgggggtctttgaggtagcatgatgtcaggaaatagacatggctgcagtaaaacagacttggattcagattttaccacttctagccctgaagccttaagcaagatatgtcctcttagtctgtatctatcaacagacaatactactgtcatttaattcctaatgaacatgttagtcaagactttttgggctgcaacagagaggaagtttctcagctcctataacaaaaagcccaggagctggatccagtgcttaagcgaaatcatttagaatccccagccatcttggcttactttcttccaagttaagtttattctcaggagggcgttcttggtgatgggaaagttggacaccag

SEQ ID NO: 224870 - DNA, 488 bp, Homo sapiens
cagtcttcaaattttggacccatgaagggaggaaactttggaggtggaagctctgacccctatgggggtggaggccaatacttggccaaaccacaaaaccaaggtggctatggcggttccagtagcagcagtagctatggcaatggcagaagattttaattagggaacaaagcttagctggagaggagagccagagaagtgacagggaagcttcaggttataacagatttgtgaactcagtcaagcacagtggtggcaaggtctagctgctacaaagaagacatgttttagacaaatactcatgtgtatgggcaaaaataggactgtatttgtgactaactgtataacaggttattttagtttctgttctgtgcaaagtgtaaagcattccaacaaagggttttaatgtagatttttttttgcacccatgctgttgattgctaaatgtaatagtctgatcatgacgctgaataaatgtctttttttta

SEQ ID NO: 224871 - DNA, 709 bp, Homo sapiens
ggctgggagagaccagggatacgagagaggagagagagcctgcagatttctcggctcccatcctagaccatgaagaccccgtgctctgggaattccgtgcctgtctggcacacagatggtgctctgaggctaggaaatcaaggggttttctccaagtttgtttgaaagccctggaatcgacagggaagtgttcctgggagagggtctggctgtgtccccaggcaagaggccccatagtgattttccaggcctttcctggagtggcctcactgtagccattgggtggaggccacaccaagatgcactggagcttgggtctagtctgcttcccaaacctacacttgccccctccactgcactgtctttgagatggaggaggttgatagagccactctagttatcactggtcaggcaacatcaagagtctaggtttggtcctgggccaggtttttcttcaactggaaagcatacggtgaaagatgatcacacattcatcaagtgtttgaatgactcacacataagcttggcagaaaaaccttagttttttcccagttcactcatgtactaagcatttatcaagcaactctcagttgccttgtggcagacactgacctaggcactagggatatgacaaagaactatgcaggctgggctcagtggctcacacctgtaaatcacagcaatttgggaggctgaggccggaggatct

SEQ ID NO: 224872 - DNA, 601 bp, Homo sapiens
tatatgattgggtagaaactggacagatgagcaagtccaaagcaagcccacaaggggagaaataatccaaactgtaattagaaaatggtatctgttctgggagttaaaatccaagactgaaatcatagaagtctacatgtgactgtgttccgtgaaagctagagaaattactgtggcttaaagagactgcacagtaaaaacccagtccttcttgtggccaagaaggattctgggaagaaagcagagtgttgttttctagtatgaaatcatgatatgtgtatgaaatagcaggtaaggtcaccgcatgtcaagaaatacacaacagagctccgagtaaaaataaaggccgaaaaaaattaaaacatgaagtttgagccatttccatgtaagagtagacatgcagatgtcaatgtagaaaaacctaagccgatatatgatcaaaatgaataaaattatgaataaattgacaaggtatatataaagatttgttcaccaaagtataaaatacttgatctagaataatttttttttttaatttagaagtgttatgctataaaacccaattctttccaatgctgaaaatccaaataggtttaggaaa

SEQ ID NO: 224873 - DNA, 375 bp, Homo sapiens
atttaaattactgtattataatgttttctttctgttgagcaatgtgattttaaaatgcagatacaattactgcattatatagattatggtgatttctatacttcagcttgcagcctttttaccaaaaaaaatctgtactcttttcttatagatctacacttttcctgtttgtaataaatgttggtccatgtctgtgtgattattcagatttttactttaaaactcaatatgcttttttatctagtttcttagatgcatatataaatgtagaatagagatgtattacaagaaaaaagtacttgtaaacagaactgagtgataatctgaaagtgctttgaataaagtactgtttgataagcaaaggaaatatttgca

SEQ ID NO: 224874 - DNA, 880 bp, Homo sapiens
aagccagtgtacagaaacaggtgtcgcatcagtaggcattctccagaggccgaccaatatattggagagacggattaatagacggatgatagtgggtttgtcaggggaattggcccatgcggttagggaggccgagaagtcccgggagggatgccatctgcaagccggagacctgggatgctggcagcctggctcggtccaagtcaggaaacggaagaaccaggggagctaaaggtgtgactcaggccagggctgaaagctgagaatccaaggagccgctggtgttaagtcctggagtcccaaggctgggggccctgtccaagggcaggaggaggaagagagagtcccagcgccaggaacaagagcagaacttcttttccctctttttttttttttttttgacagagtctcgctctgtctcctaggctagagacagaatgcagtgcagtggcacgacctcagctcactgcagcgttcacctcccaggttcaagcgagtctcctgcctcagtctgcagagtagctgggactacaggtgcatgccaccatgcctggcaatttgttttgtattttttaggagagatggggtatcaccatggccaggctagtcgcgaactcctgacctcaagtgatccgcctgcctcagcctcccaaagtgctgggattacaggcgtggaccatcgtgcccagcccctttttgttctatctgggcccccaggcgattgatggtatccgcccccatggagggtcttccccttggtcccccgacccccaggcaggctcctctggaaaccccctcgcagacacacccagaagcagcgccttatgaggtctctagggatcccttcacccagccaagtaggtgcttgagatgacccacg

SEQ ID NO: 224875 - DNA, 519 bp, Homo sapiens
gtgggaggattgcttgagcccaggagtttgagaccaacttagggaacatagtaagagaccaacttggggaacatattaagaccccatctaaaaaaatgacaataaaaatccaactcgatcatgtataatctttttgatatgttggtagattcagttttctaatatattgttgagattttttgcatctatgttcatcagggatattagcctgtagttttcttttttgttgtatttttgtgtagaattataaaaaaagatctacacaatatatcttctaattggagattgtggttgaaatgtgatctttttatatacaattgtttcaaattagacattgaagtttttaatacacttatttataactggcatttaaattataacctcaaacaacagtatttactcaaactatgatttttcgactattagccaatatgtggcagttagaattttggctgtttcctgaaagaaacttccccaaatatctgtgaaaagtattatgaattaaagatatattaattc

SEQ ID NO: 224876 - DNA, 505 bp, Homo sapiens
gttttacttcaggttgagactagtctcctttggtgaagtgttgatataatatgactaaatgcttaataaaggggacaggataagactgcagataacaagtatattagatacttggtagacattttatatatgttaccttatttaacaaatatacctggccttatacatacaaatgattattgtccccttcaaaatgggcccctttggagagctgtagtctagtgatgcggtaattgcccaaaacagttgtagaatcgtcttttataatggcttactggcttgataatatgatctttctaatacagtcctaatggcaagccattatggtttgggagtaggtttaatttttgtaaataaacaagatcagacccaagataagtgaccaagttcaataaaaacttttttttttaaatcaaagcaaagtatatctgcagtaaaataatgaaacccattttcttggtttacaaactggcttagaaatctttgaactaaagatttatggtga

SEQ ID NO: 224877 - DNA, 508 bp, Homo sapiens
tataagatcactgggtttatcttatgttcatgctgctgttacttcagctctgtgaattggcccacgtgaggctcacttccttcctcttatttccttgccaggtgtcttgcgtggtctgcactgctcttcccttttcatccctacaggcttccacagcaactcatgtcttcattttatcttgtcatttcctccacctccctcctgcctgtatccttgctattttcaaattcaataagtgctgattttctgataaaattaacttcctgaatgaaccctaacatggtagtaaaacaaaatttgtgatctaaaagccaaatgttttttccctttagttatattggcaaatagtcttactagttaagaaatgcctttaaacaccaagtacagtgctagctgcagtggcttacacctataatcctagcattttgggagaccaagataggaggctcacttaacgccaagagttcaaaaccagcctgagcaacgtagcaaaacccagtctctacag

SEQ ID NO: 224878 - DNA, 489 bp, Homo sapiens
gaagcacagtaataggggaagatgcataatttcctgtccccttgtagatgcaatacctctacaaaacaacttaccaaatacattagtgaatgtccatttttgtaaagaaatctttacttgaaaaagtaatttatctttataagagtttaagtcagtgtcccaccaccttcctacttggatgtgggctgcatttagtgactcacttgcaaaaggtatcttatggaaagacagggacaaataattttacaatggagtagcctggcaaacactacctccctaggtcaccaaggtcaccatcaacagtggtaagtcctgtgggtagcttgtaccccggctatgaatgactcttctgcaggcttcctctccaaatctataaccccagtacaattaggggaaaacattagaaaaattccaaatgaaggacattctgcaaaatccctgactggtacccaaagctgtccaggtcatcaaaagcagggaaagtcggag

SEQ ID NO: 224879 - DNA, 351 bp, Homo sapiens
ctgttgacatctaagtgaatgcacatgagggcctctgcaccagcacaggtgcaggaatagagaaccagtgagacacctgaggaccagcttgggctcatgccaccaccagcacactgccctgagatgctcccccatggctccttcgtcctggtgaggtagtgtcaatcgccgaaattacctgggggatgattatttacacatttccaaaagtatagctccaaataaggggctcaggctttattcacttttcggtagcatgtgccatgctccaggcactgtgccatggtgaacacacagacatggagtttgtagatatgtgaggaaaacagataaagacaaatacatacaaat

SEQ ID NO: 224880 - DNA, 940 bp, Homo sapiens
tccaggtccagcacacaaactcacagtaatgaattcatgaataactcattgattacagttcaggaaacggcctcagagaggtgaggagacgcccacagtcgcgtggcatggtgcacctgtgttctgaactgtcacttgcctctccctgtgagcctctctttactctgccttgtcttcttgtcctggggcaagaagttagggttcaagacccttcgggatgtgaggatgtttctgccactctggacattagttttctcccctaagtggctctatctctcccggcctgagtttggaagggagacaccattctggtacgacttttcttaggcctgtgctgccatctatggggctcgaaggtgctcgccatgctccagaccggccacctggcagtcaggtgagcttgcaagtgtgaagagcagcgggatgcgggggagggagcaagcccagtaacaaataaagcaaatatcatcggcccttgtcctcagctgctcgctcaggccccccagaatcctgtagcatttctggggattaagagggtggtggggttttcacctctatcacgtctactgccagcctggcgcccaaaggttcggccgtcatccgccccagcgggtccctggaaccgccgggatgcccaggctgccagggggtctaatggggaactgggagtttctttcaggtcacaggataggtctgcagtgcgactcaggctcccgcggggacctgcccactcgaacgggggaggaggaagaggctccgggggagagccaaggaggcggggaagaggagcggcgtcccgggaaaggggatgctggagctcctgccgacgctccacctgtagccccgcccttgactccgcccacttccccagcccctcccttccaggcgcagcctcgaggtggcgctgtggagccgcgcagggtctagggcgactctctga

SEQ ID NO: 224881 - DNA, 471 bp, Homo sapiens
  misc_feature (402)..(402): n is a, c, g, or t
gaagtctataaaggaaggctagaggagagagagaagcaaaggaaggctggaggagagagagaagcactgaaagagacatcgtggcaattggcatggcacatgggctagaaattaaaataggactcacggactgtgaaggaagcctggtttattttaggctgttgtctacgaatttgtagcagtaatgctccccctggctgtgtgaggacaactagcaattctcagaaccaaatgcaaattctgagaagccaggaagttagattcatcaagggtgaagatttctgccagactcttgttgagaacagtagatcaaagcaggtttgtatgttgctaggaggtggcttgtaaggaaatgaagaaagagggagaattgcttgccttgggggaggcgggaggttgcantgagccatgatcgcaccactgtactccagcctggatgacagaatgagactctgtctcaaaaaaaacaaa

SEQ ID NO: 224882 - DNA, 359 bp, Homo sapiens
tgggtggcagaggccaccagacactcccttcctagaatgttccagaagctctctcatgtagctatggaaatacattgagacatccctcaagattattttcatttaggtgctgtctttaactttttaaaaattttagtcacaaatcactggaagttccaacaggtgagcgtgagatcatgttgcattcacctaacagagcacctggcaatgagtctgggcatgataaatatttgccaagtgtcgctgaattggaactgggatttaaagagacaaccaaacagcaatttctgttaaccctccaagttatccaaatccaaatcttcctttatgattcaaattctagttgttagttgttgctt

SEQ ID NO: 224883 - DNA, 359 bp, Homo sapiens
tgcagaacattgtgaatacactaaatacggctgagctgcacacttaaaatgcttaattgtatgttatgtgaattttgcctcaataaaacattgggctataatatactggttcatttatgcaaatacttgagaacctaccatatgccaggcacactcctagtacacaggttaaggtaatagaaatacattctctgcaggccgggtgtgggggctcctaaagtatttttaattaaggtatatacattgtgttttagacacttcgcagcctacagtacagtgtaaatcctttttttttttttttttttttttttaaagggggggggcctggggggttgcccaagggggttccaaaacccggg

SEQ ID NO: 224884 - DNA, 524 bp, Homo sapiens
ggatatggggactctgacctctccggatggtgtttgcagaaggtcgtggttggttgcacggagtcatataatcctgaagtggcaacagtgcacacagtgaggaaaggggtgggtgattgggtggctgagagtgttgagagccttggagtgaatgatttccagacctgttagttttctagacgcagtaacaaagtaccacaaactaggtggctttaaacaacagaaacttagtctcaatgttctggaggctgaaagttcacgaggaaggtgcccgcagggccatgccctctgaaggttctagaggagcatctgcccatgcctttctcttatcttccagcgttgctgcaatccttggcattccttggcccctaggactccaatctctgcctctgccatcacatggcacctccctgtgcatctcattttatattcccctcatttcatatggataccagtcattgcatcaggacccaccctaatccaatatcacctcatttttgctaagtgatacttgcaaaaggatg

SEQ ID NO: 224885 - DNA, 304 bp, Homo sapiens
cttttgttttattttccaggagatgtctaataatgcttctattgaatttttcatatcggctagaatgtttttaattctaaagtttcatttaattataattttttaaagtagcatcctattcatgtttcatagttggactgttgtttcgtatccaatacagttataaagttttctcccagcagaagtcctcattttctctacattgctgttttgtgttgataaaacttttctcaaaagcctaccaattctagatctgtcttttcataaagagtagaatattaaaaaaatataagttctataagta

SEQ ID NO: 224886 - DNA, 663 bp, Homo sapiens
aagaagggaaggaagggaagaagggaaggaaggaagaaagagagagagagaaagagaaaagaaagaaagagaaagaaaaagaaagaaggaaagaaggaaagaaagaacgagaagaaagaaagaaaaagaaagaaagaaagaaacaaagaaagagaaagaaaagggaaatggggtccgaccagtgctggggactagatcccggcctccgagtgaaagcagagcgcgtatgaccgatgtcagttgcagagtcaaacagctggagccgcccagtctgaggagcgccaggagatcaaagtgcaggacgggtcacagaggcaggaccagggtcctggaagtatatgttagtccctctctcttctcgttcctaaggagtcgttctccggacccagcatcctttctccttctttcttgtccttggcagacacagagcagagtagagtaaagaccttcgggctcaggttgttcgagaaagcagagctgggtttggctttagcaaagaaacagctaaagcaaacctgggctttcgtagacctgttctgagaagagatccccctggccgggacccaccatttgggttatgcttgctgcgttatcttctcatgaaaggccgatcttatcactcatactattgcgcatgagacaggcatgagacctctcacacta

SEQ ID NO: 224887 - DNA, 475 bp, Homo sapiens
aacagggggtaatatttgtacttagctcccaaagttctgatgaaggaggattaaattaattaataaggtaaaccactttaagagaacctggcacatcgagccactgtgttggttattgttattattgctaatgtcagaaaatatattacaatcaaaaggaaagagaccagagttgcataagtaattaacaataatcatcaaatatcaaagtacgaaatgcttcatctgagacaaacataattattagtaaggaataatcaatgaaaaataaatatttgttacacctatagccaatggagtaataaaaaaaacttaccagctgacagttaatatatagtataatctttttggagtatctttttgtacaaatttctctgggtagacatcaatctttttacattacctagcacctaccaactagcctgaagcccttaacaagctgttacgtggggtggtttaaaacagtaacaagaaa

SEQ ID NO: 224888 - DNA, 313 bp, Homo sapiens
acttatcagaaaggcagattctcaggtctcacttcaaatctgttaaattagaaactctgggggtgatagggccagcgatctgtgtttgcacaaaccctccaggtgacttagatgtgtgttaaagttgaaggccgccgatctagagaaacgtggctgcctatttgccctcaatttcctagtgaacctccctaaccacacatgcagaggtgaaaactctcagtatacaacattctcaacatagaccctcttactatacgtaaaaaaaaaattccattcttgtatttttttcttgaaatcattccattatttagga

SEQ ID NO: 224889 - DNA, 238 bp, Homo sapiens
tttttttttaaaccacccctcttccacaaagaaaaactttaaatttgcttctggtccagcaactcaattttgtgtgacatattgcaatatatatgcccttcaaatacagttgacccttgaacaacacaggtttgaactgtgtgggtccacttatataaggattttctgctgcctctgccacccctaaggcagcaagaacaaccccgcccccttcctcctcctctgcctatgcagcatg

SEQ ID NO: 224890 - DNA, 313 bp, Homo sapiens
gaaagctgtggagtgatggttgctaatttgcagccaggagtgtaagaattatctcaagttctcatttaaattctgagtagaaatctccagagacctttactaacaacttctagtgtttttaacatccaaagtgttacaatttttatcatcactaatactattaacattattatttgcagtagctgagagaaacacggtcttgagtcactgcaagtatagacgcttacgataaaaatatttgatgacgccatcgtaacctagtgacaaaacatgtaataaaacaagtgtttggaagtactggtttgactagttg

SEQ ID NO: 224891 - DNA, 461 bp, Homo sapiens
tccaatatgactggtgttcttataagaaaagattaggacacagacaggtacagaagggaggccttgtgaggtcacagggagaaggtggccatctgcaggctggggagggaggcttctaaagaaaccaactgcttggcaaggtgttagagtgctggcagcagagaatggttggctcatgggtagtaaggggaatttaccaacaacagtataggtttgaaaagggaagttgtattagacagaaagaacgctgcagcagagttcagcggggcgcttcagcgagaggactgggcgtgccagggtagattttccttagagccatttatggaccttaaagcgggaacttaagggtaatttggaccatgttagccgcgtaggtcacggtacatgattacatttgtaaacatttcagtgccttgatgtcagcaagggttgcatgatgagtttctatatgcatgcattcc

SEQ ID NO: 224892 - DNA, 503 bp, Homo sapiens
agtttgatgaaagcattcataaatttcaaataattagaggaatatctgctcaagaaatacagactggaaatgtgaaatctgccaaatggttgtttgaaacccaacctcttgattcaattaaatattttagtgatgtggaagaaacagaaagtaagaactgaacaaactagagatattgttaaaggggatgtcaaaacctgtaaatggctttttgagacccagccaatggagtctctttatgaaaaagtttcgttaatgaccagcagtgaagaaattcataagggagatgtcaaaacttgtacttggctctttgaaactcagccacttgataccataaaagatgactctgaaacagcagtcaaattgcaaactgtaaaacaggaggagatccaaggtggggatgttcgtacagccatttggcagatttcacatttccagtctgtatttcttgagcagatattcctctaattatttgaaatttatgaatgctttcatcaaactgg

SEQ ID NO: 224893 - DNA, 632 bp, Homo sapiens
catggcgcagagcggaggcgcggctttctggggctcagccctagggctacagacccagggcgcggagatgctcgcggccgggccacccaccagagccaggcaaccggcgcttccaggcgagctccgcggggccgaggtgccgggagaagcggccccgggcgcccgcgcgctgcccgacctgggtaacaggcaaagcggagccccggggtcgaagtcctaaagttactaatcccgcggagggggagagagcgtgcctcgggccgcccggggcggtcatttgagcgtgtttacttaaagactttgcaagcagagcgcgcgcgaaatcgtcggatttccagcgaggcagcaaatatttgcaggcagaagaaagaagcggagccgagccgagccgccgagtccctccccccggagccccggagccccggcgcctgcctgggcggtcccggccgcgcagacagaaaagaagccgggaatctgcggggctggggggcggggagcgacaccaaaggccagaaactgcagcacggcccgaggccctggcgagctgggcctgggggaggagaagtcccttcccattccagctcgatcaatcttgctgggctgcgatcggtcaataaaaacggtgtgaagcg

SEQ ID NO: 224894 - DNA, 359 bp, Homo sapiens
ggaatccacagatgtaactagacgtaactgatgaattgcaagaagttagaagcctgaagaatgcagccgacatgaaaggcttttattcatacaggtgatgtgatctaaatgactgactgcatatttagaaaataggaagagtgtgagggacggcagcaagggtgaagaatcgcccctcaccagacaagactacaacaaaattaactgagtcctcatttcagctttaaaataaacaaaaggggctgggcatggtggttcactcctgtaatcccagcactttgggaggccaaggcaggcagatttcttgagctcaggagttagagaacagcctggacaatatggtgaaaccccatctctac

SEQ ID NO: 224895 - DNA, 817 bp, Homo sapiens
actagccctaggcctgccttgtcccaggagtttcttcaccttaatcacagaccaaattgcatacttttatcttcgaatcatctaaaatataatttcaaatcacaagacagaataaaataatctttgagagaggcagaaccttagaaaggagatattttatctcatttattttatagatgaagaaagtaaacttcagagagatcaaagtgatttgtctcaggtcacataaccagtggcagaaagaagagaattgctggaatgtcaagataagaatgaattctaggtttaaagttgtttaagtatatcccaaattaaatatttcattcctgagctctaaaacctatttacattgaagcctgatgtcctaaacacggtaattacaaagctgggtaatggtctccatcctttcctttcatgaatccatgtatgaaagttagctttatcaaactatttcatctccagaaaggcatgtacatttcatactgttcaagtctgtaattgtcagcaaaatcagacccaagaccgctagcttctcaattcagcctacagactgctcctctaatagacacactggactctcagggaggtagaatgggcaagctctaacaaaggacagcacttctgtgatggtgtggaagtaccaaaggtttgactgtactttaaaaaggtgacatgcatgagccaccacgcccgcccatgtaatgtgtattttatagtttaaaaaaaaaacttataaaatagtgtggtactcagacacagatcattggaacaaaaatccagaaacagacccacacatatatggtcacaaggcgaaggt

SEQ ID NO: 224896 - DNA, 328 bp, Homo sapiens
taaaacatttaaaaaaaaagaaaaccacactccaaggtgggccttcttgatatcacagctacctagatcagttctctccaaaaaccctgtaacaatgactctacaaaagcagtaaacaagaaaaaagatgagagtaatagaattggaaagccaaagaacatatgagtaagtgtaactgacttagcagaaagacccaagaacatcaaatactcaaacaacaaagcaagcagagactgaatctgattcaccgttatcagacgcccataagtctcaggaatggctgtataaagttgtagtgaaattgaaataaaacaagaaggttggctga

SEQ ID NO: 224897 - DNA, 447 bp, Homo sapiens
acaaatgaacatcaaacatgagtcaggcactggggatacaatggtgagaaacatgcatagccttcatcatcactgagcttacactgagtgactttaaatgttcttttaggatgtgaaagattatggcagcttcaaaaattaagctaagaagctctccatcattttctatgacttgagtttaaagcacaagatttagctcttatgatttttaatcataaatctgagtgggctggaggctttttatttgtgagtacagaactttggcatctttgttccagtcctgtctgtagttattgacttaattcagttttccaccttttttgagttatgttttccttgaaaagtgactatttcattttctattaatatttattggcggtataaaattgtataaaatattttaataatttttaaacctcccttttattaaattaccaaccttactag

SEQ ID NO: 224898 - DNA, 360 bp, Homo sapiens
agaatattttcctatctaaagagagattcaaatgcctctggtaatgacagaatttcagagacatttaaaggtctcaattcttgatgtaaacattgagtcaagattgaaatagctatcctgaaattatctaggttttggaaactttagcagctctccacagagcacagagtgtccttcttcactgtggcaacactcagggaatcccctttcctggacaagaggcacacatcacatgtttccaggaactttcgtcttttccatcaattaaaaaaaagtacaaggtgcagacaccagtctgggtcttatcttgtataggaaaagttcattttcatctcccagaagtcagggaagtaaataaaa

SEQ ID NO: 224899 - DNA, 378 bp, Homo sapiens
tccactgtaagaatgttagtatgttcattttctttgctatttgaaagaggtggataattttgttaggtgttagcaggaaacaactgtctgattagagattattaactaagcagtagaaagtgaaattgcagttttgtttactcattttgtggggtctctgagtcctcaaaaactttctaaagtgtgatagttttttaagaagctaggaaacaagtcagaacaccagatatttctgagcccatgatatttatgactatctgatattctctattcgtcacccaaaaagttgaactcctatctatatttctaacctaggttgagaatatcatttactgtttaaagctgaatattggggttcttgaaaaaattcctacctgg

SEQ ID NO: 224900 - DNA, 501 bp, Homo sapiens
atattagttaacatgtattttggggtagaggaaggaaaaatgagaacttatttaaacaatggctctaacatgcattaaaacagagaacattctaattccctgtgcattcttagacaggtgagtgccaggactatctgttagacactgtacaaaaacaatatctatcctctatgtagcactaatcattgactatttattctttattctaatagtatttttctctatcataattacttatgggtgttactgaatgggatttatttaagattatgtgcaaaatacatttcaaatacgtgagagaaagttggccacaaagacagtgatccaattatttaggtcaaggaaatcaaagtaacatcgataaaaaaaagaaaactaaagccaaaaagtaacatttagagccaacatttctaattgacttttcatatttagttagaatttgtagtgtgatgaaaatataaagctgtcgttctgtacatagcaaattgatttttttaatac

SEQ ID NO: 224901 - DNA, 253 bp, Homo sapiens
tcaatatctgatactcaaactttaaaatgttcgctaatctcttgggtgtgaaataatttcatttcttttcttttttttgagaaacagcccaggctggagtgcagtggcgtgatctcagctcactgcaacctccacctccttggttcaaacaaatttcctgcctcagcttcccaagtagctgggactacaggtgtgacacgtcattacgttatcgcaagtggtgcagaggtaaccacaaaaacctttactgtgg

SEQ ID NO: 224902 - DNA, 414 bp, Homo sapiens
gatatgtaaatgaaaatttatattccagtcaaggaacgtacccaatgagagtacataaattatatatgtattatgcaagataatagttgttacagacatttcatcaaaagccattttaaaaactgcaaaatatgtcaagatgtttacatggtgaaatgaaatttcataatatggcaccttaaaacaatctcacattagattgctgcacctcagaaaagcactattgatatttcactgagccaaagaataatcataattcccttatcaagtgaatatagtggaaaggaaccaggctgaaagtcaaatagaaacaccattttctcaaataataatatattattaataatgatacatatctgaaggcttaagtttcaagatccgaaaattccagaagtataaaatgccacatattat

SEQ ID NO: 224903 - DNA, 709 bp, Homo sapiens
tttgagataatcatatggttccttttaatctattaatgtggtaaagtacattgattttctgatgttaaagaatcctcgcacttctgggatgcaatttcgtgatttttttctccatctctgggggagtttgtgtcccttgaattttagttgcattcatctgttaaactgggattattgtgtttgtagtgtgtggtatggttggttttaggggctatttagatttactgtttcttctagaaagttgtaggtttttctaaaaatgtatcctttttggtcatcgagttgtttaaaatatttttattttcaagtacttgttctatttgaacttagtcccttttttctttcctgatattgcttatttgtatcctctcttggtaatgtttctagagatgtgtcaactttactagtcttttaaaataactgactttttgaacttttgcaaaaatcaacttttatcaaagtgcacaataaaattcacccacttaaaggtgtttgctatgtttgacgaagatattacccttgtaactaccaccataattgtgtgtgtggttataatagttccttcttctcctcctccctccctctctcttcctcctccctatcttcctccttctcctttcacccctttctctttcttcctcccttcttcctttcttccttccacagttctgtcttaaaatgaacaggaaaaaagaatggaaaagaaaat

SEQ ID NO: 224904 - DNA, 435 bp, Homo sapiens
agtctagctctgttacccaggctggagtacagtggcatgatctcggctcactgcaacctctgcctcctgggttcaagcgattctcctgcctcagcctcccaaagtgctgggattacaggcatgagccactgcacccggcccagctattattattatgaatttgcaaactaagatttttctaaaaagctttcactggaatgtttatgtattcccatccaatatttgtatttctttaaaaatatgtctagactgtaaatgaactgcagattctccagtgttcatataaaattaaaacatattatcagaaggtaatatagatagtataatcagaaagtattatattgcaaataagttttcttcaaatttggtagatctacaaaaattttatttggcctatgaaatctccctagcttacctgacctttatgatcttgta

SEQ ID NO: 224905 - DNA, 409 bp, Homo sapiens
ggttcaaaggactacttcgatagtggtacagacccctgacaaaagaaatcaccttttgtaaatgtcatcgctgcaaatgagcaatgtgacggggaactagtgagatgccattgagactggaacccaccccactggaggcagctgagcgaattcgtggatgactaaatgtcggaatactaagttaggagaggggtgcgtgtcatccaaggaatgacgtgcgctcacactgtgcctcaagtgacacagatcatagtagattccagcggaacacttgcagctgtgttgagttcctcaaactaccacaaaactcttatggtaaaacttgtgagaggtggagttaagagagtatgagccctgtgatcgaatccaaatatgaattgtaaaacatgccttaatactatcaccagta

SEQ ID NO: 224906 - DNA, 579 bp, Homo sapiens
aggctgtcagagtggttgcactttacctgcacgccccccaacccagccctctgtgaagggttggtttacatcagggatggctgctcctgacataattgtctatttccggcaacagaggaagataccttctgccatttagagaagagaaataaatattcacttcagagaatacactttgaagtggggctgtgtgtgcatgggtgacagctccctgcctacttttcctgcaaggttcttgtacatcaggaaaggttaatggacttcccttgaagtcagacagagatgtgttcatggaaaatccaagtgcaaaaccaagggcaaactctggctttcctgggggtttttttgttgttgtttctccttttagaatggacagtgaaagcaaggtgaagggcttcattattcctcttttgtaaagcctgttgagcaggaaccttctggagcttctagatggaggttcctggagattgtgtgagtggtgagcagtctggttgaagagggccagtgtttgttggctttgccctcattgtgtcaggaatgagctctgcacggactcagagagctaacagatcagctagg

SEQ ID NO: 224907 - DNA, 655 bp, Homo sapiens
ggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctac

SEQ ID NO: 224908 - DNA, 583 bp, Homo sapiens
cttgcatggtggcaggcaagagagcgtgtacaggggaactgctctttataaagccattagatcttgtgagacgtattcactatcatgagaacagcatgggaaaaacccacccctatgattcagttacctcccatcggtcccctcccatgacacatggggattacgggagctacaattcaagatgagatttggatggagacacagcccaaccatatcaaatggggttcagattgggcagtcaaaacatgactaagctcccttacacttgggacccttttaacatgcaataaatcgtgagactatcctaaagagcagttgttccatcgaacatactttgggaaatactgtcctgggtatttttcacagaaactggtgtgaagatattatgtcctgaagaatctaaccaattctgggctacttttgcctctcactccaagagctaatcattttctgtctctccaggttcctcagtttttgcattggtttgcttttcttttttgagatggaatttcactcttgttgcccaggctggattggagttcaatggcatgatctcagctcactacaacctctgcctcctggg

SEQ ID NO: 224909 - DNA, 300 bp, Homo sapiens
aaaacctagaagagcacatggagaaaatagtactcatcaggaatcccaccaggcaaagatgaccactgttaacatttcatgtaagtgcttctagcatttttgatgtatatttgttttagctttccaaattgccgttgtacggtaatactcttttgaatcttggtagcatttggttttgcactttttgcaatatgttgcaaatggtttcttctttttttcttcttttgcttggtttgtttgtgttttaattattctattttgtattattgtttaaaacaccaataaacattttgtatacat

SEQ ID NO: 224910 - DNA, 608 bp, Homo sapiens
ccgctggtatttctgtgttgcatatgggctggggtccctcctgtccttctctcctacacgatcccagatctgatttctaatggtgttgtatttcctccctaaatcatttttcaatagtatttttgttcttctgtgggatacagaagaacttttttttcctattgcaataaggacaagtaaacaagtcagaagcctcagaagacctcaagagagaaatcacagccttcaattcctggtccctttctgaaacctcagctcttgattcacttaatttcaaggagaattgttttatgactacgccaagctgacccaaagacccctgggaagcacgtggcccatcagagggaagggctaggccctggggctggaaaggatgcagagcctgttttcaacaattacgtctacattttccaagagattaaaccgattggaagccaagcattggagaagagatcttttgtcttccttggcaacatttctgaaatctacagatagggatgaggaagtgaggcacatttttcatctgttccaacaaactgccaatggaatggctgacatgccattttagtgtatgtcatctctcccgtgttccgtcatcactgagggtc

SEQ ID NO: 224911 - DNA, 416 bp, Homo sapiens
cacccccacagccatgtgtcctgcttgaccctgggaacctgacttctttaagctgcctctcaggctttcttactgactgggcagaggttggaattagccagtgggagactctagctggaaggcaaaagtataggaagagagagagtggtcagtgtatccccccaccccgtccccactgcccctccccaaggctgtgtctctccaagacatcagctcctgctggaaaccccttctccacatctctagctcttactggctgtggcaacactattcctctctgtctagccccatgagtaacagcatcctagagttgtttgttttcgtgcttctcaacatccctgttcatcctcttcacctggccacacttctgtaaggactactgccattaaagtctcatcatttgaagcattcaatgc

SEQ ID NO: 224912 - DNA, 470 bp, Homo sapiens
cttgttttgctgcagctagacagtcccatctgggggtgatgggagacagtggcagatcttcaggcattcgattctcataaggcgcacacaatgtaggtccctcacatgtgcagttcacaatagggtttgtgcttctatgagaatctaatgctgccactgatctgacaaaaggtggagctcaggcggtaatgggagtggttgtaaatacagatgaagttttgctcacgtctgccgctcacgtcctgctgtgtgacctggttcccaaccagccatggaccactactgttcaatggcccagggtttggggaaccctgcttgaaatcatctctagattactcatgatacctaatacaatatgaatattatataaaatgtccaacaatgatagactggattaagaaaatgtggcacatatacaccatggaatactatgcagccataaaaaatgatgagttcatgtcctttgtagg

SEQ ID NO: 224913 - DNA, 634 bp, Homo sapiens
tccaaaggccaccaacaggtccttctcgcctagaacagtcaagagtctacaagggtgaaggcaagtggcttcagtctcgtggatggatgcctcttctcaacccctcttcacctcctctgcagcagtctgatcggactccgtagggggccactctcccacctgctggggcccaggatctgggggaggacaccagcagcagccctcagaaaagggatcatcttggcccgggtctggacgctggagaaggcagtgctgcctgaaaaagacagaaaggggaagcgcatcactcggggctcagggacaactttcacgtgtcacttcttcctgtttctgggaagagaaaatgggggaagagatggggcttgctcaattgaggtcctgcccagaacctcaggcaggacgcacccagcacccgctccctgtctgagggaggcggcctcgggcctgagggctgctgggggccctggattcaagggggtgatcaaggtgagatttctaagaaagttgccctcttccccacccccacgggctggtgagagtttcaccaaaattcccccacacgccctggctggaggccgccgggccctccctagggagctgagctttcaaaataaagtttgctgagagcctcact

SEQ ID NO: 224914 - DNA, 742 bp, Homo sapiens
tccaaaggccaccaacaggtccttctcgcctagaacagtcaagagtctacaagggtgaaggcaagtggcttcagtctcgtggatggatgcctcttctcaacccctcttcacctcctctgcagcagtctgatcggactccgtagggggccactctcccacctgctggggcccaggatctgggggaggacaccagcagcagccctcagaaaagggatcatcttggcccggtgggttcttcaccctcacccaccctggacccaggcatgagttgagcaggtaggggtgtggtgggggcagagctgagtgagcagtttctcctggtatttttcctccagggtctggacgctggagaaggcagtgctgcctgaaaaagacagaaaggggaagcgcatcactcggggctcagggacaactttcacgtgtcacttcttcctgtttctgggaagagaaaatgggggaagagatggggcttgctcaattgaggtcctgcccagaacctcaggcaggacgcacccagcacccgctccctgtctgagggaggcggcctcgggcctgagggctgctgggggccctggattcaagggggtgatcaaggtgagatttctaagaaagttgccctcttccccacccccacgggctggtgagagtttcaccaaaattcccccacacgccctggctggaggccgccgggccctccctagggagctgagctttcaaaataaagtttgctgagagcctcact

SEQ ID NO: 224915 - DNA, 500 bp, Homo sapiens
tcatttcctcttggctagggctccctcctgcgtctgtggccagctgggggctaactgactgtgagctggagcagctagttttcctccacatggacttcatctttcagcgtggcagccagtccttttcacacggttttcagtcagagggagtagaattgtgcaaagctatgtttggaaatgttacaacacttcctctgtattctatgcccaaagaaagtaaaaagtcaggccagattaaagggtttagaaatagacttcacttatttatgagaggtgctggaaagtcacattgcaaagcagcctgggcacagagagaggaatgatcttacacatttttgcaaacaatttgctgcattatccaaatctcttacctgtttgtccctcacgcttgactatcagtcacctcttgcaaacttgcttctggccacactggccttatttctattcttccaaaaggcaatcccatttctagctggattgtctttgaccaagttttaccc

SEQ ID NO: 224916 - DNA, 401 bp, Homo sapiens
ctgtatttctaaagtatttttctgcattcaaggtttgaatattccatttctcaacctttttctggcctagtcctatctttcacaaagcttaacttttccctattcagtggctggaaaagggacttaagaggttataaagggttggataggcatatgatgtgtaagaatctgtccctggttctctgcacagccctgtccaatcactgattaattatataagcctgtctccctggatactgtatataaaaaggatataatctggggaagaactgttgtcaagccttggagccccacagtgtagtgggaccactagtactccagaaccataatataactagacatgcctggaatgcttctgatgaaaactaagcaacttccagtttgctgattcaggagctgtt

SEQ ID NO: 224917 - DNA, 280 bp, Homo sapiens
tcgttgatgtttgaatatgagaccatttcatcagtatttaagtgtgcccgctgggatctaactaggagaggagagggtattcactgccgaacatttcaaagaatatacgaacaagctcttttatggtcagaaatgttagcccttttccccttaaacttgtatttcctttcttcttccctcctaaaattttatctaaatgatatttatatttgatgcttttaagccttttattaatcactcctatacttgcctgcaacataaatatataagttgaagcaaa

SEQ ID NO: 224918 - DNA, 395 bp, Homo sapiens
gagccacggatttaagaaaatcttttcaattcacatctttgatgaagacttgcatatgcaacctataaagaagtctcaaaatctaataagaaaactagcaacttaataaaaaataagcaatgtatttaaatggtttaccaaatatacttcatcaaaaagagaaattggacggaaaataagcacatggaaataagcttaacatcagccatgaggaaaatgcaaattaaagccacagtgagatacttctttaacctattagaacgtctcagatagacagaccattaggcaaatgaagggcaatttacaaaatactggaccagtacccctccaaatgcctgataataaataccaagtgttaggtcgacgcggccgcgaatttagtagtagtagtaggc

SEQ ID NO: 224919 - DNA, 384 bp, Homo sapiens
agctcactggttccacctgcagccgtggaggggatcctggcctcaggcaagtctgcctccgtctgaagccccgcttcctcatcggtctctagggggagtcgtggtatcatcacaggactttgggtagttttaaagagataataggtaaaaaatactttgtacaaccattcattatcaatgagaatatttgtatgagcctagcatgagaactgactcacatctatccacttgggctcaattactcgatgggtttatcagcagccaaagaacaaatggagtctgggcctcacccaaggattatggactcatatttatacaacctgaggcaaatactgttaggaatacaaatgcattgcttaaaaatatcatggtatatatctcaaa

SEQ ID NO: 224920 - DNA, 206 bp, Homo sapiens
ttattcccatagactactttttaatagtgctttacacctaatgtaacagaatttatactttaacttttaagttacatgatagtaaaagtcaatttggaacaatggaaaatgccatgttttattagaatcatagtgttaaaattagtcctctgacagtttaagtgatgaaagaaaggaatttacattaataaagtaatcttttaatg

SEQ ID NO: 224921 - DNA, 497 bp, Homo sapiens
ccctgctgaagcagaactgtgtctgcaccttcataacccgtgggctggagcccaaccagccactgtctcctgcacttccgacttcagctctctttgtcaggatatttaaaactcaatatcaaacataaaatttacaaaaggctgtatcctctgaagacagagcatggagtcacaggttaggaaacctcacttctagtcctggattcccgacaacccattcatattatcttcagcttattgctttataaaccccagaactaaatatcctggttgagctttgaaagagccctgtcggctccatgacttcaaggtttcatccttgttttattcatttaaaaaatgttttagaaattatttgtctttatttttttatatctcctaaagtaaaatctgagaatgacccaagaatatttgtttcagagggttgtctttttgttggcaagcagtgaagcacatgtaagtttctcaagctttagaatatatatatattaaaaaac

SEQ ID NO: 224922 - DNA, 556 bp, Homo sapiens
acaggaaccaagaacagccaaaaacccttttgaagactaataataaggaaatcctgccatatcaaaatacattttaatgttctaataaagtagtatggtattgttataagagacatatcaatacaatagagaacttaggacacacataggtttggtctgtgatagaggtgacattatagatcaatggaggaaaaaaatgttcaataagtgaatcctcatattgaaaaagataaaattagatctaatgatatggtttggttgtgtccccacccaaaatctcatcctgaattgtaatccccataatccccacacgtcaagggtgggatgaggtggaggtaactggatgatggggatggtttgccctatgttgttctcatgatagtgagtgagttctcacgagatgtaatggttttataagcatctggcatttcccctgctcgcttctccccccctgctgctctgtgactaggtgccttctaccatgattctacgtttcctaaggcctccccagccatgctgaactgtgagtcaattaaacctctttcctttataaatc

SEQ ID NO: 224923 - DNA, 1322 bp, Homo sapiens
ggtctacatagtctgaaaattctaaaagaatgctgtttaaattttgtttttatttcaatgatttctatgtgcatatacacgtattttaagtcatgagtaaccaccatataactgagttctactacaacctttcagtgctgtttgctttttacaattatacaattgcattctaaaatcattacataatagatttaacttttattttaatatattgtttatcatattgaaacatgcaaaaactctgcaagatcacttattcttggaattctggagtatctcagatatatctcctttttttgtgatggggaggtgtcggcacattactcaagtttgaaaatacaaatatgtattatttaagaaacataacacattacacagagatgtgactgggatgaggtgagtgaggcacatgcctcaggtacaaaattaagggggcaccaaaaacctcagtaatgaagataatattttaacacagtatttttaaaaatcaaatttatgcaaggtccatgaagagcaaaatatcaaatttttaaataaataccaaatcagtattactgattttttccttctgcctccggctccaatggcaccaagattttataaccacaacacaatgttggtccatttaatgtttccgcatattcagtacaatcagtaatgccacgatgaatatctctgtgaatattcatactcccatatttaggattatctcctaagaaaagaattcctgaagtggaactactaggtaaaaaggtacatagtaaaggttcttgatacataatgacaggttgttttcctccccaaaaaatgttcttaattatatttactccagtaatttatgaaaaaaacaccatttaaaagtattttcccactttgtttcaatttgcagctatttttaatgttcatttacaaaaagtacattataatggaacactattaactctcagtagcatttgttatcaacatttcctcaatatgtacgttaagttaaaattttatatatttgtttccatttttgtgccaaaaaaatctgacagtttttacctttgtgatttcttctatctcttacaaagttttatttccacattaaaagaataagaaaatagtttcatttttataataatacattcatttactccagggatcagcaaactttatctgtaagggaccagatagcaaatatttttgactttgcaggccatatggtctctgtcccaactactcaactctgctctggtggagcaaaagcacccacataatatgtaaatgaatgaatgtggcaatgttcaaataaaactttatttatgaaagcagtgggtgga

SEQ ID NO: 224924 - DNA, 488 bp, Homo sapiens
tatttcattattgttcctaacagctctgggagagaggaattacaattttccccattttatagatgagtagactgaggcttggagacagaactgctgagaagaagtaatgcagtacttacaaatatctgtgtgggtgtgggtgtgtgcttagcagcaggtcatggcagcagatggcgtgtgttacgctgctttagaatcagtcatttggtggctgggcacagtggcctgtaatctcagcactttgggaggctgaggtgggaggatcctttcaggccaggaatttaaaaccagcctggacaacatagccagacctgtctctacaaaataaacataaaaattagccagatgtaatggcatgcacccatagtcccaagtactcaggagactgagacaggacgatctatcaagcccaggagttcaaggttgtagtgagctattgtgccactgcactccagcctaggcgacagagtaagaccttgtctcaaaac

SEQ ID NO: 224925 - DNA, 729 bp, Homo sapiens
  misc_feature (655)..(655): n is a, c, g, or t
cgtgcgaggggggcgacgtaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggtggaagctacaatgattttgggaattacaacaatcagtcttcaaatttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagattttttttngcaccccatgctgttgatgctaaatgtaacagtctgatcgtgacgctgaataatgtctttttaatgtgctgcgt

SEQ ID NO: 224926 - DNA, 4786 bp, Homo sapiens
cgtgcgaggggggcgacgtaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggtatgaaagttaattatatgggatctgttgtcaggatacaatacacactgatatatacatgttgaagtaatggtatgcagtaagattttttttaatcctattatgtttagttaagagcatgttactaaaatgctgaggattttgtaggcttgcatagtagttgttttttaactagctgattttgtaaccataaaaacaagctatctgctttatcaataagtgtagttgtaatgtcaaatcaataagatattcacactcctcaataacattatattgattgtgttcccctcaagcatcatattttacatttttttatcatcttttaaacaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttcttttttgtttgtttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttcaaaaaaaaaaa

SEQ ID NO: 224927 - DNA, 2295 bp, Homo sapiens
  misc_feature (13)..(13): n is a, c, g, or t
  misc_feature (17)..(17): n is a, c, g, or t
cggtaccccgggnccgnacggatgtggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttcttttttgtttgtttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttcaaaaaaaaaaa

SEQ ID NO: 224928 - DNA, 1321 bp, Homo sapiens
ggctgttggttgttggttttgcgactcttcctctggcttcgtttatgctgcgtctctgatttctcttcctctttcgtttgttttctgttgtggttatgtgtttggttcttctcttctttctgtgtgttctggttttttttgtctttcttctcgtatgtgcttctgcgttgtgtttttgctctctgctctctccatgagtttttttgtgtcttgtcctccgctcgctccgctcctgcaccttgtttgggagggggggggagtcggtgtttcttcgttgctgttggttgtgggtgcctgtctcttgttctttggctttgttttttttctcctttttctcttgtgtcttgtctgtgtttttatacaggctgcgcctccctctcttttgttgtttttctgcgtttatatactggttctgcgcttcctctgcttcgtcctcttagttgatgtggtgtgtcgccctcttcccgtatcgatcactaatacgtgtgttgtcggcctcctgctctgtcgtccgccctggcgggaggaataataggttgttgcgccgcccccctctcttttttttttttttttttttttttttttttttttttttttttttttttttttttttttttttttttttttttttttctttcttttttcttttttgtttgtttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttcaaaaaaaaaaa

SEQ ID NO: 224929 - DNA, 317 bp, Homo sapiens
agacattaataacattctgttaattttgtcagtgtttaacatgggaaaaaataccccagaagaattttattccggttattctaaggagagaaaacaagaaaagtagcattaattacaaaacttttcaataaccaatttgttttccttgacagaaattgatatgcctctaatctgatatacagccttagaaagtcacatactaataatattattttgtcgttttgctgtagatgtgttctttgtgccattgtcctggagcaacaattggttgtgatgtgaaaacatgtcacaggacataccactaccactgtgcattg

SEQ ID NO: 224930 - DNA, 396 bp, Homo sapiens
tatactaaataaacatttaaaaatgtgtatattaaaacctaggtcaaatttttaacaactttcatgaatatgtataaactgattttaaaataaaattaacattgtcgcccttcttattctctgtagcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatggtaagtataccggcagcaacagagaccttgaaacgattcatgagactcttaataacacatgaatgttcctgaatactaaaaaaaaa

SEQ ID NO: 224931 - DNA, 444 bp, Homo sapiens
tgttacccttcttattctctgtagcatttcttggggcttagagtggcttaatttgtctatactaaataaacatttaaaaatgtgtatattaaaacctaggtcaaatttttaacaactttcatgaatatgtataaactgattttaaaataaaattaacattgtcgcccttcttattctctgtagcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatggtaagtataccggcagcaacagagaccttgaaacgattcatgagactcttaataacacatgaatgttcctgaatact

SEQ ID NO: 224932 - DNA, 4456 bp, Homo sapiens
cgtgcgaggggggcgacgtaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttcttttttgtttgtttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttcaaaaaaaaaaa

SEQ ID NO: 224933 - DNA, 1224 bp, Homo sapiens
cgtgcgaggggggcgacgtaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatggtctgtagtttttatatttgttatgcaacattacacttgatttgctgctttaaatttagagtacatcccaaatttatccagtcatcagaaaatttaaagtagttcgtatgttaaagcaaagtatatatttgacttatttgtaatataataaaggatgctgatgttacgg

SEQ ID NO: 224934 - DNA, 480 bp, Homo sapiens
agctccaaaattcatcagatatttcttaacaatttcaaaatctttccctttgaaattaattgtgtccagttttgatagaggtctgcatgctttctgctctttattatataatagaagcattatttgttgactagtaggtaattttagattgtttcaatgtgtacctgataaagatgtcaatgatgtttttaccttaacatggaaacctagtttaactagtctattattcaattttcttcttttgtgtaatttgttaaaatagtaagctgtgagctgcatttggaaccaatgtgataaaaccttgaagaagtttcttttgctcagatatgtgaaagagggtctgggaattttctttttttcttttctttttttttttttttgtgagctggagtcttgctctctcacccaggctggagtacatgagccgagatcacgccactgcactccaacctggtgacagagtgagactccgtctcaaaa

SEQ ID NO: 224935 - DNA, 826 bp, Homo sapiens
tccagaaaaatagctcattcttattcagtgtttgttttctgaggatgtcaagtggagtcagaaccaataaaagttctatcaagaagagtctcagttaaccagattagcttgcccaggttggtggaaccatgaaaaccagattaaaaataatgggagtaatcttccattgcttccatccctaggattcacttcctgtcctgttttatacactttgtaaatggtacctctataacccattatgctttttggcatcattgctcactttgactatttgcagattacaaattatttgaggtcaaagaagtgagtggagtacataaccttcaaggtgaagcaggaagcagatgcctccttccgagtataagttctcttaggtcagatactgggaacaaatttgtttacagcaccaagcacagctctttgagggttggaatacccactaaacatctaagcaaatgtggacatttacccttcagggatacatgctgacaaattccttcctatatgccaacctgaaagaccaaccttggagatatatgaagcattgcctagtccagagtgaggcagaagactgagtcaggggtttcgacttagtcaaggaatgctcaattttcaccttttccctcttcctgcataccttcctcatgagtcatgagcccagacaaggccccagggtttttcccaatatagttcttcaggaagtcactataagtcaagtggagttggtatttatatggcatttgttccttttaaaatgtatttttaattgataaataataattgtatatatttataatgtataatgaataaactgaaaaattcaata

SEQ ID NO: 224936 - DNA, 391 bp, Homo sapiens
catatatacatagacttatagaatcagtaagacaactctataagatagatattattttctctattttatggattcaaaaactgagccattagagattatgtattttgctgggcctggcggctcacacctgtaatcccagcactttgggaggccaaggcaggtggatcatctgaggtcaggagttcaagaccagcctggccaacatggtgaaaccccgtctctactaaaaatacaaaaattagccaggcatggtggcaggcacctgtaatcccaactactcgggaggctgaggcaggagaatcatttgaacccgggaggcagaggttgcagtgagccaagatcgtgccactgcactccagcctgggtgacacagtgagactctgactaaaaa

SEQ ID NO: 224937 - DNA, 640 bp, Homo sapiens
cataaagaggaattgttattaccccaatttcattttctgacttttattcctataatgagaggtttctataatttatacataagaatatttacttgaggtctcctttggtagaataaatcctaatttgtaggccataactgcctttttctggttcagtcactttctctaagcatgctgtttcccagttataaagtagtatttcaaattctattttatatttcccctgtgctacagagggcccattcaaaatttagagctaataaaaatgacaagaacaatatccaatttttttttaaatgaaaaggggggaggaactaattaaggccacgaagagtcaccacaaaagaataaaagagacacaatgaccacttcacaacactaggatggctataatttttttttaactgaaaataacaagtgttggcaaagatgtggaaaaactggcaccctgacacattgctggtgggaatgcaaagtggtttgcctgctgtaagaacagcatggcagctccttaaaagattaaacataccatgtgatgatctatggtatgtttaatcatgtgacccagccattccgctcttaggtaaatactcaagagaactgaaaacatatgttcacacaaaaacttgtacaagaaagt

SEQ ID NO: 224938 - DNA, 391 bp, Homo sapiens
cccaggttcaagcgattctcctgcctcagcctcccaagtagctgggactataggcatacaccaccaaacccagctaatttttgtattgtttgtagagacagggttttgccatgttgcccagtctggtctcaaactcctgggctcaagtgatctgcccacctcagcctgccaaagtactgggattacaggcatgagccaccttgctcaacctgtttccttctttataccaagtgctaacattttgaatgaatattaggaattgatgctggttagtgctaaaatatctttaaactatcagtgtaaacataattaggccgtgagtttttgctcttactcccaggtttctaaatgtctaagaaacaataaaatgagagtcatgtacagaaatata

SEQ ID NO: 224939 - DNA, 638 bp, Homo sapiens
ataagcttgattgtagcgtttaggtgcaaacgtgtcacatggcaagagcaggagcaagagcaaacctgagttgtaagccacctatttgacagttactcctttcctgagtttcttccatgtatatatgaaatatacatgttaataaacttctgtttttctcttatcttttgttacagggttctcagccaagaacttaaaagggtataggaaaaattatttttcttcccctaacatgctcaaattggtaccacccctatgaagggcaaactggcaacatctaccaaattgcaaatgtgtttccccttcggctctgcaatcccacatctgggaatctatccatatgaaatgctgtatgaaaaagattaattgcagcaccgtttgtatcagcacccaaatgcccatctacaaaacctggtttaaaaaattatggtatactctacactgggaagttaaggtaaaaaaattatttttaaaaatggtatatccatataatgaaatactataaagcattaaaaaaatcacaaagaacattgtgtgtcttaactgtggtggtgccttcaggcatataattgccaaaactcatcaaattatatacttaaattggatgcagtttgttgtggatagccttgaataatgct

SEQ ID NO: 224940 - DNA, 439 bp, Homo sapiens
gtataggaaaaattatttttcttcccctaacatgctcaaattggtaccacccctatgaagggcaaactggcaacatctaccaaattgcaaatgtgtttccccttcggctctgcaatcccacatctgggaatctatccatatgaaatgctgtatgaaaaagattaattgcagcaccgtttgtatcagcacccaaatgcccatctacaaaacctggtttaaaaaattatggtatactctacactgggaagttaaggtaaaaaaattatttttaaaaatggtatatccatataatgaaatactataaagcattaaaaaaatcacaaagaacattgtgtgtcttaactgtggtggtgccttcaggcatataattgccaaaactcatcaaattatatacttaaattggatgcagtttgttgtggatagccttgaataatgctaa

SEQ ID NO: 224941 - DNA, 363 bp, Homo sapiens
gtccgtttttgtattgctataaataaatacctaaggctgggtaatttataaagaaaacaggcttaactggctcacagttctgcagggtgtaccaagatggctccagcatctgcctctcatgaggcctcagggagcatccaatcatggcagaaggcaaagggggtgcagacgtgtcacatggcaagagcaggagcaagagcaaacctgagttgtaagccacctatttgacagttactcctttcctgagtttcttccatgtatatatgaaatatacatgttaataaacttctgtttttctcttatcttttgttacagggttctcagccaagaacttaaaagggtataggaaaaattatttttctt

SEQ ID NO: 224942 - DNA, 2396 bp, Homo sapiens
agcattcttccatctgtagatgtttcagctgctgtacaagggagtcccatttcaggtgtggggctgggcatggtcactcctgctggatgtctggaaggtgaaaaccaaggacctagggaaataccaggtacagcctttccaccctcatccagagcaggacaaacaggccaggtggtatcaggagcccaggtctccagctggagggaatgtcaaccctgcagtgggagcccatcacgcatcctaggcacagatgctaatgtaggcaccgcgggtaagctgagcttggtacccctccctggcttcaaaaataagccaaacaaggagctttctgcagaatgaaacctgtttttcatccagaagcactgctgactgtttggtggttgctgttggggcagtgagccttttgtccattctgagattgggctggtttctcctcttggccctgccctacagaccataaaggaaaacagcaagaggtccgcagcaaacatctacagatggccctggacatcagccacattctgagaaacatgtcatgttctgggagggctaaggcatcaagtaaggcctctggggctggaggatcccagggcaggtggggcaatccagagctgtgggggcttccatgggaattgggaggtctcaaggcagagggaggggttccacaggaggagtcacagagccaccaaggggtctcctggcccagggagcagccaacaccatggactgaacacccgctgggctccaagccctgggccaggctggggcatatggggccaggaggcagctcagagtgggagacagagagacaagtgtgctcagagggcacccgtatctggatgtagtgtggtcctgagtttctggctgggaagcgcttccagggtttcatatgtattatggagctgcttcctctctccaggctcaccctgcaggaatcccagtgaatatattgccaccatcttggagctcagtgccctcttagtgtaatggcaccagcagatctgcctgtgcacggacttcctgtactacctcactcctgaggggagatgcttctgcagggcctatgacctggtgcacaactttagacaccatcatcctggagcagcacctcaccctcacttgccggggtgttgatgacttcctcaaggctaaggccacattcaagattttggacttcagtgatgcatttttgctgagcaaggtgggcttctccgggattttagttcaggaggtagaatgcagcttgagatcaagtgtctgatcaaataacttgaacttgatctggagagctctggggagccatagaagttgttggataaaggagggacagtcgtatatgttttagagatgactgtggaaggctgcctggaaggagtgaacaagagccaggagaccagggagggagcttgtggggcaggtctggagatgacaagggagggatcctgctttgatgaaaggtcttcagggaatgtctcaggttacactcaggtgtcctcagagctagtgtgttcaggggtcttgcctccaggatgaaaatgagaaggagttgtcagacaagaacatataaatgaaggctggcatcttcgtgagtgccaatcgttgtcctggtgtggactactgtgggaataggggtctctccatccagggacatggtggatggaccctacatcactccattctgcccttcctttccctcccattctgagggcctcagtgcaagggcgctgtccaacctctggtgctgaagcagccgagagacccaagcctgccactcaggatatgacagcacagccagtggcctctactggatcctgtacaacctcagaagacacctagacactgggagtgctgccaccacgtggtgcaagagttctgagggaccgcaattctgaagacattgaatgctgcttcctgctccctccatggacctgcacagaattgtcccatgtttctgtttgtttgggcaccactgaggaaggaagcatgaaggacgcagaggtcaggccattctattgccctcctgctgctgggtctttaatcctgagatggcttcaggggctggtccttctccatggccccctccacatatctcagccattttgcaaaccctggtcagaatgaaacattccttgggaactcgggccatgagaagcatccttcctgaccacctgactgcggaaacatccttatcgcatcctcccgggcgaaggcccaacagcctgactgcaggaacatccttgccatatcctgccgggcagcaagctctaccgcccagacccctccttcccagtcccatgatcgccccagcctgtgagcggcagttggtgatggcactaagctgatttcctcctctgcagggttttgctagtaataaaggtgttgctgttgaagccacc

SEQ ID NO: 224943 - DNA, 2346 bp, Homo sapiens
agcattcttccatctgtagatgtttcagctgctgtacaagggagtcccatttcaggtgtggggctgggcatggtcactcctgctggatgtctggaaggtgaaaaccaaggacctagggaaataccaggtacagcctttccaccctcatccagagcaggacaaacaggccaggtggtatcaggagcccaggtctccagctggagggaatgtcaaccctgcagtgggagcccatcacgcatcctaggcacagatgctaatgtaggcaccgcgggtaagctgagcttggtacccctccctggcttcaaaaataagccaaacaaggagctttctgcagaatgaaacctgtttttcatccagaagcactgctgactgtttggtggttgctgttggggcagtgagccttttgtccattctgagattgggctggtttctcctcttggccctgccctacagaccataaaggaaaacagcaagaggtccgcagcaaacatctacagatggccctggacatcagccacattctgagaaacatgtcatgttctgggagggctaaggcatcaagtaaggcctctggggctggaggatcccagggcaggtggggcaatccagagctgtgggggcttccatgggaattgggaggtctcaaggcagagggaggggttccacaggaggagtcacagagccaccaaggggtctcctggcccagggagcagccaacaccatggactgaacacccgctgggctccaagccctgggccaggctggggcatatggggccaggaggcagctcagagtgggagacagagagacaagtgtgctcagagggcacccgtatctggatgtagtgtggtcctgagtttctggctgggaagcgcttccagggtttcatatgtattatggagctgcttcctctctccaggctcaccctgcaggaatcccagtgaatatattgccaccatcttggagctcagtgccctcttagtgtaatggcaccagcagatctgcctgtgcacggacttcctgtactacctcactcctgaggggagatgcttctgcagggcctatgacctggtgcacaactttagacaccatcatcctggagcagcacctcaccctcacttgccggggtgttgatgacttcctcaaggctaaggccacattcaagattttggacttcagtgatgcatttttgctgagcaaggtgggcttctccgggattttagttcaggaggtagaatgcagcttgagatcaagtgtctgatcaaataacttgaacttgatctggagagctctggggagccatagaagttgttggataaaggagggacagtcgtatatgttttagagatgactgtggaaggctgcctggaaggagtgaacaagagccaggagaccagggagggagcttgtggggcaggtctggagatgacaagggagggatcctgctttgatgaaaggtcttcagggaatgtctcaggttacactcaggtgtcctcagagctagtgtgttcaggggtcttgcctccaggatgaaaatgagaaggagttgtcagacaagaacatataaatgaaggctggcatcttcgtgagtgccaatcgttgtcctggtgtggactactgtgggaataggggtctctccatccagggacatggtggatggaccctacatcactccattctgcccttcctttccctcccattctgagggcctcagtgcaagggcgctgtccaacctctggtgctgaagcagccgagagacccaagcctgccactcaggatatgacagcacagccagtggcctctactggatcctgtacaacctcagaagacacctagacactgggagtgctgccaccacgtggtgcaagagttctgagggaccgcaattctgaagacattgaatgctgcttcctgctccctccatggacctgcacagaattgtcccatgtttctgtttgtttgggcaccactgaggaaggaagcatgaaccattctattgccctcctgctgctgggtctttaatcctgagatggcttcaggggctggtccttctccatggccccctccacatatctcagccattttgcaaaccctggtcagaatgaaacattccttgggaactcgggccatgagaagcatccttcctgaccacctgactgcggaaacatcgggcgaaggcccaacagcctgactgcaggaacatccttgccatatcctgccgggcagcaagctctaccgcccagacccctccttcccacctgtgagcggcagttggtgatggcactaagctgatttcctcctctgcagggttttgctagtaataaaggtgttgctgttgaagccacc

SEQ ID NO: 224944 - DNA, 2158 bp, Homo sapiens
agcattcttccatctgtagatgtttcagctgctgtacaagggagtcccatttcaggtgtggggctgggcatggtcactcctgctggatgtctggaaggtgaaaaccaaggacctagggaaataccaggtacagcctttccaccctcatccagagcaggacaaacaggccaggtggtatcaggagcccaggtctccagctggagggaatgtcaaccctgcagtgggagcccatcacgcatcctaggcacagatgctaatgtaggcaccgcgggtaagctgagcttggtacccctccctggcttcaaaaataagccaaacaaggagctttctgcagaatgaaacctgtttttcatccagaagcactgctgactgtttggtggttgctgttggggcagtgagccttttgtccattctgagattgggctggtttctcctcttggccctgccctacagaccataaaggaaaacagcaagaggtccgcagcaaacatctacagatggccctggacatcagccacattctgagaaacatgtcatgttctgggagggctaaggcatcaagtaaggcctctggggctggaggatcccagggcaggtggggcaatccagagctgtgggggcttccatgggaattgggaggtctcaaggcagagggaggggttccacaggaggagtcacagagccaccaaggggtctcctggcccagggagcagccaacaccatggactgaacacccgctgggctccaagccctgggccaggctggggcatatggggccaggaggcagctcagagtgggagacagagagacaagtgtgctcagagggcacccgtatctggatgtagtgtggtcctgagtttctggctgggaagcgcttccagggtttcatatgtattatggagctgcttcctctctccaggctcaccctgcaggaatcccagtgaatatattgccaccatcttggagctcagtgccctcttagtgtaatggcaccagcagatctgcctgtgcacggacttcctgtactacctcactcctgaggggagatgcttctgcagggcctatgacctggtgcacaactttagacaccatcatcctggagcagcacctcaccctcacttgccggggtgttgatgacttcctcaaggctaaggccacattcaagattttggacttcagtgatgcatttttgctgagcaaggtgggcttctccgggattttagttcaggaggtagaatgcagcttgagatcaagtgtctgatcaaataacttgaacttgatctggagagctctggggagccatagaagttgttggataaaggagggacagtcgtatatgttttagagatgactgtggaaggctgcctggaaggagtgaacaagagccaggagaccagggagggagcttgtggggcaggtctggagatgacaagggagggatcctgctttgatgaaaggtcttcagggaatgtctcaggttacactcaggtgtcctcagagctagtgtgttcaggggtcttgcctccaggatgaaaatgagaaggagttgtcagacaagaacatataaatgaaggctggcatcttcgtgagtgccaatcgttgtcctggtgtggactactgtgggaataggggtctctccatccagggacatggtggatggaccctacatcactccattctgcccttcctttccctcccattctgagggcctcagtgcaagggcgctgtccaacctctggtgctgaagcagccgagagacccaagcctgccactcaggatatgacagcacagccagtggcctctactggatcctgtacaacctcagaagacacctagacactgggagtgctgccaccacgtggtgcaagagttctgagggaccgcaattctgaagacattgaatggtgggtgccaggcctcgtggctgttccccagcccctctcataggctctgctccagctggtgaagggggatgacgtctctgtcaattctgccatgattgcctagcaggaaaaggagcagagcccagaagcagggcctggtacccagcctgcctaacaagggagaatttgtaggctttgtggacagaaagatctgggagtccatatcacccactaacttgctgagacattagtaaaatcagttttcttttctgagc

SEQ ID NO: 224945 - DNA, 631 bp, Homo sapiens
gcttacacctcagtagtaccttcttcagtgttttgagcttgagagttcaggtggcaatttcttcagcccagtattttctccctatggaaaaggatttctttgcccctagaaactttccttgccttctggaaggattcttttttccatttatatatttcctcataaagagaaaagctgtactatgcaacactaaggttagtcaaataggaaggaaaagaacatcagctttcacagttagcattagggagtatttcctagtagaaatattttcagtttcccgcacctccgtacctccactaatctgttctcactctgcctccaacttctttcaggatgtcttggctgtgctgctgtttgggggacagtgttttactctgacgggcagtttgagttcttgcagaaagtaggctcagcctttccaaactaaaccttgggtttcctcccaaagatgaagcaagatggctgctagcacagtcactgcggcacctgcaggctgcctgagagcaggctctgtatctaatgccgtgttttacctggtgggagatgcctgttaattgtgagacacactgttcagtttgtactactgacaaaacaaaaaacaataaaaaaaccatacttcttgcagaaatgt

SEQ ID NO: 224946 - DNA, 429 bp, Homo sapiens
gtaccagcaggtcggtttctgaggaggcctctcttccttgatttacaaatggccacctacgcatcatgtcctcacatggtctttctcagagagaaagagaggtgtctcttcctcttcttcttttgttttgttgagacagagtttcgctcttgttgcccaggctggagtgcaatggcacgatcttggctcactgcaacctccacctcctgggttcaagcgattctcgtgcctcagcctcccgagtagctgagattacaggcatgcctggctaattttgtatttttagtagagacagggtttctccatgttggtcaggctggtctcgaactctcgacctcaggtgatccacctgccttgccctcccaaagttctgggattacaggcgtgagccccgcacccggcctcctccttttcttataaggacacctg

SEQ ID NO: 224947 - DNA, 286 bp, Homo sapiens
tgcttcattattctctactctctctacatatataggtagacacacacatgcacgcacacacacacatttttctggactgagagtaagttatagacatgctgttggagtctaaatactttattttttttccctaaaaaataaggacactgccttacataatcatgaattattatctgggtcaggaaattaacataggtataattctaccacatgatctgtagacccattcaaactttgcccactggcccaataatgcccttggtggctatttcccctcctcttattc

SEQ ID NO: 224948 - DNA, 466 bp, Homo sapiens
tttgatgaacaaagttcttaagtctaattcatcaatcttttctctaacggttaatgctttttgtattctgtgtaagacattgtttattccaagatcatgaagatactgtcgtatgttttcctgcagaagctttattgttgtatctttcacactaaatagaaaccctctttaaaatcaccaactcctactgcattcttaaaatattttgctaaacttttcgaagattctggcaccacaacactcgcttcccagcctcaaaccttttggggaggtggggacagagaaagaaagaagctggcagggaaaacccagcctcagccaagacctagcccagatagtaaattagcagggctgggagtctccatcatatcagcagtcacatgtcttaaaaccagaatctaccaagattatatatatatcttgtatctgccactgccattaccttcttttcattttatgtcaaaaa

SEQ ID NO: 224949 - DNA, 399 bp, Homo sapiens
taggaaatagggaacaaaaaagtgggaggacaggtgggtgtgtgggcagagtatagcaataatattgttaacctatgcaaaggttaggctgattctgaatagagcaagagtttataatggaagattccttttaacacttaaaattcatgaaacgaagagctcaaagaaaatcttagaagccatctaatctactctcctttccctatctccacttgaaaaatggggacttaagagcagagctgttgcgacttgcctgaattcataaaccgagttagtggcggagctgaaagtcgagcctggctcttctgtttttaccatttgcagttgctcccacccctgcccccattcatgggttccacatccatggattcaaccaactatggatcaaaagtatttttt

SEQ ID NO: 224950 - DNA, 570 bp, Homo sapiens
tttattttaagttccaggatacacgtgcaggatgtgcaggtttgttacataggtaaacgtgtcccatggtggtttgctgcacctatcaacctgataacatttttaatttaagaaaaaggttaataccagcttagacagtttattttggctcttatattatttagaattaggcttggtttcatgggcagaaaaattaaatagtattcagaacatgtttacgggcttctgtattcgacagtttattttgattgcaaaggtttgaatctcagaaccttcttttccctttacttaaaaaatggtaaaattcataaaacatggctatgaatggttaaaattcatcattttcaccattttaaagtgtataattcagtgactttagtacatttaaaatgttgtgaaactgttaccactatctagttctggaacattttcatcaccccaagaggaaaccttttaagcagtcattctcctcttcccctccctgcattatcccctggcaaccactgatatcttttctgtctctatggatttgcctactctggacattcatataaatgaaatcgtacatat

SEQ ID NO: 224951 - DNA, 619 bp, Homo sapiens
cactccagcctgggcaacagagcgagcctctgtctcaaaaaaagaaaagaaaagaaaatgtattccatattcaaatgcagaatccactgaagatgagtctcctgcggcaccaacccattccacatcagggcatctggtatttacccaagggtaggttttgccatgaaccaggggtcaggcaagggccaaagacaccgagtacttgtagatgtgattggaaagcaaatcatctctatatggggacaggaagagagaggacagcgcttggtggtccacacatgttccttgggccagccgtgggctatccccccacattcagacattgggtcctgacactctttataaaaacactctgtgttgagtcccttccctgtggatggaaggaagtaggtttcctccaggaacgcatggcccagtgtggtgaacttgtatctgcttggctcctgtctctattaaaaatataaaaattagccaggcacggtggtgtgcatctgtgatcccagctgctcggtgggctgaggtgggagaatcacttgaacccaggaggcagaggttgcagtgaaccgagaccgcaccattgcactccagcctgggtgaaagagtgagacttcatctcaaa

SEQ ID NO: 224952 - DNA, 727 bp, Homo sapiens
acaaaacattcagattgttgtgtaaacaaagtaatcagaatgtcataataaatgacaggctgaagctctgtgcttatttgaaaggggatcaagtaatactgaagaagagtgatgtaaacatactcctgagcaaagtctcactgggatagaatttaatcaagaggttttactttcaagaaataagcacaatcacagaggccaggaaacttagctgtttcagggaattgatgggtagcacaaatgtgtgtttggcagaacacacacaaaaatcaggcattaaattaggcataccctaaaaccttcaaattcatatttttatatataactcaggttgctgatttgtcatctaaaaatgaaaatgatcagggccttaccatgcaaaagtaatgataaaataatgattgtgtggtctgaagaaataaaactttgggaatacttttgattgcttttcaataataaatgattactatagtgatggtgatgttctgtacctaaaataatagtactgcctagaggagagatgtaaaattatagtagcagaagttctcttagacagcagggaaagctgctagataaaggctgaataggttccttttttttttttttttttttttgagacggagtctcgctctgtcacccaggctggagtgcagtggtgcaatctcggctcactgcaacctctgcctcccgggttcaagcgattctcctgcctcagcctcctgagtag

SEQ ID NO: 224953 - DNA, 512 bp, Homo sapiens
agatatgtaatgaagggagatggttggggaggagaggaagacaaaagatacaactccgggggatggtggaggtttaccaagaggagaaaccagcaagacacacagtgggaacaaccatgagggaagaggtgactgagggactgtattgttactgcagcctcggaagcagcaaatataaaaaagttaccctttctgccccacccaagctcagagcctcctcactgattttcctactcccaggccctcccagtgccactgtggttcacactgagcactggtcctggggtcctagcagtcatcattttacacaatttgatcctgttcagctcttctggttttgtctctctttctttccttcttctgaaagtctagctggagaaaataactctccataccccggaacacacaccgcgttttcccatctttagctctctgctcactaatgacttcccctctaatgtccatccccatcatatcatctccacccacccaagtcctacccataaaaggag

SEQ ID NO: 224954 - DNA, 246 bp, Homo sapiens
catgtccctgaagagtgacttgatgcaagagggtggcacagaactgtggaaagaaattggaacatgaacttaataaattagcatatgtaatgcactgaaacatttacacataacagagattagaggagaactgacctctaggaaggtttgggttcttaagtcatccaggtcttgatggccaaggccatctataaaagaaatattttccttttttcatggtgactaaaaaataaattttaaaagtat

SEQ ID NO: 224955 - DNA, 404 bp, Homo sapiens
tgtatatgtccaaatccagattcaacctgcattcacaaagagaaatgaagaactgaatcattcgtctgtgctgtgccaagcttctgcctctatcaaccatatctttcaagcatgggtaggaggcaagggtgaattgccccaatcggttgtttaccttgctaagcttgccttctgatagcttttcttcccattctgattgtccatcacaaagccaagtatatgttgtatatgttccaaagattgtaagagtaagagtatttggtatattctaagagagaaatgtaaactctacaatttgattcaataattaagtatatagccatgttaaaaacagtgaaacaaaaacacccatctgagtctttcttcttagactaagtaagctccaatgaaagcatttctcctat

SEQ ID NO: 224956 - DNA, 286 bp, Homo sapiens
gtacctaatcaatgcatttcccatctgactggttgattatagcccattaaaatagtggagtctgtgcaatagaattctctctcaccccttctgtggtccacgccttcttctcgggtcaagataattgacgagtagaccatagacatagacacaacttaccttttataagacattatatgtctgttatttgtgtgttgtttgtgtttctcctggaatgctttgtaaaacccctgcaatcttacttattttctagtttggatttgctgtaggccaagcaataatgaat

SEQ ID NO: 224957 - DNA, 357 bp, Homo sapiens
caaattagttaaaatggcctaattagtggactgtaaaaatacaaactgaggctggcagcctgatgtgtattagacaaggggactgtctccccacacggggaggcctggagctgagcaggccatgggacccagctcacacctgactgtggggcttcggacctttaatagccagcgacgcagctgaacccaatggttttgccttaggtaacgctgtcttctcctggcccaagtcatggccctagctttggccaagtgggtataatggaaagaacgtggggtttggatccagaacctgagcttgaatctcagccttagttcaccagctactgctttattaaagttgcttaaccctcctga

SEQ ID NO: 224958 - DNA, 267 bp, Homo sapiens
ttccattggagtttatgggctagttgagaaggtagacattaatgaaaatacataactaaatataaaagcaagagagaaagaaaaaaaggaaggacagaaagaagaaagaaagaaagagagagagagagagaaagacagagaaagaaagaaaggaaaagaaagaaggataaaaagaaaaacagatgcataattctgaaatcacaactgtgatgagtgctacaaaggaaaggtaaatataatagaaaggggaaaaatgtatgacagagg

SEQ ID NO: 224959 - DNA, 907 bp, Homo sapiens
tgccctccttgtagtccggtgggaaacagaaacagtaaatagggaattataacacagtgtcatcaagttcgtggtagaagtacaggatgcagcagggccgcatcagctaccttatgcagcgctgttgggtcatggatgacttcttagagaaagtgacagctaagaaagaggcttaagggagaaacagagattagcttcagccacaagaagttcattggtgtctttaatatagacctatttgttttgttgttttgtttttgagtgatggagattgaatcaagataagttgaggacttcatgaaaaaacagaggctgcagtaaatgattcttctatgaagattgagataggatggagagagacagggctgaaggggacataggttgagaggatgttttgttttgtttttaaaattagagtattttgtgctgatgagaaggagccaataaaggaaggtagattgggaatatacggagacaataatgagaaaaattagtaaggtattccctgaggaaaggcaaaaaggaacatgtccagggcatgagtggagggagtagccatgccaatgaaagaaggaaaagataaacaagacagataataagccctgcattcatggaattgtttaaggacaatgttagtcttggagagccctatttaatttggttagcttctttgtggtttgaaaaatatattgattttaattatacaatcccaccaatgatttctgataattatagcttagagacctaatgctgggtttcctggaactctttaaaattacaaatagtggctgggtgcagtggctcatgcctgtaatccaggcactttaagaggccaaggcgggtggatcacttgacgccaggagttagacaccagcctggccaacatggtgaaatcccatctctacta

SEQ ID NO: 224960 - DNA, 214 bp, Homo sapiens
tgccctccttgtagtccggtgggaaacagaaacagtaaatagggaattataacacagtgtcatcaagttcgtggtagaagtacaggatgcagcagggccgcatcagctaccttatgcagcgctgttgggtcatggatgacttcttagagaaagtgacagcctggaaagacttaactttactctgagtgagtggaggagagaagtccgagccgac

SEQ ID NO: 224961 - DNA, 353 bp, Homo sapiens
tcctcccttaaaagggcaaaagcacaaggctcagccctggctttcccagctcctctggtctcgctgctccacggacgtgtgacgtacgctggtgaaacgaagcccgcttgaatgggggcttcactattgtgtgctgctgaacctaggcctagcgcctggcaggctttggtgaatgttcagaaaatgacaattcatttcgtgtcagcgagggcacaccagctttgaatattttgctgctgttcaaatgcacaattttgacaattacctagcaatgtccaaagtcgtcataattgttagtgtcttgcacgtgatgttccttataaccatgtaataaatacagtgtgaagtctcca

SEQ ID NO: 224962 - DNA, 646 bp, Homo sapiens
acagcagtgatttttccgaggtggtcctcaggccaggcatcatcaccaccacctggaatttactagaaaatgaaatgttcatgttggggccccgtcccatatccactgaatcagaaactctagaaatggggcctggtgcagtcacttgcaaacttcaagtgtttaaaagacctgaatctcacaatagtctctataatcatgaaacattaagaactaaacgaatgttaatgccataaaactgggaataatccaaatatctttgaaaagaagaatggataaattgtgtcacattcattcgatggaatacgatacaggattgaaaacgaacagtacagctgcattcaacagtggaggaatctcacaggcaacattgaacagagggagccaggctcatccagaccatcattaaattcatataaatttccaggcaggcataactgcacagcacatttgtgctaactagaaaaggcctcttctctgggcagatttatccccacaggtatatagcttggcaccttcagaaaaagatgccccgtttccagccctggaccacgggacacagtctgcccagcgggtcaggctgaatgtcagctcttgtctgtctctttgggcattacaaaaagagtaaacaagtcaagcgattcat

SEQ ID NO: 224963 - DNA, 536 bp, Homo sapiens
ctgaaatagctacaatgattttgaaaaaataagaggaatctcacacttttgagacttactgtgaaactctagtaattaagacagtgtgcagtgttgaaggaatggatacagagctccatggaacacagtagagtccagagatagccccacacaaacgtgtggacggagagtccggagacagccccacacaaacgtgtggatggagagtccggagatagacccacacaaacgtgtggatggagagtccggagacagccccacacaaacgtgtggatggagagtccggagatagacccacacaaacggggccatcagagttttgacaaagagcaaaataaattcaagggagaaagggtagtctgttcaaaaatgctgctgggaaaagcagtcatttgtgtcaaaaaccaaacgctgacctatccctcatgcctcgtgcaaacatctaaaactccaaagcttttggaagaaaccataggaaatccttatgacctgacactaggcagcaaaattcagaacttttgcttcaagacactttt

SEQ ID NO: 224964 - DNA, 395 bp, Homo sapiens
tgaaatatgccagatatgtctcaatcctttagtcagtaatgatactaaaagacctcactggtcacatatggaagatgctaggaatcaactcgttattttgaaaactgatgcagataaaatgaaatcaagccattattttgccttatatgtttgaagtgtacctgagacagtaactgatgagggaaaaatttggaagcattctagctaatgaagaaacgtgatagacttagaatattactctattactaaccttaatgaaatagtaaatcattaatggccattgatatcacagagagccaaccagacatatatgcctctgatagaaatatacaaccccgcttaggaaatattaccatcaaaaaattaaaccagactgctgaagcaaggacaaataa

SEQ ID NO: 224965 - DNA, 476 bp, Homo sapiens
tgatactcgagtaagtgttcaaagtgagcagcccatgcaactgcctgggggaaaggaggattttccattccttggggaaagggtctgtgccaatgccatgaggtggacatgtgcctggtgtgttgaagactggcaaggaggtcagtatgggtggagcagagtgagcaagtgggagaagagtagtaaaagagaggtaatgggattgagtagggggaaatttcccacagcatttactctgtgttgagtccacggaaaggatttcagcagagggtataatgtgatcagactcctcaaccataatatgccatcaggagtgctccgttgagctgagaatagcccgtatgaggacaaacatgaaggctgataccacttagaacacggaatcatgtgagggacagtgatttggaccatagtggtagcagtggagtggctatattctaggtgtattttgcaagtggagccaacaggatttactg

SEQ ID NO: 224966 - DNA, 457 bp, Homo sapiens
cagggccaccaagtacttggtggagagaatatgaatacagagcacatgaggatttcacttgtttttatcagagcatttgatagtctcctgttgtcgaattgagtaaatatgtgatgaattatgctttgcggtggttgaaggggcttatcaaagagttctactaaatgtataggagttagtttgtagggaagtcatcttagacttattcagcatttttctcaagtgatttggtgaccactgatagcgttttgatcaagttgatttagaactaagaaaaacaagttaaattaggaaaaagaatatggatgaaaaaacaacccttagagtttagagtgatctgctcaatagtaataatgtgaaatttaataaagataagtgcgaatcttgtgttttaacccaaagtgctaaattcataagtacagaataggagaaacacagcctacaatggcacaggttt

SEQ ID NO: 224967 - DNA, 457 bp, Homo sapiens
ttctatacagatgcaaatttatcctacaaaagatagctttgcaggcccacttcattctgctggctctatttcagccatttcaaaatatgtcaaataaatttatttcgcagtaagattatctatctatctatctatctatctatctatctatctatctaatctatctaccacaaagtttaaaacaattgaagacctagaaacatactgggtatttctcatccttcccctatggtaccacaatgccatgttttctatctctagaatatcatttactgccttattttataaaggatgtctgagtatatattataaatataaatagaatgtaagattttgagtatatatctcatgcatttactaatattccacataatccctgtatgatatcagcacataatagttattcaatttactaatttacaattaaaaaaatgaaaacaaaggtaactaaagtaaa

SEQ ID NO: 224968 - DNA, 172 bp, Homo sapiens
ttgttcaagatactggggataagcagaaaaaatgcaggcatgatctcaattatcttggtgcttacactctagtgaggcaagagacaattaagcaaacacataaataaatgagattggttttgaaaatatagaaagcggctgggtgcggtggctcatgcctgtaatcccagca

SEQ ID NO: 224969 - DNA, 221 bp, Homo sapiens
gtttgacgcagagcagaatcatcccctagagcttgttaacattgctggaccccaactccagagtttctgattcggcaggtctgggttggggccccagactttgcatttctaaccagctcccaggtgatgcacgagagaccacaccttgcaaaccattgttttagagtctgtgggaggttcttactgcggttgttggaacaagcacttgtctaaagttcaca

SEQ ID NO: 224970 - DNA, 515 bp, Homo sapiens
ctgctttatctctgggggcaagagcagcagttttgcagtcttaagagaaaattgcaacatggatagtacttgtccttaaaaaaggaaaagtattgtttatggttctaaagtaattaattcagggacagaaaggtgttgcataacggtttgcctaacaaatgatcatgcttggcttattaaatttgaaagtatgcttcagacgatcacaagttcgtaaattaattttcaaaatatttgcggggctgtcttgttactaatggtgttacaagttcctgaattccatatctctttttgccaatttgatataagaaaaacttacgtaaaagaaaccagtgacataacgatagctaagaactttgttgaatagattacgtgtcaaatggttgcaaaaaagcactcaaactggggagatgagatggggagagagttacaaattttttttttttttttttacaaattttgttacatggaagtttctctaatcaatttagaccatatctctttttcctgctcca

SEQ ID NO: 224971 - DNA, 253 bp, Homo sapiens
cacaacatacacacacacgcgccccccagtttttttcatcgtaagccccgagggagccagacccagagggtccaccgacgtcccggattctaataacgacatctgcgcgccaggcgggcctcctgcgggagccggggcccattttctttcgaagctaacgaagctgctgcgcaggcctgttaattccctcagcagccagtgcgaggttaaacacgcgacctcgcaaccatggcttttgagaggaagctgaatt

SEQ ID NO: 224972 - DNA, 260 bp, Homo sapiens
tataaattaacagttaaaaaaattaacagaacaataagcaaaaaacaaagaacaaattgagatcaagatatcccaacaggctaagattttctaaataatgactccagtacaagacacataaccatggcataaattccaaatattctatcctgttatccctcaacccactaaaatatgtatgggctgctgaatgttaaattgaaaaatgttaaatttaacattaaatgttaaattctttctttatgaataacttctcccag

SEQ ID NO: 224973 - DNA, 496 bp, Homo sapiens
cttaccattttgcttctaacaatgactttgatttggaactaattggggtttaaagcacacgttaaccacatctctctcaagggcacttaataaactccctgtcccttgttcaaggagaccagccaggccctccttttgggataagagccaagagcttctgagtacctttcaccaagaaatgagaaccccatgcagagaatcttatctgccagaaaagagccactcctgtccctgagcagagctacttatttcattcctgggcagaatatgctcaagctttctggaggaggtggggttctcctggcaatctgggagggggctcttctgctgctcagctgctgggccatggcagccaaccatcaggtatttggtgaccaaaagaaagcggccagcacccagccaggtgaccagatgtcttcatgcctcagtttcctcatctataaaatgtaaagaataataaaacatatcttgcagagttgttgggaaaattgcatta

SEQ ID NO: 224974 - DNA, 1061 bp, Homo sapiens
acactatatatatacatatatacatgatatacacactatatatgtgattcatgttttaggtactgtaagtaatatatataacaaatatatatgatatataacatatatagtgtgtgtatatatagggttttataaaaattaatatataatgaatatatgagatatataactaatctatatattgaatgtatgtatgtgtatatagggtgctgtaaagaatatataactaatatatatgattatatatagtgtatgtctaatctatataaagtgaggtaagggggatgcttggcaagggatgtttgggtctgagcattgtcggcagggtttatgggctaggcatgatcacagggtgtgggagtgatggtaaggaaagaaagatgagagaggggcttgagatggctaatttggggctttcagaaccttagtggggtaagggcagtatcctccaaaggaatagatggcaactatggatgattgctcacacatagcagggttgttcaaataagtaaatatctcaaggataatgggagccaggcttctctctgtaggagaaagtagttataaatgtggaagggcaaaaactagaatgaactgtatgatgctggattggaggttttactgtgaacacatgatttttcaatatatattgttagacaaagaaatataactgtaaatgtgtgtgtaaggatacatataaagatgtgctgtatatgtgtatgaatgtataaatattccctaactgcatccactcagacagcctgggctatggatatctcaatagcagtgagcatacctagtgctaaataccattctccgctataaggaatcagggctcctgaataaatgattacatccaaggctggagcaggatgagtatgaaacatctaattgccctagtaactaggggagtgctgaaagaatgatggggatgtgtcaaaaggcctcagaatggtaacctgttaatgttgaatctggattatgtgtatatggtatttaaagctcttttaattattctgtattaaaaaatattttacaataaaatgtttacagaatctaag

SEQ ID NO: 224975 - DNA, 1006 bp, Homo sapiens
acactatatatatacatatatacatgatatacacactatatatgtgattcatgttttaggtactgtaagtaatatatataacaaatatatatgatatataacatatatagtgtgtgtatatatagggttttataaaaattaatatataatgaatatatgagatatataactaatctatatattgaatgtatgtatgtgtatatagggtgctgtaaagaatatataactaatatatatgattatatatagtgtatgtctaatctatataaagtgaggtaagggggatgcttggcaagggatgtttgggtctgagcattgtcggcagggtttatgggctaggcatgatcacagggtgtgggagtgatggtaaggaaagaaagatgagagaggggcttgagatggctaatttggggctttcagaaccttagtggggtaagggcagtatcctccaaaggaatagatggcaactatggatgattgctcacacatagcagggttgttcaaataagtaaatatctcaaggataatgggagccaggcttctctctgtaggagaaagtagttttactgtgaacacatgatttttcaatatatattgttagacaaagaaatataactgtaaatgtgtgtgtaaggatacatataaagatgtgctgtatatgtgtatgaatgtataaatattccctaactgcatccactcagacagcctgggctatggatatctcaatagcagtgagcatacctagtgctaaataccattctccgctataaggaatcagggctcctgaataaatgattacatccaaggctggagcaggatgagtatgaaacatctaattgccctagtaactaggggagtgctgaaagaatgatggggatgtgtcaaaaggcctcagaatggtaacctgttaatgttgaatctggattatgtgtatatggtatttaaagctcttttaattattctgtattaaaaaatattttacaataaaatgtttacagaatctaag

SEQ ID NO: 224976 - DNA, 497 bp, Homo sapiens
gtgcatttgggatgagcacagatatcaagacaggaagaccatggccctggtatattaccatcttgtctccagagaaatgtagaaggaaataggtttcaattcactgctttccagtctgccacgtgcagccttatccctcagaggagtgagtctctcaatatctgggtcactggcccagatttttctgtctctgtgctgactgaccacaagacatctctagatgtcaggattgtttggtatgcaaatttaagtagccctccttgtgaggcttactgtgcactttgtgcattagaatggcatgttcaatgaaaaaggagtgaattcacccttacaggtggggaagatgccagaagggaggtgtgtctcacctgtcagatgcaacttcataaatgctgtttgctgggataagctctgtgcatgttcctgagaattctttttctaagatcaaacttttacatgtaacttgaaaacacgtgtggtatgtttgaatgtgcaga

SEQ ID NO: 224977 - DNA, 754 bp, Homo sapiens
gcacgagaaatataacaggaggaagagcatactcatgcaaattagctctcatacagtttcacactggaaagggtttataggacaggggttgagggtgttagattttagggactgaaggaggaaaactgtgtgaaactgtatgagagttaattcaagtgatttgacaagtctaggaagtgacaggaagtagaatgaggcctgacgaggacttaaaactaaaagaccaagggagagtcaaagaaatggaggtgtagaagaggtcagaaagagacagaatgtgagtaaggcaggagagtgttacaatgagttggagatttcttaacgtggagcaggcaaggtccagaatatgaatgtattgccatgtaagtagactgttgaaggtggaacaaaggtgaaggcacaaacaactaccagttggattacaagatggaagagaagcacccatgtaatagcaactgaactgaaaaaaataaaacacctaggaataaacttcaacaagagatatgcaataccttcataggagaaactttaaacacttccgacagacacaaaaataaacctgaataaatagacatgccaagatggcaatgtccctactatacatgtaatacaattccataaaaagtgcctgcaggccgggtgccagggctcacacctgtaatcccagcactgtgtgagactgaggcaggtggattacttgagtccaggagtttgagaccagcctgggcaacaggttgagagcccatttctacca

SEQ ID NO: 224978 - DNA, 920 bp, Homo sapiens
ctcggctctaccttgtcttcccaatttcctttgttgagtgtaagggaattgggaaggcaggtagaggactcatggtacatttgctgaagcttacaagagtcagtggaagctgaccaaagacgagcagaggcagcactgagcagtgatgagggcccccgtgagactctgccccatacagctgtggtttctaatttgcatgagtatgctcttcctcctgttatatttaacactggaaagggtttataggacaggggttgagggtgttagattttagggactgaaggaggaaaactgtgtgaaactgtatgagagttaattcaagtgatttgacaagtctaggaagtgacaggaagtagaatgaggcctgacgaggacttaaaactaaaagaccaagggagagtcaaagaaatggaggtgtagaagaggtcagaaagagacagaatgtgagtaaggcaggagagtgttacaatgagttggagatttcttaacgtggagcaggcaaggtccagaatatgaatgtattgccatgtaagtagactgttgaaggtggaacaaaggtgaaggcacaaacaactaccagttggattacaagatggaagagaagcacccatgtaatagcaactgaactgaaaaaaataaaacacctaggaataaacttcaacaagagatatgcaataccttcataggagaaactttaaacacttccgacagacacaaaaataaacctgaataaatagacatgccaagatggcaatgtccctactatacatgtaatacaattccataaaaagtgcctgcaggccgggtgccagggctcacacctgtaatcccagcactgtgtgagactgaggcaggtggattacttgagtccaggagtttgagaccagcctgggcaacaggttgagagcccatttctacca

SEQ ID NO: 224979 - DNA, 506 bp, Homo sapiens
tttttgggccagtattcacagtttttcagtgctaatccatgtagattaaacataaaccactgattagtatcccactgtaccaacgtatttggctaccctcacatagatgaacacttaggttgcttttgactttttacaattaaaaatgaattattctgcgcttcagtgaataatcctgatcatacatccttgttcacatgtccctagaagggaaacactggggctcaaagcatgcacatttaaaaatctgttttggccaggcatggtggctcatgcctgtaatcccagcactttttggaggccaaggtgagcggatcgcgaggtcaagagttcgagatcagcctggctaacaaggtgaaaccttgtctctattaagaatacaaaaaattagccaggtgtggtggcatgtgcctgtagtcccagctactctggaatctgaggcaggagaatcgcttgaacccgggaggcagaggttacagtgagccaagaccgaaccattgcactcc

SEQ ID NO: 224980 - DNA, 418 bp, Homo sapiens
actgtacaagtcctaagaaaaatatagcgagaaacttgcaggacttgagtaaatgagaaatatttgttaagtaagaacaaatataatggtattgcaggttaataaattgtttattatataaatatttaaaattttgtacagctaaaaatactttaaatatagatatgagttgaaggatagactcaaagaaaatatttgtaaacatttgataaataatatcactaacatacaaatagctcctttataatgacaataaaaagatccatagcgtaaatacaaatggaaaagtcttaacaggtaatagataaatgaatataaattgtcatgtaaaagtccttcttctgaactaaaagttaagaaagtgaaaattaaacatataaacaagataccattttcttttattaaaatttcaaattaa

SEQ ID NO: 224981 - DNA, 195 bp, Homo sapiens
tttcattattttacatcatggaaaaactgaattgcaaaattatcatgaagatactttaagtactctaataggtaatatagaacaagtgtagagcatttcatctgtaggatgaaaaagttgtttacaattattgaccacatagagcgttataaaaagacccaatttaattaaagtggcaaatatggtgaggaaacc

SEQ ID NO: 224982 - DNA, 377 bp, Homo sapiens
ccaccccccacccaccagaccgaggattccaaaagggggcgaaggcggagagcaaagggggctgcgcccacccggagccccgcggcggcccagcgcggcccgccctctcgttgccttggaggcagcccctgcgggcactcgcggtcaaaggcaggatttccgtcggggcggcagcaattcccggatccagcggggagcgcgggccgagaccgccgcgggcgcggagggggcgcccggagaggcctgtccctgccgagggcggggacttccccaggaagcggggacccacgcctcgcgcgcccggcaggagtcccctgcagcccggaacctaccgcaagggcgggccgagagggtcgcggggccgcggtcgcggccgc

SEQ ID NO: 224983 - DNA, 118 bp, Homo sapiens
ttccaatacaattcagctcgtacctaaggaaaaacaaaagactgttgtccttcattgtaatatgttggaagagatgtatgctttgaaatgaagcatttactaagagaactctgaacac

SEQ ID NO: 224984 - DNA, 429 bp, Homo sapiens
ttgggagtgtgtctttgactggacctgtgttttcatctgtctcaggcccacgtttgggagtatgtggctggctggatagcagacgtagcataggcctcacttttctgtgccgttttgcagtcccacctgcagtgcgtgagcatcttgctccgagacctcaccagcactctgcattgtgatgttcttaatttcagccgttccagcagatgtgcactgatgctgtgtcgtggcttggatttgtgatgcttttaatttcagccgttccagcggatgtgtactgatgtgtcctggcttggatttgctttcacggtgaccagtgctgctcctcgtttgttcatgtgcttattggccatttgtatgttttccttgtgaagtgtctgttcaattttttgcctattttttcattaaattgtttattgagctgtatga

SEQ ID NO: 224985 - DNA, 415 bp, Homo sapiens
gggctcagggaccagagcgggattatggaaatcaaaaccaagcttgcagtggaggggagaggtatgggccactttgagaggtgcctcgtgtgggagggggtcagaatggacctcaccattgaggggccgggagaagaggcttctaggcagaagagaacagtgggtgccaaggccctgaggcaggaaggtgtttaggagcagaaagaaggaagcctggggcttagcatgtgctcagtacttggccaagaagcctcggcccaggggctgggagtgtgagcgcaggaaagaggttgctggacacggcaggagagaatgggaactgggccctccaagggcagcccttccaggagatgggacatggattccttgtttgtgttctctgctatagccaaatatatgtgcacgtgtatgtgag

SEQ ID NO: 224986 - DNA, 232 bp, Homo sapiens
tcaagaacaaagattatgttttattcatctctatattcttagcatttagcactgtggcttgcaaatacaagtgtctccctttccacctccccacccctacccaccaaaaaccacaaaatgacttaatctttaaggatacttgattactctgtttggattttaagagttctatgtgcttgaaccataatcacatttcttttggtgaagaaaaataaaccaatgtttatcttta

SEQ ID NO: 224987 - DNA, 421 bp, Homo sapiens
aactaatgaatgttttcctgtcaagttaatttggagtttatcctgagtttattaaggattagcatcctgaagtgtattgaaacaaaatgattatttcataatgtttgaattgcttccaaactgcatgttatttattctaaactctccctctgataggataccgagacctagagaagttaagaaaacaagccccagatcaatcacattgctcctgacagcacctaaccttctagattccaagtccaatggttttcctggtactatgatgctagtagatcttaaaaaataataatctagatctacactatccaatatggtagccactggccacatgtgattttagctcttgatatgtgtttaattcgaatttagatgtgccgtaagtgtaaaatgcacactgaatttcaaagacttagtatga

SEQ ID NO: 224988 - DNA, 313 bp, Homo sapiens
tattgttctaatcatcgttatttatatatgtatttatatatatgaacataaggaaataaattcaatcaaccaataagtattatatccaaacaagcccaaatgttttctttcatctgtttagaagtttttccgataaagaatataacatcttttaattttttgctaaaattagaatttttactttatgtaagaaaaagagcacattgaaactataccatatactgatcatttatataagatagtcttatctgaaaagcaatctatttttgatttgtcttaaataaaactgacatcttttagtaaatctaagttg

SEQ ID NO: 224989 - DNA, 309 bp, Homo sapiens
gctttagttttggtctctgcatttttacaaaagtatgtgtggtatatgtgagaatgtatttttaaatttacgtcttctagaaatgttttgaattcgcatatacttggtactggggtttgaagcatattgtttggtaaaattacttaaaatataggtgcttgttttattaacaagctaggtatttttacaagggagattgtaattgggcttaatgtaaaggccaatgagagtacctaaaattgggtgttgagtggtactgggctgttttaatatatatattttagatattaaaaatcaacggatgtgtta

SEQ ID NO: 224990 - DNA, 477 bp, Homo sapiens
gtattgaagtttcctacaatttttttaaattttttatttatttatttttggagatggtgtctcactctgtcacccaggctggagtgcagtggcatgcctccctggtttgcaccattctcctgcctcagcctcccgagtagctgggactacaggcgcccaccaccacacctggctgattttttgtatttttagtagagatggggctttaccgtgttagccagggtggtctcaatctcctgacctcgtgatctgcccgcctcggccttccaaagtgctgggattacaggcgtgagccactgcgcccagcctctactattattatataattttctgtttctcccttcagttctgtcagtgtgcttcattatattttcaggcggtcatggtttgttgcatatatgtttataattgtatcttcttggaaaattgaccatttaatcaataaacaatgttctttttttgtcttttgtaacaatg

SEQ ID NO: 224991 - DNA, 408 bp, Homo sapiens
attgtttgccattcttctgttctctctacactgtcactccaaatactatgatcacggcaatcttcagctgaaaacctaccaattgcagtatccatagcctatagggtgaactgccaggagctgacatagcaaataattgtttaagatttggtccttgctccctgcccagcctaacgtcctttcatactctcctacactctagaagctgctctgtgttgctggagtttataagccaaggggcagtgaatggcactatcattccccagatgtatgtgggagtcttccttgatacctctgggttcttacctccactcctaacacacatacaacccccaagttgcccctaaatacctctgtaatttatcttctctccatctgtgctgacactataagccaatccatcttcct

SEQ ID NO: 224992 - DNA, 273 bp, Homo sapiens
tttcctgcactgcccgatggggccaacttcttggctggggcaccctgcttctagtaggaccaagatgcactttgagaaggtgattaaagttaccgcttgccccccaaatgctcaagacaactggcagaccatttttggaaggtttacagccaccagtgtcccaaagatcaacacacaacagcaaaaaggctggcatctccctaggtactgttagtgccagaaattatgtattcggttcctcccctcccctgagctctggcaggccctagcaac

SEQ ID NO: 224993 - DNA, 102 bp, Homo sapiens
gtccatatgaattttagaattgttttttttctaattctatgaagaatgatggggattgcactgaatttgtagattgcttttggcagtatggtcgttttcaca

SEQ ID NO: 224994 - DNA, 414 bp, Homo sapiens
agaaaatattgcatcagatgaaaggcaggtttagaagatagcaaataaagtggtttaatatttataaactttttagagttgaaatcttatgatttcatggcatccacatattttaggtttcagaaaatatacagctgccaggaaaatgaatatcctcttcatgaaggttaccctatttaggcttcttctaaaacatacagtaaaatactccttgggctggtaaaacaactgtatcatcataatctagatagaggctaagaactttttgtgtttcccatctcaactttgtacatgttctttaatgtttgtaagacggaaagaaaagtgataaactcttcatccaagcccatacatcacatccatcttggaaatctaagcttaaagacatgaatataaaaaaattgaaatcaaatt

SEQ ID NO: 224995 - DNA, 358 bp, Homo sapiens
agaagagtagggtgggacattgagagattttcatggaagtgaaatggtcggttactagagactgcatatgtggtagaaagaaatggagggggaatgatagtcaccctctcttgaaaggtagttactgttgcatatcacagattattgaacatagataggtcttatttttggaaactgaagagagaatggttaccatagaggacagttccatcaaaagaaccagagtagtgttcttataggggattcacatttggcccctgagattgcatttgataccattttatttagaatatattatacttcttatgtcttaattagtaaaatataatcatttttagtaaccctgaatgaatcgtgt

SEQ ID NO: 224996 - DNA, 271 bp, Homo sapiens
tgtggttccgtgtacatgcaacagcagggtggggagcgcggcagagacagacagcaggtgggctggcaccaggagctgggggaggagaggataagagcaactgcccaatgggtgtggggatcccttctgggaagtggtggttgcacaacaccatgatgtgccgaatgccaccgaattgttcattttaaatggtgaattttacgttctgtgaatttcacctcaattaaagaaaaaaaatattgctcctttgaagcctccatgctgaagagac

SEQ ID NO: 224997 - DNA, 324 bp, Homo sapiens
gaaccttgagaacgttatgataagtgaaataagacagtcacaaaaagacaaatattgtatgattccacttataggaggttcccagagtagtcaaaaattcatagagaaagtaaaatggtggttgttggaggctggtgggaggggaatggggagctactgtttaatgggtgtagagtttcagctttgcaagacgaagaattcaggagatgcgcttaataccactgaactgtacatttttaaatggttagatggtaagtctcattttatgtgcacgttgccacaatttaaaacttaaaaaggtaacaatttaaaaacaaagcaaca

SEQ ID NO: 224998 - DNA, 571 bp, Homo sapiens
caacctcagaagtctacccttccttccagctaaagtgggcagcacagcatctctactttctagccttttctttcagccctaaccactctagttttctatcttgtctttaaaatgagtttgtcatcatgtgcacggttccttctaagtctacattcataagcctgtgtgtaaaatgccccactcagttcatccttatcacctctatatattcatccttcaaagtttcagcttaagttccaccgcctttgagaagcctctctgaccgctacctcttccagcaatgcttttcttcccttcatgttgaccactggttatctatggattgcacttaaaacaattgctttattttttattctgctctatagtttgcttctttattccttgacttctcaggtggagtgacagggactggcctggtccactttaatgacccacagaagaccctaataagtgtgcttactaaactcaccaggacattcgaacactcaagacactttcctctctagagttaccccaatttagagccattcactggctccggtagcttcctccccacccaggacaggaaacg

SEQ ID NO: 224999 - DNA, 773 bp, Homo sapiens
taaagggccagagagtaaatatgttatgctttgttggccatctggactctttcacaactacttaactctgctgttgtagcaggacagcagccatagacaatctgtaaatgactgggtgcggctgtgttccaatgaaactttatttacaaaacagatggcacacagatttgcttctaaggctctagtttgcagcttctcctctactaaactaagagtggtttactgacttagtttcacatctagagtatatttgtgtatggcaaaactcaaagtctttttacatagttgaatgatagtatattgtggtggaatagtaatctgctcaatagtttgctagtggtctaaagatctgatgttcaatcaaagatgtgtaatttactactaagaggaagcaagttaagcctcactaattctaatgtacttgtgagtggaaagatacaatgaatatcatgttaagaaaatagtacacgtttaagaacaatctgttcccctatggtctcctaggtcatcaagagaatggactctttaatggacaagaattatgtgctcagtaaaatggtaatattggctctgcctgtcaaaggaagcgttcattattcacaggtgtatatttatcagcatcttcctgagttgatgcctgtttcccaaccatttcttggcattaaagacttcctctggtaggtctatctcctcacagggctccatgtggtccaggctggatctttgcatatatggcttttcccaccaggatgtgggggtgttagaggatagat

SEQ ID NO: 225000 - DNA, 217 bp, Homo sapiens
agccaggatggtctcaatctcttgaccttgtgatccgcccgcctcggacttccaaagtgctgggattacaggcgtgagccaccgcgcccagcctccttgggcacattctttaaccattctgggtctcagtttcctcatctctaaagtggggttaattcctgcctttcctggattactgtgttatcatgggatagataatgagatacaagtagaacgc

SEQ ID NO: 225001 - DNA, 419 bp, Homo sapiens
gtatcctggcgaagtttggatgcagagaacttggagctgttgttttctaccagacactaggatccctgagagaggtgtcattctttcgcgctgcacacaccttcctccacgtggtgaagatacatcgctcctgacagatccaaagggagatatcgatccatggaagatggttgctctcggaaaatgctgagaagtttgcaaaaggaatggaagcagagttaaccaatgtatcaggaagcttacactttctccttttaaactgctgtgctggtctattaagacatgcctaatacccaaagctgaggggcaaaaggggagagaatgaagtttatgcgtctgtgtcatagagaaaagctgccaaaatgtgattaagctttttgagttagaacttaacaaaatgcctttgctactggtttcca

SEQ ID NO: 225002 - DNA, 512 bp, Homo sapiens
gtatcctggcgaagtttggatgcagagaacttggagctgttgttttctaccagacactaggatccctgagagaggtgtcattctttcgcgctgcacacaccttcctccacgtggtgaagatacatcgctcctgacagcctcatgcctgactggacactgaaaaagaggtgaagagatgaggcgatagaacaaaagaacagaaagataatgaagctgagactaagtaagtgaaagcataattatgtatgcagccacaaatggagcacaaagcaattactgcttgtgggaatttgagagatgctctttgaagaggtgtgagggaatcagtaatacttgcagtgacttttaaggaggtggagtgtgctgatgaagatgccacaaagaactgatgggaagttattcctctccccaactgctattgtatccttcctgtagtgctgtctctgctttttgcatcttgcccagtatattatgacacaaataaaaattctcttttcatcatcttgcaaaaa

SEQ ID NO: 225003 - DNA, 824 bp, Homo sapiens
atcctatgagtggtttttggacaagttgcttccggaagtatgccccaaaatgtctgtacacaccccagagaaattagcaatctgtcaaatgacgtatctgggcatgaagtaattgagtgtgttatcaaccttacaagtggccttgccaagtcactaagtcaaccccagaaaatctcattagcacctgcctttccaggtcatcaggaacaggtcgtggtgacccacggtgctatccccagtgatatccacagtgactggaatccatgaaaactcgtttacttaaaggatcagtttaaaagatctttttaaattggcccagaaatttataaaagttcattcttgtttgcttagggttcattactcatttatttaatagacatgggcctgattgataaaggaactgggaatgcatgtttaactaaaattacatagtacacacatatgcatatactgttgaccctgagaacacgggtttgaactgtgcaagttcacttatatgtggattttttttccaataaatatgttggaaaaatttttggagatttgcgacaatttgaaaaaagtcactaatggtagccttgaaatatcaaaaaaattaagaaaaagatttgccatgaatgtatacaatacacataggtagtagtctatttgtgtgctaatagactgtttatctgtaaaacttcggttcaacagtaggctattggtagttaagttttggaggagtcaaaagttatacatggcttttatagcagaaaaatattactaataaccgctataaaacatggcataagtaaaagttctaaattgatcattgtttatctacc

SEQ ID NO: 225004 - DNA, 368 bp, Homo sapiens
ggtgtaaacctgtcttttaaaaatggaattattttaaagaatttatcctacaatattcctgacatgccaaagatataaagagtaatataggccgggcgcggtggctcacgtctgtactcccagcactttgggaggccaaggcaggaggatcacaaggtcaagagatcgagactatcctggctaacatggtgaaccccgtctctactaaaaatacaaaaaattagccaggcatggtggcaccagctactcgggaagctgaggcaggagaattgcttgaacgtgggaggcggagcggaaggcagaggttgcagtgagccgagatggcgccactgcactccagcctgggcgacagagctagactccatctc

SEQ ID NO: 225005 - DNA, 293 bp, Homo sapiens
catgagggtggtgtctccccaatgcaacagtgcccttataaaaaagggcatatatggagccaggacagtgagaggatctgaaaaccatactatgtagaaatagttgtcagatttgataaatcttgtgtgttgaatgaatgaatagcctggatgagaggtgactgagaataacaactaattttggtgtctgaaaggctgccatggcaagagaatctttgttccatgttattctgtaatgcaggaatgagacaacctcatagaagctcttgagtgacagatttcagcacgattca

SEQ ID NO: 225006 - DNA, 405 bp, Homo sapiens
tgggattatgggcatgcaccaccattcctggctaattttggtatttttagtaaagatggggtttcaccatgttggtcaggctagtcttgaactcctgatctcaggtgataccaccctccttggcctcccaaagtgctgggattacaggcatgagcccccgcgcctcgcggaaaatgatttaaaatagaaagaatgtggtcaggttgttgcagattcatgtttaaacttttcaaaagggggaggaaggataagaacactgacacattattaatagaaaaatcatatgacttcactgcataagtcttaatgatttgattgtaaaccttttcctctaactcagagacacctgaaaacgtgtatgtaattattctttcttttattcaagaggatgtttataaccttatt

SEQ ID NO: 225007 - DNA, 266 bp, Homo sapiens
tgggattatgggcatgcaccaccattcctggctaattttggtatttttagtaaagatggggtttcaccatgttggtcaggctagtcttgaactcctgatctcaggtgataccaccctccttggcctcccaaagtgctgggattacaggcatgagcccccgcgcctcgcggaaaatgatttaaaatagaaagaatgtggtcaggttgttgcagattcatgtttaaacttttcaaaagggggatagtggtatagctgtgtatagcact

SEQ ID NO: 225008 - DNA, 382 bp, Homo sapiens
cagaaataattagatttacatagtgttttaaatggatactgttgacacttgagctcaccataagagcattaggaggtggctacaaaattatagtagtacagtactacagttaattttatgcagttatgatttaatattgcatcttgatgtttgtttatatttctcttgactataaatggtgccatgtatggtctgtaagtgtttgtgtgtaagtttgataaattctaaccttttctaatagatttgtgtattttatggtagtgaatgataaaatagactagtatctacatatatgcattcatgacatatctttgttgtaatgtttttgatatttctatgctatgtgattcatctgcagatttttcaaactgttgcacatttc

SEQ ID NO: 225009 - DNA, 367 bp, Homo sapiens
atttgcaagcttcagctgagaagaagaaaaatccaagtaggtcaagtgatggaaatttctttcagaaggtctatttcaagcctcaattaatcagcatccctattgtccactgcagctgacctttctaagacaagaatctgattatgtcatttattgtgcttaaaagcatttagaggaaagttcagacttgcaagcatagcttactgcatgggggcttcaggtttggcctcctgtctctcagtctcatctaccagtctgcaccccatgcctacctcactcctttggagctactcaccactccccagaacagcatgctctgcccctccgctctgcacatgctgctcctctcatacattccacctttccc

SEQ ID NO: 225010 - DNA, 349 bp, Homo sapiens
tttagtttttgtgacaatctgttaagaagggggcttattgcataatcaaaaaagaacaataaaaaaataaaaatttctactgtgaaactatttcaatctgtagcagctggtcatgttaaaacactttctgttttgcttaattcgtaactaggcataattaaagttaaatgctaaattttaggtagcagctgataaatggttctaagctttcctgacagaatactcctactactttggtgaatcatggaaaactccttctcctttatttttaattatttcttttccatctgttattgatgtcatcaacacggaagttggaaaggtgacaatgattgttctagactgcctc

SEQ ID NO: 225011 - DNA, 479 bp, Homo sapiens
cagatcacttttttttttgcttcttccatagaaagattaccttctttttttgaatctttatgtatagttttattatattctctatgtgctttgaatgataggaactttaggttaactgataacttatggatacagcctcctaccatggctaaaattcctttcataactagcaaggtagtctcttcaattattataaagttctgtgacttagaaaatacttcctaattaatgagccccaaaatcttcctattgatcctattgacataggatcaaatgtccaccatttgatcccatgtcatatctctgtggaaacacagaaataagtctccctttatgatgtagcttttctggcacatgaaaactactgttatatctgccttctcttctcagattaaacatctttatttctttaacacattgctaattcattcattcagcgaatatttattgagcattttttttgaggcggagtctcgctc

SEQ ID NO: 225012 - DNA, 511 bp, Homo sapiens
actctcctggacacgtaggaaagtgtaaacaatacttaaaatgggaaacacatctcagcacctagaagcgaaattagtgacaaatgcgagcagtttttgctcacagctacatcacttatgaccattttaagcacagaagtttcattttctgacccactaactggctcttccttgctcttctatctccataatctcacctttaaaagaatctaatagatggtttataatgtaaaaagtatgtccatgttaggtgggaggagaatggtaagtatccagttacaggttattcaattttcatttcaatgtgtattctataattgggttctctaaatactaatacttgagacattcctccaaccctgttagctgttatcataaatcactgttacatacacttgggtacaccataatttggccacaataccattctaaagcattgtgttggcttctagagtgccaccgcacccagcaaaactactcttttaaataaatgtacgatgtgaattggatt

SEQ ID NO: 225013 - DNA, 408 bp, Homo sapiens
caagctctcagatgttctaaatggcagtttccttttctataatacaagattctaaagaataattaaaggcagcgagaaaagaatcaactgtgtattttagcttagtcaataccacaaaacttgacagaaaattgacaaatatgagaaaggctggttggggttggggggtattaaataaatttccctggcttgctaatttcttactaaaatggccaaagaattcttgcaactggtaggggcctttctccagtttgagtagttcatcagctgctcagaaccccatctgacatccatcaaaacccagctaggttcatttaacctaatagttctacttcctctgtgtttaagacctatgctcatctgagactaggaccttccttgcctctggcagcaaatctacctgctgga

SEQ ID NO: 225014 - DNA, 568 bp, Homo sapiens
tgttatgtaaatggtaattaggctcacacagaagacaaatttacaggaatagagaaataagaggtcagagaaagccacatagaggtggtgacatttcatgtttggaagatgactaaggacacaaaaatctctgccatgcaaaaaagcccatgtaagggagctcggtagagcgtgtcggacatggggttacattgaggttccaatgtgtaggatatgtaactgtatacattggccactaacacagttgtttatttttaaatgtttatattgtaataattcgctctattctttgatgtggttcaaatccattgatttttatcatgttaaaataagaattacaggtgtgagccactacgcctggccttggggtagtttattatacagacttgtcaaatgtaattcagtcattttatttaaagcccactgtgtgctaggccactgtgcttagaactacgatatgaatattagtaaaatgtactccttgcccttaatgagctgtcagcattagttgaagtcaaaggtggaaagcagatctaagaagatagaaccttaaattgcaacaatgcac

SEQ ID NO: 225015 - DNA, 628 bp, Homo sapiens
tgttatgtaaatggtaattaggctcacacagaagacaaatttacaggaatagagaaataagaggtcagagaaagccacatagaggtggtgacatttcatgtttggaagatgactaaggacacaaaaatctctgccatgcaaaaaagcccatgtaagggagctcggtagagcgtgtcggacatggggttacattgaggttccaatgtgtaggatatgtaactgtatacattggccactaacacagttgtttatttttaaatgtttatattgtaataattcgctctattctttgatgtggttcaaatccattgatttttatcatgttaaaataagaaatatccagatggggctgggtgcggtggctcatgcctgtaatcccagcactttgggaggccaaggtgggcggatcacctgagggtcgggagttcgagaccagcctgaccaatatggagaaaccctgtctctactaaaaatacaaaattagccgggcatggtggtgcatgcctgtaatcccagctactcgggaggctgaggcaggagaagcgcttgaacctgggaggcagaggttgcggtgagcccagatcgtgccattgcactccagcctgggcaatgagtgaactccgtctca

SEQ ID NO: 225016 - DNA, 398 bp, Homo sapiens
aggattcaggttgactgtaatatcctgggtttttggggaaaaccgacctgtttcaaagttgagcttgattatgtggcgctgagcacgagggactccattctggcttggtgtggtctgctggggactggctttgtccaaaccaacggcctcctgtaaaatgtatttaccacccactggcttttcagatccttgagttttgactcctctttccaggctcgggcatcttttatgtcttccagaccactagggctctagagtttctatctttaggcctggagagttttctgagaatttccattcccaaggttgcccctcacttagcctgcaacagtatcccctttctttgtctcattaactgccattgtaagctaatttattcatgtaaatcaaggaatcaa

SEQ ID NO: 225017 - DNA, 211 bp, Homo sapiens
aggccctacataccctcttttggcagccttcagcaagctcccagctccctctcttctggaagagaagtcctaggacaagggtttttaaccttattgatgtcatggatcccttgacaatctgcgaaacctatgggctccttctcagaatatttttaaatacctaaaatacataggatgacaaaggaaaccaatcatcctgaaatacaactat

SEQ ID NO: 225018 - DNA, 511 bp, Homo sapiens
tgtctcaagagccgagctccctgagtgagcaattcctgtcccttttaagggctcacaactctaagggggtctgcgtgagagggtcgtgatcgattgagcaagcaaggggtacgtgactgggggctgcatgcaccagtaattggaacggaacagaacaggatggggattttcacagtgcttttctatacaatgtctgtaatctatagataacataacctattaggtcaggggtcgatctttaactaccaggcccagggtgtggcgctgggctgtctgctggtggatttcatttctgtcttttagtttttacttcttctttctttggaggcagaaattgggcataagacaatatgaggggtggtctcctccgttactctggaggctgaggtgggaggatcactcaagcctgggaggtagaggctgcagtgagctgtgattgcaccactgcactccagcctggcaactaagagagactctgtctcaaacacaaaataaatctgtctcaggagcc

SEQ ID NO: 225019 - DNA, 482 bp, Homo sapiens
caatatttaagaagcagctccaatatttttaaaacgtgaaggaaaacttgcaagcaatctctagggctggagggagagaaatgcaaagccctctcagcctgctccaccattatcttttgcattccaataactgacatgctgctgaatgttatgactatttgtttattgttgactgttcttggcactgctcagtgtagccaaagattccttgcctacaagaaagtcttgctcagacaataaaccacggagaaagaaaattgtccttgagaataagggcatttcagagggaaaggaattccaccagaggcaaagaaacccccgtccaccgcagaattcgagctcaatatctcctatgtctatctgtgaaagccatcatggaactcaagggcaggagggggtggtacacaatggtttgtattgtaatcccctgttttcagacacatttttctgaaagcataaactttgctggctaggactgtata

SEQ ID NO: 225020 - DNA, 335 bp, Homo sapiens
ctatatgtagaatatgtctctaaaattttttaaaaattcaaggcaaggggctggatatggtggctcatgtctgtaatctcagcactttgggagaccgaggtgagagatcacttgaggccaggagttcgagaccagcttgggcaatgtagtaggacccccgtctctataatttttttttttaaattagtcgagcatggtggcatgtgcctatagtcccagctacatgggaggctgaagcagaaggatcacttgagcccaggagttggaggttacagtgagctatgattgtaccactgccctccagcctgggtgacagagtgagatcctgtatctta

SEQ ID NO: 225021 - DNA, 483 bp, Homo sapiens
gtatttttagtacagatggggtttcaccatgttgccaggctggtctcaaactcctaacctcatgatccgccctccttggcctcccaaaatgctgggattacaagcatgagccactgcgcctggtcttaaaatgatttttttactgtcctttagtttctgtccttgaatgaataaacaaagatgttagaacaaaaattccagtctttgcaggaagaaaactttttaaaaaatctttcatcatcagtaagttctacacataagtgcttcacatgtgaagcagtagaattgaggcggaatttttaaatgcagaaaagttgaggaagaaccttaacatttaagatctaatataaaaccaagcctgtggggtgggggggaaccaaaaaaacaacaacaaaaaaacaccctctcggtgctgtccaaggttctgatcgtttcagccatattggcttgtccacataaaatcaattaaaaaccttgttttca

SEQ ID NO: 225022 - DNA, 514 bp, Homo sapiens
tttagtgataacattaaaaaatacaaataaaagctatactgtccccctttcatttgccaatctagaggctaaattaaggagactgctgtcactcattaagagacatggggaaaggataagactataacaaactttataaaatagagtttctcaaatgttcatcatctgtgaattaatgagcactgcacataacatgatcaatttatgtaaaacattcactgcatttttatttatttatttatgtatttttgagacaggttctcactctgtcgccaggccgaagtgaagcagcgtgatcacagttcactgcagcctcgacctcccaggctcaggtaatcctcccacctcagtctccagagtagctggaactacaggtatgcatcactatacctggctaaatttttgtatttttagtagagacagggtttcaccatgttggccaggctggtctcgaactcctgacctcaggtgatccacccacctcagcctcccaaaagtgctgggattacaggca

SEQ ID NO: 225023 - DNA, 616 bp, Homo sapiens
gagcagtgccagcggcaagcgaacaaggtgacggaaatcacgcttaacaactttgacaaggtcctggagcatgatggaaagctgaccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaaca

SEQ ID NO: 225024 - DNA, 433 bp, Homo sapiens
agtcccatgccctctctgggcttcagcctcaccgctagggtagagaggttgggtgagagaacgacctccttcccaggtctgagctggatggttcaccagggaccccaggctccctggagcagactctgtgcccgctgctgagtctggaattcctttcctgtatcttgcctttggctgccccattcttcatggcccagcaccctgtcttctggtcagaacctagttctgaatgggtttttccagaagttgttgctttcaggggcccctggcagagaggtgtttctggctggctttgtctctctggcatgacaaaggctctgttcctgctggaggcatttcagggctcagtgggcagctggggcagagcccgtgagaccacagccttcctggtgagcccggtctccgccccctaccccatctctggggaaggcgc

SEQ ID NO: 225025 - DNA, 834 bp, Homo sapiens
tgaagtaatagtgccacctagagaacaaaatcaccagctttactagccaaatggcttatttccatatgaaccatttttccaacgctacagttactaggatttccttgttaccatattcagatcttgtgagtgtgtatgggggtgggggttgcatgtggaattacagatgaaattttaaaacaagcagatccacaatttgatatatgcactaaatccttttaacgttgtaatgtagccaaatgtagaatagcatgccaggaatcaacggctagcatcctttttaacatttattattttcatggatatgtaccaaaccgaaccattgagtataaaggttctgattttatttatttgctacaggcaattcattatactttctgagatacaataacaccaaataatttgagtagagagacctttaagaatgttttcgatttatgatctacctttaactttaatgtactcagaagatgtgagaataaaataaagtcaaatataagcaagattttaaacacacacacaaaaaacaaacaaacaagaaaaaggaagaaaattataaggattgccttaaccttagaatagatgaaggtatacatctgagccagcaccaaaaaaaaaaaaaaaaaaagttatggaaccaggaaccaataattacaaattgacttaaaattcttggatgacaaaaatctatatttagttcatttttgcatgcgcccacaacagcatccaaaacagttctggggaggcactttgataaatgttgctgaatgcactaatagattgattaatggctgcttcagattatcactagtgatgtagacagaaacttcatga

SEQ ID NO: 225026 - DNA, 519 bp, Homo sapiens
tgaagtaatagtgccacctagagaacaaaatcaccagctttactagccaaatggcttatttccatatgaaccatttttccaacgctacagttactaggatttccttgttaccatattcagatcttgtgagtgtgtatgggggtgggggttgcatgtggaattacagatgaaattttaaaacaagcagatccacaatttgatatatgcactaaatccttttaacgttgtaatgtagccaaatgtagaatagcatgccaggaatcaacggctagcatcctttttaacatttattattttcatggatatgtaccaaaccgaaccattgagtataaaggttctgattttatttatttgctacaggcaattcattatactttctgagatacaataacaccaaataatttgagtagagagacctttaagaatgttttcgatttatgatctacctttaactttaatgtactcagaagatgtgagaataaaataaagtcaaatataagcaagattttaaacacacac

SEQ ID NO: 225027 - DNA, 458 bp, Homo sapiens
ctaagcaggaacatggtgtattctgtgccctctaagtctttctttacagttctaattcaggatgctaattgcctgcattccatctgagtcaatctgtatacggtgtactaatgatcagcatttcttcaacttttccctttttttatagtggtgttaaatgttcatataaaaattagaaaatataggccaggcctggtggctcgcgcctggaatcccaattgctggtattacaaatgtgagccaccgcgcccggcccctttaatgatttttaatagtttagtgtttcttcagtgtttcaacaactatttctccatagagcttaaacacagtgctttggacacatttaataaacgctcaatgaatgtttggtgaatcggaatcttataaatatttgttttaacatgaagaccatttaaaataaaaatgtattgtcaacttctaaatggaaataacagtaa

SEQ ID NO: 225028 - DNA, 781 bp, Homo sapiens
ggctaacctttcctccttctggtattgctcaggatgctgaccacagcaccctgcacagagaagaggtttaatatttattttattacttaaattgcataagagggatctacctacttgtgaaaaaggttgctgtgacctgtgttccttcttctgtgacaagaaactaaaatgtacatatattctcttcttgatgttctttcgagttttatctccttcctagatctggttcaccagatttcctcccctccttttttttcatcaatacaaaacttcaagtcgcagtcttgccaataattcttctttgactaatttatgagttaaataaagaaaaaattcctcacacacatatcatgtccaaggtcagctcaacattgctttattccacacctctcaatgggtgtatgatgcgggcccactttaacactgtatcagtggttgattcctacgtgcagatctttctgctctttttgcctgaattatcttcaatgttctttgtgcaaaaatcacagccagtatagtctatttccaaaagagctgtaaagaggcatttcagaaacttccctaaacaatatttctttaaaatgcaccaagctggataaagccgctttgtgacctgcataaaaactccaacggataaatgtgtattaccttcccaaagaactacttctccaaagttattccagctctttccagttgaaatgtcaaacttgacataaaaatgagatgttcttgcatcaattaataaacaaataaatctgtgtttcccattgcccttttcatt

SEQ ID NO: 225029 - DNA, 301 bp, Homo sapiens
aaaaattgtgtaaaaattgataatctttttgcactgtactcaagctgtataggataaaaactagttacatgtgaatttaatttaccaattctagcccatccagaggttaaacccatggcccccagcatgaattaacattttaatcataaactatctgtgtggccagtgccatgggtaaacaagaggaattttttttttttttaaatacaaggtctcactctgttgcccaggctagaggttgcagtgagctgagattgcaccactgcactccagccttggcgacagagtgagaatccatctc

SEQ ID NO: 225030 - DNA, 667 bp, Homo sapiens
ccatttagagcatggggggttttcaccagggatgaaatttggtccagcttttaaaaacaggacaaccataattacaatacactgaaattactctttatgtcttccttttcctgccgatgctcaactctgcctgccgaccctccacaccactatacctggtgcgtgttatatgagcagaagagaagagaatatgaagcactttcctatgggacacaggagctctggggtctagtcctgattctactcagatgagtgggcgacttcaggacaggttgaatagaagctacagggtgcaggtattagaaccaaacctcacttcagtcccagccttgtcactttactagacttttaaccctgaaaaagccacccagagtccaccagcttccggggctttatcgctatgatgaaaatgttaatgttaatctggacatgttgtgctattataagtgttattcataaagcccttagcaaatcattactacatattttgacaaaaaggctaccatctactatttttcctcatctctggtttttggttccatcagcaaaaaatggtgggattagaaatagatgatctcagaggtcttctctggatttaggatgacaagatttcccgggcgcagtggctcacacctgtaatcccaactttgggaggctgaggggagca

SEQ ID NO: 225031 - DNA, 1393 bp, Homo sapiens
ttttaactctgcattactaaacaaatataaaagaaattcatctccatttaaaaatcttttttgttatttatattttgttttatttttgtttcctattctttatgcagttacctgatactatggacagtatatccagtggatcttttagtactgtaatatcaaaatgctacaaatatttatgtttcctgctatgttcaagatattgtagtggcaccaacttcttgggcatcagctaatattgcattttggagtcattagggtgttctgtgaagaatgaatactgaagtgacagttttatctagttttttgaggggcatttatgatggggttgggttgccattgtgtctgacagtgcaattcatgtagttcctggcataattgccttttttttttccttaatggagaggcagggttctgattggtgctgtataaatttaagtaactttgtgctttgtaggaatggtgacaaggaaggcatgatttccccctgacaaggaatgaaaggtgaactgtatcagctcttatctggacatatatgttaatgttttctatgctccctgatacaagaagtttccaagttatataggaaaattaagtccattgatcctgtctttatcctcagaggacagaaatgagacaagtggataaaggctgtaggaagctgaattccagattaatcagtgccaaggaagatttttcattatcggaaaacccaacagtctaaaatcaataaccagttcttctgcaaaggggtgagtttaagcagggctaatgtgactgtcatttctgcctgtcctgcaagcttagactagttgaactttgaggtcactctatgattcttttattagggcttcaaatcagcagggagtgtgtcaagaaaaaatgctcccccccaccatttcaaataaaagtgaatgttttctctttcaaagctactattagaggtagttgtgatagacactaacaatccccggtgttaatactttccactccttttattttattttaatttaatattattttattgagacagagtctcgctctgtcacccaggctggagtgcagtggcgtaatctctgctcactgcaagctcctcctcccaggttcacgccattctcctgcctcagcctcccgagtagctgggactacaggcgcccgccaccacgcctggctaattttttgtattttgagtagagacggggtttcaccgtgttagccaggatggtctcgatctcctgaactcgtgatccactcctttttaaagtgagtctagtctgttgatcttcataaataggagggttttcctccagcttggacattaaaaataatttttaaaaagatctttgtggctaactggaaaatcttctggaattatctaatgcttcattcattt

SEQ ID NO: 225032 - DNA, 370 bp, Homo sapiens
tatgatgtgatggagaatgcccacaagagctcttgttttaaatggtagagtgaacatacactggaattctatcctgcttgacccaagctcttgatagcgaaaggtagaaaagatagatggtaaacagatagatagatgatagataaagaaaatacatagctgttccagaaaacagaaatggataacttcatgaaccaaaagcagagtaatatactttagaaaggaagcaggccagaaaacccacagttgcaaagcaaatagaatttccaactgcctcttgtagccccttcctggaagtagtcacagcccagggtgtttgacttcttcctctgttttttgtttgtttgttgtttgcttttctctggggttt

SEQ ID NO: 225033 - DNA, 435 bp, Homo sapiens
acttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctcccaaagtgctgggattacaggcatgagccactatgcccaaccactggctatgggattctaagaaagtataatttctgtgagcctcaatttcctgacctataaaatgtgattaatattatcacctattacggagtgtagtaggggttaaatgaaataatgctatttaaagtacttggttcagtgcctatcaagcaccagttaagtgcttgatagacgttagctattattagatgtcttggaatgcttggagtgtaagggaggg

SEQ ID NO: 225034 - DNA, 583 bp, Homo sapiens
gctctgggattacagagctgggtgcgtgccactgtatccagccctctatgactttaattctcatatggtaatctttcagctcctgctccactgctaagtgatactgtgaattctccattcaaattcctaagtcaaagtgctcaaccgaatacattttggctgcttgtttgtggggtgagggtgccgtccatgtagtttgtatatacagaactgccatttggcagtgactgtgagttgggcagcttcatgtagtagaaggctgtaggttagcaagtacacgattgacgtttccaataagattggcctgatcatccacttcttaacgttgcttattctggtttcactctttgattctaagtttaatttatcgtgaaattgtctgagctcaccacttttgcccaaagtctgtaacagttctaatcttttatatcatgtgaaactgaaattgttgcatggtacagagatgttctgtatttattgattagttattatttgagattactataaaatatatgttaatactttgacatgttgaaatgtatgaaagatagacaaggaataaagaaaagttgaaccagaattt

SEQ ID NO: 225035 - DNA, 486 bp, Homo sapiens
ctctcagttaccggcagaatcacactcaaaacacggttcgtttattgcattcagctgacatgcttctcatgtctctctccacattcaaactctcccttgacgttctgtttttcctgaattcacgtgataaaataatggatctgtttgttgggagtttcccatattctggatcttgccagctccatctctgtggtgccattgaacacgtcccctgggttctctagatctgctataatcaggcaattggatctaaggcattggttaggttcagagttggatttttggcaagattgcaccattgatggcttcatgtatatgcacacagaatgcctggtgaggcccagagcattggtgttaggatgcttcagtgttcagggaatataggctgacttgcaaaggtccccatcagcttcccacctaatacttttagcagccattaacaatcatttcccagatcctttacatctttgagtgtgattctggccg

SEQ ID NO: 225036 - DNA, 387 bp, Homo sapiens
caatgatggaagcctgcaggagccaagagtgtaagaaatggaaaccgctttctctattttctctggagctatagattcagacggttatcttaacagtctgcaacaatatactgagagaagcactaacgaaactgcatttctctgtcatgctgtgccagctgtagtatgtgggaaaccttgtctctcccaagtaccttctgtctctggcagctccatgtaaacttcaggaatggtcagtgctgagcttttagttgctgtatccaccatctccacagaccaagacccagtgacttgcatttcttgcctccatgtccatggcttattttctccctactcagttatgttatcctacttcattcaccgatgttgtagacactgttctgaata

SEQ ID NO: 225037 - DNA, 419 bp, Homo sapiens
atgcaatgttgaggtttccccaccaggacaagcttgattgctgataacttcacagtgaaaaccaggttcctattaatggtctttgtgagtatgcaaaacactgcttaaaggattgtgacagagacttctccttgaccaaacttgagttggactcttctgggccctcttcttgacttggcttcagtattagtccccatccttgccaggcctgcacagcccagtgttagcaagaatcctgctaagtcagtttagaaagaatcctcccacccctgatacttgatcccattactatctaatcaaattcttcatcccccaggtgacatctgatcaagagttatctgccttcagcaggaatcctgttagtttagcatgaatcacccaacccttgatgtctcctcttagtaatcttccatctacag

SEQ ID NO: 225038 - DNA, 217 bp, Homo sapiens
gcagggatccaacttcattctttttgcatgtggatatctgcttgttccagaacaatttgttaaaaagaatattctttccctcattgaattattttgacatccatgttgaaaatcagttgactaagggactttatttctttatttgtttatttttgagacaaaatctcactctgtctccaggctggagtgcagtggtgcaatctcggctcactgcaac

SEQ ID NO: 225039 - DNA, 269 bp, Homo sapiens
cagattttatacatgaagatgctgaggctcagagaggttgaaagtctccaaaagctgcggagtaagagtggtagccgactcttactttaagagtaaaagcacaagtttgaatctgtatctccgtggtacacttaaatagaactctaatagcacttcacttctaaatgtcaggaatataatccactgcttgaatctatattgagtaatgtaacccctttgttatgagtagcaccacaaaaaaaccctactattaaacatatacgaaatcc

SEQ ID NO: 225040 - DNA, 351 bp, Homo sapiens
tgagacggagtctggttctgttgcccaggctggagtgcagtggcgcgatctcggctcactgcaagctccgcctcccaggttcacgccattctcctgcctcagcctcctgagtagctgggactacaggtgcccgccaccacacccagctaattttttgtatttttaatagagacagggtttcaccgtgttagccaggatggtctcgatctcctgacctggtgatccgcctgcctcggccttccggagtgctgggattacaggcatgagccaccgcgcccggcctcattccattcttataagagctttattaaattataaaagcaatacatattctatacgatttggaagttg

SEQ ID NO: 225041 - DNA, 590 bp, Homo sapiens
gggtgtctgtcatcttaatgacatactgtgtgagggttctttgtctgcaggcatagggtgcctttgtggctccccggggcatttaagacacaatggagaaggaaccttttccgtgattgtggcgcattgaacccgtggctatttacctgtgatgttcgttttcatattcctggtagcagaatcttctgtttactgcagcagcttacaaaagtgggatgtgaggttagattaattcatggactcaaaatcggcacatagtattgttgagaaaggagctgggaggcaaacctccctttgtgaatgtcaacttggcatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctattattgttggacatttgggttggttccaagtctttgctattgtgaataatgccgcaataaacacatgtgtgcatgtgtcttta

SEQ ID NO: 225042 - DNA, 416 bp, Homo sapiens
agttttcaaaaagttcaagtactactaagtcagcagagttcgagagctctgtcgggttttcttgattgtgaattggcacagtgattatccactgaggatgaccaatttgcctgctatttaaaaaaaataatctctgagcattcaaaatctactgcaactctctgttctgggaagaatgtgacgttggcatagagggagtatgccagtgaaggcttgtaagtaggttctaaaagtgctaagggcacaagttaatttgactttaaaagcaccttaacattttattactgaaagctttatattctcttgcctgttcaaggaattgtacggaccagcccaagaattgcctattactgccagttaaaatgtgagccctggggtcagtgtaatttctggaaataaagtaagtttgagaaaga

SEQ ID NO: 225043 - DNA, 192 bp, Homo sapiens
cctatcaataattatattaaatgtaaatgaattaaactccccagtcaaaaggcatagagtggttgaatggacttaaaaaacaagatccagtggtacggtgtctgcaagagattcacataagctgggcatggagcatggggaagtcaaggctgcagtgagtcatgatcacaccactgcactccaacctgggtg

SEQ ID NO: 225044 - DNA, 391 bp, Homo sapiens
aggaaagatgaagacaatgaaacatgcatgaattacccattcaaaacataaatagctggaaataaaaacaaaagcaaaatggaagggaagataaacacaaattcatgacaggaattttctcaaaattgcaaaatggggacttctcaggctggaggaataagggaacatcaactttatctgtaacactttacatattttgattagaaaataagacaagaagaacaatcatcacctctgagtgataggtacatttatatataaaaatttataaatttataaatctattaatatgtataaatatttgaatcttatataaatgtgtatatatcttatataacaatagtatatattaacaatataaatacatataataaagcataaatacatacta

SEQ ID NO: 225045 - DNA, 420 bp, Homo sapiens
ccgtgtaggtaagcctacggttatgtaaaccacctgaactgagtcacttccaatccttggctcagcatcagtatctatttcatgatggaattcagtgatctcagtttcctctgtttctaatagtgaatgatttaactccgtctgtatttaacaaaatactttcagtgacaagtatcacaatgtattgtgtaacatgttagggctctggcatcagttttcctggacgaaatcatgactctgccatttattagttgtacagccttgactcagtttgttcatttgtaaaatggagtaataacgataacatattaagggctgtcataaggattaagtcataaaaaagtaaaattcttaggacaatgcttggagcatagcgtgtactcaataaatgctggctggttgctcttattgccaccttta

SEQ ID NO: 225046 - DNA, 450 bp, Homo sapiens
gaaccccatctctactaaaaatacaacaattatctgggtgtgatggcacatgcttgtaatcccagctactcaggaggctgaggtgcgaattgcttgaacctggaaggtggaggttgcagtgagccaagatcacgccattgcactccagcctggtgtggagtgagactctgtctaaaaaaaaaaaaagaagaatttataatgaacacatccattatatgcaaatagccacttcctaaaggggctcatgatatgatttctgctttcacaactgtggaaattggagtgtctatctgtagctacgttcaccgcccccccccaaaaaaattatgtcttttctttttgagaaataatgacattgtaaatatttgcatgactaaataaaggtggcagacggtaggtaacaaaagataggtgattcaaaaatgagaaaataaaagattgtttacatta

SEQ ID NO: 225047 - DNA, 543 bp, Homo sapiens
aacagagaaaccttaatcccaaagatttccttaactgttgtggccctactgcagcatagggctccccacttcattcactgtctctcctgcttcaagatgtttcttccctgtggatgaagaaccaggagatcacacacagaaatgggaaaatatctgggtaaaaacattcaaagaatagcacaaaatggtttgggacttccaaataagactctcaggaaagcaggctacagctctacctcaaaacccgccacctcctataacgaaggactggttttccaatggcctatatacacattttgctgcactctacaaacagaaagcaataggcttgaatttcaccatgatatgtggtacacctaccttattattcacttatctttcaaccttccattactttttgattagtaacaaaattaagactcatttctcaaaaatatcagaaaaccaaccgtttcattcttactcgagttcttccagcatgttcattttgaactgtttacctcccatgaaataaaaagtctcttgactctgagaacttttcaa

SEQ ID NO: 225048 - DNA, 278 bp, Homo sapiens
ggtccctgggaggatataagttccagctctttttcgtataatgatgaaagtaacataaaagattctaggatggcaggtacaaagaacatgttaagaacagcccttgaaaatatatatcatcattgcagacatcttcttggggtcaactcataatgttcccaaataaataactgtccatccatgaggactttgtttgaatatgttattgatactttgttttgtttttggttttttaccctaattcttggagagaggactttatgactaaaaacacacca

SEQ ID NO: 225049 - DNA, 345 bp, Homo sapiens
agaattgcttgaacctgggaggcggaggttacagtgagccaagatcacaccactgcactccagcctgggcaacacagcaatattccatctcaaaaaaaaaaaaaaaaggaaaactcatctagtatcctgtgacatcgaaattattatacagcagtaattgctgcttacagagatgggggtaagactaagatcctagtgttccacaaatcattaagaaaagatcaaattgtgatttgtcttgctttagtgttgtatacagttttgtcaaattctttgacagtagttatccttgtatagtatgtcattgtagttcagtggattgaaattaaatgatctattcatcta

SEQ ID NO: 225050 - DNA, 347 bp, Homo sapiens
gaatgctaggattataggcgtgagccaccacacccggtctcaagtcaatatctttaaaaagcaacttgagagaggcaaatatttcttcatctgtcacctttatttgtaaaagcagaaaactctctaagtcagtagactacaatctaatgattagaatatcgaaacctgtctaatagaggcaaagagggtatccattttcagtgggctccagcatgaagcaaattagtcatcagctccctaaaatatgcaatataaactgtaatcatgtgcctaatgctttttctttttctttttttgagacggagtctcactctgtcacccaggtgcaatcttggctcactgcaacc

SEQ ID NO: 225051 - DNA, 470 bp, Homo sapiens
gacgtgattcaaaaaaaggggaagagagattgccccaaagagggccctagatgctcccagacaatagccctgtagactatgcacctcatggcttcctatcacctcctctgcctccagacagggcccatggtaacacctaaagcagggtctccaccatccccacaccctaatctttgcagccagctctgctccctgagcaacggggaataaatacacagccttcaagggttagaattctcttggattcttgctggcacccagtttccatggcaacctgaaactctccttcgccatcttcaggaatgtcattaggctgcgagggggaggctgcaaacaaagccacgatgtgtcaggctgcagcagatgctgaggagggcagcactggggggcagaagcccttttcgtggcaggtatttttttttttctttaaaataaaatacataaaccattccattacatcaaaccaaaaa

SEQ ID NO: 225052 - DNA, 772 bp, Homo sapiens
caggccagtgcttttcctgcagagtcactctttcctgaactgaagctgtcacaaggagtgttcagtgtgttctcgtgactgaaggcagctgattcaactcccaacatgcctgtgctctcattttaccctgtggcgtccacttgaatatcttgacacagtcagagctctgttacagcactttatgcatggtcacgtggtactcacaacatgcccaagtaactgagagcgaaaagcaccagggtatgcctgacacattggaagaacccactgcccagcttggcagggcgcctcagagtgtcttccaaataccacctgcagcagaatcacctgagatgcacgttaaggtgcagatcataggactccacccctggcctacccaatcagcctcttaggtggcagcacctagaaatctgcattttaacaagttccatggatgacttgtgtccacccaactgtgagaactgctctccactgaggtttcaaagggatacataatacccaaagcaggtatgtagtccttcttggctggatgtgggaacttattttgcatcattcttcttcattccacctgctggcacaattgtgagaaggataaatattctcagatcttagggatgcattgttttaatgaagattgccccattgtgcaggatctggattttatgcaaaaaaattaaaaaaaaaaaaagaagatggccccattcccctacctccatcccacctatttaaacaaacagcaatgggggcagggacttttcatgagaggaatgac

SEQ ID NO: 225053 - DNA, 428 bp, Homo sapiens
gattcaaatggcagaattgatgggccctgtttccttcctagtcctttcatttcctttaaacacaggtttggttttgtttaatggcattgttcaatagcccaagaggcccatgaatgcttctcttagggtgatgaatacatcggctaagaagtcatgaattgcaaaggtcagagttttcctattcaaaataattattaattgaatccagtgacctagggctgacctgcaacaaaattacagagctggtgaaatttgtctttgagattcctatccaggcgttctttttcagatttcttttttcttctttgataaaagaatgcctacgtattaactacctgttttgtgccataccttgtccaaatcctgtactagagttgatcttatttactgaatgctgaaatgtaccttatttgctgtagtcaccaccc

SEQ ID NO: 225054 - DNA, 394 bp, Homo sapiens
atgggagatcatcagggaaaataactaatgggtgctaggctcaatacgtggatgatgaaataatctgtaccacaaacccccatgacaaaagtttacctatgtaacaaacctgcacttgtacccccgaacctaaaataaaagtttaaaaaggaagtgaaaaaaactttaaagtagctcaataagttttatattaatgtcaactttaaataatttttatgcataatacgttattaaaattcatttacctttttaaaaaaagaatgtgaaattttagcagagttttcaacaacaatgttgtagttaacaagagaaaagcatccctgatgctttacaaactggtgtttcaatgaattagtcttttttttctgagagggaatctcgctctgtcgcccag

SEQ ID NO: 225055 - DNA, 232 bp, Homo sapiens
taaaatcacccgtaagtcactcagaagaatctgagaattttttaattacttggctttcttttcttaatctatatttaaaataattctataatatgatatggagacattctactgtcatttaaattcaccgcttttgaggtgttttatactaatctttgtcatcttgacactcttattcaactctgtattcttacttctttcccctcctcacctttgtatttgtggagctgtt

SEQ ID NO: 225056 - DNA, 502 bp, Homo sapiens
tgacccacctttgtgctgtctgttgtccagtctgctctcctgatccctaaagatgtttcttatctaggctgccatttatgtgggtaaaagacaaggtagaaaatactcttctgtatcttgtatcaagggttaatctaatgtcttcatcactttgttttgagatattttggaatgttatcaacaattattatagatggagcatgtatgtcttaggtttggtgttaactgtttaacatgcattatcttattcaatcctcacagcagttataaaatgtaggtgttttagaggtaagcatattataggtcaggagagttcaaagagttaaactaccaaaaggggatctgaacccaatttctgaatctagtgttaatgatcttactatcccaaactcctactcctgaacattcttaatcaatgatcaacagcttatcacttggcagctttgagctcaaccctggtaaccaagtcatactatactgaacataatgaagcaatagaagc

SEQ ID NO: 225057 - DNA, 1545 bp, Homo sapiens
  misc_feature (892)..(892): n is a, c, g, or t
  misc_feature (916)..(916): n is a, c, g, or t
gttttagcatactccctggcagagagaagtcagtcaataaatgtttgctaaataaagaatgatgtgatgtattaatggtattaatattaaagaaggtatatatcatcatacacatatgctcataaaataatgactcaaacttccaattctgtatgcagaagctaatcacctccattgttttttacttaaaaaagggagacatttttagtcttcacaataatcatgtatagattggggatgaaataatttaagtttcctactatatataaagccactgagcagtaacttttttatttcataaaaatcataatttttttaatcattaagtatccctttgtatccaccaccttttagaaagtctatttacctacacacctatcctctgagaattgtatgtcctgtatcattccccttccataaaaattgggcctgaaagccatgttttatgaacctttggcttcatcggccacagttgattagaccagaaagagatacctgcctcagactcaattttctcccagaggttcagaatgaaatcacagaaccatgagcgaatatatgaatttaagagttagaagacatgtccatccacgtgcagtggtgaaagacaacatgcaaagtaagaaaaatgaagtggaaaagcaggaagactcagagaaatcatgctaccccagggtagtaagaaaatagctgcatggggctgggcacggtggcctgtaatcccagcaagttggaaggacgaggcaggaggatcacttgaggccaggagttcgaggccagcctggacaacacggtgaaaccccatctctactaaaaatacaaaaatgagccagccatggtggcatgtgcctgtaatcccagctactcaggaggctgaggcaggagaatcacntgaacccgggaagcggaggatgcngtgagctgagatagcaccactgcactccagcctgggcgacagagtaagacgctgtctcaaaataaagaaagaaaaaaagaaaatagctgcctgggttataaatttccagttcctggtttcccttccccttcatgagtcttggctgtacttctatcatcgggtactgtgaaaactccagcatctttgcctaatgggaactaatttccctttttgggtaagccagcttacattttttaaattgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 225058 - DNA, 646 bp, Homo sapiens
gctctgtcgagggacaggagttgcaattaggaatatacagggaattctgtggtgctgagaggatttgttgatctgggtgatggttacccaggtgtttattcactttgcaaatgattaagttgtatatatgttttacttaagtgttatatttcatagttttaaaaggtttaaaaaatatagagaatacagcctgggcatggtggctaacacctgtaatcccagcactttggaaggccaagacaggaggatcgagttcaggagttcaagacccgcctgagcaacatggcaaaacctcatctctgcaaaaatttttttaaaaatttagccaggcatggtggcatgtgctttgtatagtcccagccacttgggaggctgaggtgggaggatgacttgagcccgggaggcagaggttgcagtgatcccagatgatgccactgcactccagcctggttgacagagcgagaccctgtctcatacaacaaccaaaaaaaaaaaaaaaaaacaaaaacagaatacaaataaaaacagaactaccttctaaataagattgggcttaattttgcttttcttacaaactaatccagcagcagcagttaataacccattagatacgaagatttgattaaactatttttccacaagaaag

SEQ ID NO: 225059 - DNA, 381 bp, Homo sapiens
acctgggttcagaatatgctgggtcagtaatttgctggctgtgtggttgtagtctctccagatggagtgccaaggctgcaaaggctgcgccgccccatcccgggggtcaggcaggctcacagatggacctttggaagtaatccagatgcagagcaacactgagcccatccatccagagccaagtgtcagtgtctgaatcaatgttcagcaagagctctttaataagcttaatatctagagtcctgtacttcctggctgaaggagctctggcaagttacttaccctccctgattctcattttcctcatctgtgaaatgggaataatcccaaaagctacctcacatgtgtgtgatgattaaatgagttttaccacgtgtaaaa

SEQ ID NO: 225060 - DNA, 795 bp, Homo sapiens
ccccatttgccaccccatctccaggaatgtccctagtttctggagtggggctccagaacagattggggctgtcggtgtgacagctactgcttcccctgacgaatggctgtgaaatgccagagttgatggctacacagccaccctttttaccttcagggaaacctctgcttttctatcttttgtggttctctttccactcagaatttttgcttcttgtcttactagatgcactcacttacttgctttgtcaaaatgaaatggacgatgctcggtcagctagtaaacttagtacagacagcccctgacttacaatgattctacttagaattttttgactttacaatggtgtaaaaccatcgcaatttcaacataaattacagtattcaataaattatatgagacactcaacaccttattataaaacaggctttgcataggctaatataaatgttctgagaatgcttaagataggctaggctgagccatgatgtttggtaggttagatgtataaatgcatcttttacagtgggtttatcagaatgtaaccccatcataagttgagaatctatagtgtaaatcgcaagtattcagagaagggctcttttttaagctcaaatgtgggccgtgaggttcgtgctccagttcaggagaattacatgagttttaatgtcattatgggcaataatttgtttgctggctttcctctgtgtttcctgagtgtgaaccggaaatgggagtgagcacaggagaaattgggaggggaagggtgattagactctgggggaaatcagggca

SEQ ID NO: 225061 - DNA, 1235 bp, Homo sapiens
agggtattgagtctttggttggttttgaatattcccaaggattattttttgacatctcgttcccatacatgaacagtagttacttatgggaagtggcctaattttcttaaataataatctaccataacacacacacacacacacacacacacacagaaaaaaatcattactttattgttaaaaatgtgtcagttgtaaagatacctgtcctttgaatcagcatgttgggaggtgcaggagattcctgcctttgaacacctgcctaaagattccataacaaggggatttggtatgatgagatatatgcaaaaggtttggattctggaaaaatatatacaagtctttttccagggggggaaaatacacacacacacacacacacacacccctaaggagtccagtgtaattttgtttctcaaattcctgtttctcaaatacaaagttttaggagaataagacaatttaggaaaatcaacacattattcatgtcccgtaaaacaccaagattgtttttctattttcctgagttatatcaatagaaaaaacataaaatgataattagtctccctgtcacttcatcagagttttatagattagtaattttcatgtatagcacatttatgatataacttatacccttatttattggagatgattttattagatgatacctgcagactatggggaaacatttaaatatcaagctttgccatagcccttttcctctatgcacttatttattcctaaaggttttctttactattaagttaaggtaatggaactctccataggtgcttaatttggccctgatttttggaaggtaacttcaatgagaagtacttcacgaaatttttcgactttacactcgcccatagtacaactgccatcttcttcccatgagtcacattttgaaccattctcttattcggccacttgcttaccttctggtgacacgccattactggcccgcttgtatatcttcccaacactctctctctgcaacattctcacatgccaccatctcacgcctctcttcactcctcatctccacctctctatctgtctctcaataccgtaacgttcttctaaacgggtctctctcattccttcggtgtcatttcctcaataacatctcgttccgatgtcactcgcctacaggcattctcgacactctccctctctcttaccctcttctcagacttcctgttgctcccgctactcgctcgtctacgccc

SEQ ID NO: 225062 - DNA, 433 bp, Homo sapiens
aagctttttactgagactgggcagggtggctcatgcctgtaatcccagtactttggaagaccaaggtgagattattgcttgagcccagaagtttgagaccagcttgggcaacatagtgagaccttgtcgctacaaaaaattaacaattagccaggcgtggtgatgtatgcctgtagtcccacttactcaggaggctgaggcaggaggatcactggagcctaggaagttgaagctgcagtgagccatgatcaccactgcactccagcctgggtcacagagcaagaccctgtctcaaaaaacacacacacagaaaactttgttattgacactggattctcctagattttgctttattttacatcctcattccagaggccagaaaagactacttattctcagatgtgtaaatatagataagtccttctgtttcttc

SEQ ID NO: 225063 - DNA, 1391 bp, Homo sapiens
aagctttttactgagactgggcagggtggctcatgcctgtaatcccagtactttggaagaccaaggtgagattattgcttgagcccagaagtttgagaccagcttgggcaacatagtgagaccttgtcgctacaaaaaattaacaattagccaggcgtggtgatgtatgcctgtagtcccacttactcaggaggctgaggcaggaggatcactggagcctaggaagttgaagctgcagtgagccatgatcaccactgcactccagcctgggtcacagagcaagaccctgtctcaaaaaacacacacacacagaaaaaaatcattactttattgttaaaaatgtgtcagttgtaaagatacctgtcctttgaatcagcatgttgggaggtgcaggagattcctgcctttgaacacctgcctaaagattccataacaaggggatttggtatgatgagatatatgcaaaaggtttggattctggaaaaatatatacaagtctttttccagggggggaaaatacacacacacacacacacacacacccctaaggagtccagtgtaattttgtttctcaaattcctgtttctcaaatacaaagttttaggagaataagacaatttaggaaaatcaacacattattcatgtcccgtaaaacaccaagattgtttttctattttcctgagttatatcaatagaaaaaacataaaatgataattagtctccctgtcacttcatcagagttttatagattagtaattttcatgtatagcacatttatgatataacttatacccttatttattggagatgattttattagatgatacctgcagactatggggaaacatttaaatatcaagctttgccatagcccttttcctctatgcacttatttattcctaaaggttttctttactattaagttaaggtaatggaactctccataggtgcttaatttggccctgatttttggaaggtaacttcaatgagaagtacttcacgaaatttttcgactttacactcgcccatagtacaactgccatcttcttcccatgagtcacattttgaaccattctcttattcggccacttgcttaccttctggtgacacgccattactggcccgcttgtatatcttcccaacactctctctctgcaacattctcacatgccaccatctcacgcctctcttcactcctcatctccacctctctatctgtctctcaataccgtaacgttcttctaaacgggtctctctcattccttcggtgtcatttcctcaataacatctcgttccgatgtcactcgcctacaggcattctcgacactctccctctctcttaccctcttctcagacttcctgttgctcccgctactcgctcgtctacgccc

SEQ ID NO: 225064 - DNA, 644 bp, Homo sapiens
aaaaaatgatgctggcagggtcaaaaatagactagcagagggagacgggatctcaaaaccaccatgctggagtctgaaccaattgttctgtccactttgctaataatcacagcccattcctagcccaataacaaactgaaagttaacaaagctgcagctctggggattctaatgtgacagggacaggcttttgaaatagccacatcattaaatggaatttgtttcaaatcacctttaaaacctccaaacacaggcctgtacacttgcaattcccaaaactgaatcctaagaaccagcatgcccaggctgccccaggagaatgagggggaaagcatcaagacagagaactgtatgtgttagaacccgggggaccactggggtcattaattatatcgactggtggctgtgatctctaggttggaggttgttacagtgtggggaggatccacatcctgaaaagcctggaaagagcctgggattcagacacaggacatggtgaagccgggagagtctgagcaacagccaagggatacaccaggcccactctggccacctgctaatcctaaagtggcttatcaagcagcgtcagcaaacacacccctgacactggcagcgaatcacacgtgtaggccacatccactgcc

SEQ ID NO: 225065 - DNA, 465 bp, Homo sapiens
atagtagctccattaatttttttcatgaatccctcatgtaattgactctaggaaagatgttagggtggtaaattttcttattctgtaaatatttgaaattcaggaaaaccctcccatcaataaattaaatgaagcattgaagtaaaaaagaatattcttaacaaagcttatattgaaaatcaggtttccacagcatatagatctaagaaacctgggggtacccttgtctgtttctcctattctcctctttcaaaaccatttcctttcccaggctggataattacaataaaaaatagagtatgtgttccaaattattgaatgcttcttccttgtgtatggaaaatctgggatgacaaccagtggtctgccattttgtgtacgagaaaaagaggtatgtatgtgtgggagtcggaaggaatcttggtatactattataactaacctctctcttccctattaccttca

SEQ ID NO: 225066 - DNA, 423 bp, Homo sapiens
ttaaaaaatccaacagttaaatatggttgtggttctccaactccatatatattggtaaaatggtcattgaattagacacaaagacatgctctttttcccccaaaaagtatgcatgtaaaacttggtgaaattgtctagttagttgtgttatactagtgtcagtttcctagctttaataatgcattatagttatgtaaatgggagaagctgggtggtgggtacccaggacttctctctactgtttttttcaattactgacgagtctataattaattcagaatgaaaagtcttttaaaaatccttcaattgggatgaatactccattctccatgatgtgattattatgtattgcatgcctataccaaaacatctcatgtaccccataaatatatacacttactatgtaccctcaaaaaataaaaa

SEQ ID NO: 225067 - DNA, 173 bp, Homo sapiens
cagggaacgcagctgtgaggtggtccataccgatcctaaaacctgccaatcatgttcctggctgcagcatgggggtgggagggtgtggtctcctggactcttccacgttgggatgatccaggatttgggatcaagaaacttcatttgtgagtcatttgagggaaaagacccta

SEQ ID NO: 225068 - DNA, 764 bp, Homo sapiens
gccgcagtcgactctggagatcccccctacaacttcctgtacccatatccatagtacgcaatgatctagaacttgcacactagtctctcaaaatgtgtatttttaaaattatttatatttttagtttcgtctgtctgcattctccgctacaaaataggcagcagaggtaggtttgtgttttggtttagattgttgatccagatgctggctggctccgttacttagtagctgttaggcaagttactacatttctcacaacttcagtttcctgacctgcaaattacgataataatattctccttcacagaatgattacgagagtaaatgagatgatgtgtaccaaatgcacagttcaatatctgatacattgttaagcagttgataaatattaacaataaaaggaagtggttatgttgtggaaatagaaaccagtatttaatgagtacttactagtagtatgcatattaagaatatatatctcggccgggcgtggtggctcacacctgtaatcccagcagtttgggaggccgaggcgtgcggatcacctgaggtcgggagtttgagaccagtctggccaacatggcgaaaccccgtctctactaaaaatacaaaaattagctgggcgtggtggcaagcgcctgtaatcccagctacttgggaggctgaggtgggagaatcgcttgtacctggaaggtggtggttgcagtgagctgagatcgtgccactgcactccatcctgggtgacagagtaaaaatctgcctca

SEQ ID NO: 225069 - DNA, 252 bp, Homo sapiens
cttcctcatctcctagaattgttggagtctttaagaggctatataatgtgctgagaatgatgattaaaaatagtaactaatagccaccgtttactaagcctatgccatgtacttgattacaaatagtaactagctgtgcctgatggcttatgcctgtaatcgcagcactttgcgagatcaaggcgggcagatcacctgcggtcaggagtttgagaccagcctggccaacatggcaaaaccccatctctacta

SEQ ID NO: 225070 - DNA, 693 bp, Homo sapiens
ctgcactcccaacaccaagaaacccctgagacgcgaagctgccagcgtgctgccctcagagcagggcgacgcaaagccagcggaccccggggtggcggggcagcccacagacacgcaggtcgactggaacagttcttggcagcctcttctggagggcgtctgaggtcgtcagcagcggcctacgacttcaaggcaggcttctgacccctggggatcacgcccatcggactagccaaggaggagccttcgcactccgacctgcaccgcatgcgcgcccagttcctgatccccaagagcagcccgtctgagctggaggaccgcggcaagcccttggaggagctggcaggcctggcccgacgaggaccccgcgtcctgacactgtcaaggagctccgggagcgcaaggcgaccgcgcgctccgccaacaccttttcttccggggttcatgggcgctgccggcgctggaaatcccaggggcacggcgaggagcccagctcctaggatcccgacatcgccagcgcggcagaggacgcggatcaggcctccccgcaacccggcgtccctctacagtccggccgagtccacgcagcaagctgtactggaggacggccctgcacggctcgcagaagcccgcggagcccgtcgagaggccccgtgttcgtccacgctgggcggcgcgccttccgggagcgca

SEQ ID NO: 225071 - DNA, 444 bp, Homo sapiens
tgagcagcatctggcaacaaacgtctccaccagcgtcctcactaggccacttggatgcacagacctctggcgatgtcccaagccacccttagtatcgcctcagctacacctcatccttgaaggccaaagaccacaggcctatccaaatttttgaagcagcaagtacagctgtttgcacaaaggagtgcaaagatctactgcctaggcacaggaaggggcaccgagtaggaaagcactatggaaaggagcaccacaatggttcacctctcatggcaaaggacacgggaaagaggtcaagaattgaatcttgaaaaaccaacccaaccactctgagaacctgacgagatcaccttactcatgtaggtctgatcacagcggcaggagggaattccgggacagagatcgcacagtcccaatcagaaagaaggtgtaaccgcagcggga

SEQ ID NO: 225072 - DNA, 253 bp, Homo sapiens
gcagcagcagtgaaaatagaatgaaaggaaatagagatccacaccaggccctctgtttctaaataggaaatagttaccaattattaaccagctttcatattgttaggatattacgggtctcaatggtcggttatctctggtctcaagtcctttcactctatttttagggaaaatgtgtttaaacccctattttaaggaaatgatagtttatagattatttataaattatagttaatttagaaaatagaaaaaa

SEQ ID NO: 225073 - DNA, 416 bp, Homo sapiens
gcaggacacaaatgttggtggtagttaggatttccagattgataagaaaagagcttcgaggaaactggaagtaacctgaagactgtctcctgcatggcagctaagacctcggatgccaggtggcttcatctgactcccttctctacctcagctgtgtgatctcagaagtgttaacttagtctttctgagcctcaggctcctcatctacaagatggggctgccaatgattgctctggtcttgaagagctgttaagtggattcaataagagaaggcataggaaatgtcaagcacgatgctggtatacagtggtgttaaccatatgggggctgctgttatatgggtgttatgtgctgctatatgggtgatcgtatccccacgatccccaccaagcttgtgtctcagcctctgacgctga

SEQ ID NO: 225074 - DNA, 185 bp, Homo sapiens
attgtttaaaactgtgtggcacctccccactctctctcagttctgctcctgccatgtgagagcctgtttcttttgccttccaccatgagtacaagctccctgaggcctccccagaagtagatgctgccatgctgcctgtacagtctgtggaacaatgacccaattaaacctcttttctttatttt

SEQ ID NO: 225075 - DNA, 443 bp, Homo sapiens
tagctgggactacaggggcccaccaccacgcctggctaattttttgtatttttagtagagacggggtttcaccatgttagccaggatggtctcaatctcctgacttcgtgatccacccgcctcggcctcccaaaatgctgggatcacaggcgtgagccaccacacccagtcttgggagaaaattttaacaagagaaaacaatgaggaaaatctttattttatgcaacataaaaaaggacatgagaaaaagaaataagaattataataaatttaaaattcaggatgagaaggtagaaataattctaaacgtagcagtaattatgataaatatgaatgggtgaaattcccaaaatagatttaagctaatcagtctctgttaacaaactattgagtgttgttaacatgatatacaaattaaaacaacacaggcaggttttaaaaga

SEQ ID NO: 225076 - DNA, 465 bp, Homo sapiens
gtgttgaaagaattcactcaaatccaaacggccatgatctctgcttcctttcactgctacctgaagatattgtttttactcactagtttcctctagaaatgaaaatgaattatgaaatgtttatatgttatgcattgataacattgtttggtaatgactagattactgaacagcaagaagaaaacatgactttctttcctaagtccttttgacatttcacattaaaaatacattttcctgagcttatcttccttaactgatgaataagctctagagatctgctgtacaacactgtaattatagtcaataataatgtattacacacttaaaaatttaagagggtagatctcatgttaagtgttcttaccaaaaataaaaataataataaaaaaaaattctgtgactgttttagacctcttattttttctcttattttaaagacagtcatttgtttagaaaaattag

SEQ ID NO: 225077 - DNA, 423 bp, Homo sapiens
aagtgtttcagagtttggtttttcagattttgaaatatttgccttaccctctgggtgtcatgcaggcctttttgacattttgaacagtatctttaccccacagagcaggaaataagccaaagaaccccacaatgagtcatgcacataggtctcagccctgtgtagggtgttgtggggaactgctgctgggcatccggtctgcacacatgccatttcatgaccctctgtgggagtacctgcagagggaagtcgccgtgtgcgtgcaaaggatatatcgggccgggtgtggtggctcacgcctgaaaccccagcactttgggaggccaaggtaggaggactgcttgagttcaggggttcgagaccagcctgggcaacatagtgagactctgtctctactaaaaaaataaaaattaaataaattta

SEQ ID NO: 225078 - DNA, 505 bp, Homo sapiens
ctgtctgccaccaacttgtactaacttccgtctctcacctgggaccgtgcagccagcagctcctcctgcaagggatcatggcttaccaccatccaccccaatgtctcggagctgcctcattctgcaggaggaggcccttgcagggatggtggtggcaactgcacagcaatgaacaaaaccgctttttaaatgtcactagtaattcccaggatcacgcacagctctagaaagcaccgcagtaactattccttctgaacaccttggcacaggagacctggagtgaccctacgtggctttcacccagggggaatcatgtctggggctaaatacaaggacaaaggagagagaagcctgggggatgtcggctggggcagtagcagtcagagagcgaagggcttgaaggtcatatcaaggagtctgaattttgttgtgtacaacacagaggggtatgggagacggttaagtggagaactaagagaacaataagagacagtgcaccagagat

SEQ ID NO: 225079 - DNA, 384 bp, Homo sapiens
ctacaggtgcacaccaacacagctggctaattttttattatttttgtagaggtggggtctccctatgttgcccaggctagcctcaaactcctgggctccagtgatcctcctcccttggtcttccaaactgctgggactacaggtgtgagccactgtgcctggcctattcttccatcttttcaaaaaacctaatatatgcctgaaactaaaactattctattaccacatatattccattattactgataaagtacaatataattaatacatagtccataagatttagagtaaccaactagaaatgccacagggttttctcctgaccacagaagaactctatttacagagcagtttgactagtccagttgaggtacactggagcta

SEQ ID NO: 225080 - DNA, 318 bp, Homo sapiens
tacatgacatggaaggaattcacttattatttcagtttgatccttaagtttgaattccccaagaagcaagtccagaaacaacgatttgactgcaagtcgtttatttgtaaggtgatgctaggaaacactggtggaggtgtgggaaggtaagacagaaaagggaaggccaccaaataaacgttgcatgaccaagcacatcaccactgtgggtatctggagcttcactccactgggaaactctgagatccagtgtggaatacacacctcggagttatcccactcaaaaagtgaggggtgctgaggtatctaaacactcag

SEQ ID NO: 225081 - DNA, 385 bp, Homo sapiens
gttaggagagggtcagcctccatacatgggacttaccatggttcccaaaccagccatgcaaccaagcttatgattgcttaaaaatatactacaacagaccaggcgcggtggctcacgcctgtaatcccagcactttgggaagccgaggtgggcggatcacgaggtcaggagatcaagaccatcctggctaacaaggtgaaaccctgcctctactaaaatacaaaaaattagctgggcgtggtggcacacgcctgtagtcccagctactcgggaggctgaggcaggagaatggcgtgaacctgggaggcgcagcttgcagtgagccgagatcgcaccactgcactccagcctggacgatggagcgagactccgtctcaaaaaaaaa

SEQ ID NO: 225082 - DNA, 247 bp, Homo sapiens
tcaatcctaactggaccttggaaccacctggggagctttaaaacctgccagaaccctggccccacccagcccagactcatgaactgtggctgcctgggcctatgggttcttaaatgctcgctgaccagacacagtggctcacgcctgtaaacccagcactttgggaagtcaaggtgagaggatcgcttgcacccaggatcttgagactagcctgggcaacatagcgagaccctgtctttaattttta

SEQ ID NO: 225083 - DNA, 265 bp, Homo sapiens
caacctggataatccaggataatctccccatctcaagattgttaatttaatcacacttgtgaaatctcttttgccatataacactcaaagcttctagggattaggaccttaatatttttggagaggcattattcggccaccccttatgtgtacaagtgtatgttttttcctgagcaaagttacctcatactttcagaatttaagtgttctcagtccaagtctggtcatgatttctatattccaggtccatgttgatggaaaactg

SEQ ID NO: 225084 - DNA, 466 bp, Homo sapiens
aactgaacccttggatccctgtttcattcagctggcgaacaagttgctgctgttagaaatggaaagggtacagagccctggtgttgagagtggggtggataggtaagtctctgggtcctgggactctgcagattaacagactttgtgccatgcccaatgctgggcatctggctgtttgaatcttgaatttaccattcacaatctgtgtggcctggttgagcttcttaccaccctgagcctcggttttctcatctgtaaaatggagctaataagatctttcttgtatgactttggtgaattaaataagaaaatgaatgtgaagtgcctggtacattttggttgttcaatatgtcctgataaatttcctcattctgtcctgataaatacttgattctgacttagtcatttttgaaaatgttcaggtctgattgggagataaactggattaagggtgccattcagttaa

SEQ ID NO: 225085 - DNA, 434 bp, Homo sapiens
taaacagtagccattatgatttttcttgctctggatttaacttttttaagctcctgaattttggattagtaatgttgttgaccatggaggaaaattgaaaaaagatgttggcttcattttcttgatgactgaaaagtaaactagtggccgggcgcagtggctcactcctgtaatcccagcactttgggagactgaagctggtggatcacttaaggtcaagagatcgagaccagcctggccaacatagtgaaaacttttcgctactaaaaatacaaaaattagccaggcgtggggtgcacacctgtaatcccaactatatgggaggctgaggcaggagaatcacttgaacctgggaggcagaggttgcagtgagccgagattgtgtgactgcacttgggcctgggccacagagcaagactcctgtctcaaaaaaa

SEQ ID NO: 225086 - DNA, 562 bp, Homo sapiens
acttgctttacatttttgcttacagagttaacagagatatggcatgaacatgtattagaaaaatgattcacacacaatagaaaaaataagtaagaccaggattgggtggctttggagaatgtaatttcagcttgaatatgaagatgcttgtagaacagtgttccttcctctgaacatggctacagaagaacaaatcagttagtctgaagatgaaaacaagaagctgatggtagacacattctgaactggctaacacaacactctgaaactggaggatatcaactgataagatatgaagttctcccttagtttcaaatacactgggttcataaattattgacataaacaatagatgtcccatcaagctaccatgaagatagctaggtctgcacaactcctcaagtgtcgacccctccaagcacatcctccacctggaactgtgaactgaatggataaatgtgttggtcagaaaggtctttacatctttgaattgtaacgatcatgactagttgctgagtttgccacctccctgcctccctgccctctaccttccaagaattat

SEQ ID NO: 225087 - DNA, 201 bp, Homo sapiens
tatgtgcaaaaggagaatcatttcaactgttggctccttcaggagacatttctgactcctcctccatcttaggcacctgggccatgggggaatggagatgggccaaatctctatcccagctttccaacactctatgcattggtttacttgtttatgctctaacaagagatttaaatgcatttgctgtcttaggactcgtac

SEQ ID NO: 225088 - DNA, 1004 bp, Homo sapiens
gaccgggcccggcccgaggggtgggggcccgcgggcgactcgaggtgctggaacgcgggcgcttaccgaggcgagaacctagggggtctccccgcgtggaaaccccgcccctccctcggccttggacacagtcggcgctcaataaatgaatcgaagtttcttcctggacggcgacctgggctttcgggagaaagccagaggggcagggttctggaaggttccctggcggctggggtgcggtgcgggctgaaatccgagcaggagctgggcgcggccctcggggaccgactatgggggacggcgccgcgggagtggggcaagtgcgggcctggacccttggggccaccgcgtcagcagtcggcggggccgtgggagggacggtgcccgcccgctgtgaagggcggtggcccttctagggtcaggccaagcgcagaggcctgaaggtcaccgggtgaggagccagcgcgggtgcctcagaagccaagcgccccgtcccgagccctgcgcgaaccagtatgaccttccaggaaccagatgagagctgcgttttcaagaagcagtgccagacaccttgggaaatcgacactctcctgtccttgggtgggggtgggggtcctggaaagaagctccgtcagcgtaaagtgaactcttagctttgactttgcagagggatccgttgtgtcacagtgacccgcattcctgtcattggtgtggtgtgtttcacagccattgcctccctaggtagattgtaaaacggcgttcgtagagcctttgacctcataatattatgttggaaattacacgatagtaaacataatgataaatggggaatgttaaatggtagtatgggaacattttctaatggttgcatccttaaaattttctgtttcaagtttttaaaggctatagccttaaaaaaagctgactgtaggaaaatggtggaaagagtcgtggaataaaggtagctttggggattatgacgtgaataaatgacagaaattaaa

SEQ ID NO: 225089 - DNA, 474 bp, Homo sapiens
tgtacacttaaaaaattgttaagagggtagatctcatgttagatgttcttactacaataaaaaaagaaaaagatactgatgcacaagaataactaatctttcttccctcccttaccaaaaagattccccacaggagaaggcagaaaactaatccattattaaagtgaagagaggagagaggagccaagatggccaaataggaacagctccggtctacagctcccagcgtgagagacgcagaagacaggcgatttctccatttccatctgaggtaccgggttcatctcactagggagtgccagacagtgggcgcaggtcagtgggtgcgtgcaccatccgcgagccgaagcagggcgaggcattgcctcacttgggaagcgcagggggtcagggagttccctttcctagtcaaagaaaggggtgacagacggcacctggaagatcgggtcactcccacccgaatactgcgctttt

SEQ ID NO: 225090 - DNA, 469 bp, Homo sapiens
tgccaccatgctcacaaaggtaggatggggaaagatttccccagagctaggtgaaagatcgtagaacatggtctggacccctgcctgacttgagagaaatgcagcaaattcaggcccaagcttctaaaggaggccaatatttttctccagaggaaagacttattttgaaaactggaaaaggatatgaaatgccaggctcaattctaaagcctgtggttgaaggctgtgaggcctggactcaaaatatctggggaaatcaagacaatctggaaaacgtggcttcggagctttagtgacagctagtgtggtattgtccaggcctgcctgagcttcagaaagtcagatgtggggtgggaagctgcatgcgttctgatggtgaccagggccatctgtgggagctgtgtgggagcacaggcataccctcctcagcctgggcgcactgcaatcaacgtgattcaaaaaaagaaaa

SEQ ID NO: 225091 - DNA, 510 bp, Homo sapiens
taagacccagagtgaggactgagtggcagaaagccatgcccctgctactcagaggcaagttcaataccaggactgagactgcctgacccccagaccagaggtccctcctctgcaccacaacttccactctggttagatgtggccaggagcccacagcctcttagcttcccccaatcctaatactcagcagctcagagtcagacgtctcttctactgtcaaatccagattctcagtgtcatttcttcacttcatttcctcctgccctgtcctcggctaaactaacgaagagtgcatcaccaccaccgtttacctgcagatgggccaaacctcaaaggatcccttgagctcattccttccctctttctcagaagatcacgtcaatctcaccggacttgtttgttctagatcatgatggctgctcccaggacagtgtctgtcctggcaaaggtatctcatattgctgttccccttttttctcctttgaagtggaaaataaacttgcagactat

SEQ ID NO: 225092 - DNA, 386 bp, Homo sapiens
tcttaagactgggaaatctagaaaatcctcagcagtttgctagggcagaagagttgtgagttttaatgtttcagttcatctgtttaaagtggtttgttgactttatccagatattctcagtggttggttgttacctttgatagggagttgaaaggttatattacccagagaactgataccatagtatctggggtgtgacgcactgagcttcagagacagcagcaagacttggttctaatcaccatgattaacccgcatgttttctctgtattaaaaagccctgattgtgtcctgcttgtaccttggccactttggagaacaagagtcacttttacctaaaactgtactgtgggaaggaaaaaagtaaagatattattatcaaaaac

SEQ ID NO: 225093 - DNA, 391 bp, Homo sapiens
tctagtgttaatgaggttgtgcaacaataagaattttaatgctctgctgataggagtataaatagaaaaaaactactttgggggacaatttggtgtttagtaaagttgtagatgtttcaacctcatgcctcagcaattttacatcttggaatctaccgtagtgaaacttcttcagatatccagaaggaaacatacccaagtatactgattagagcattatttattctggcaaaatggaagtaaatcaaatagtaaacgattgtggatggtttaataaactgttgcatatttggtcaataaattgtcacatcttaaaaattatttcataaggagtgcatgataacatgggaaaagccttgatgcagtgttattaaaatagaaaagattaaaa

SEQ ID NO: 225094 - DNA, 521 bp, Homo sapiens
cccgaccatttgttgaagggaatcaccactgtcagacttcaatccaacaggacccactcgagccatccacacttgccccagcctcctccaaaacagcacactttccggctgaagaaaagaagaatggtattcacgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtcagttgaaacctgctgggactttttagccattctcttcaacataaagaatgggtgtttttggagggggtgagaggaatggggaaatgttgtcaaagagtacaacgttttagttgagacaggaagaatatattttgttgagatctacagcacagcatggtgactgtagttaacaatgaagtattgtctatttccaaattgctaagacaataaatttcaaatgttctcaccacaaa

SEQ ID NO: 225095 - DNA, 255 bp, Homo sapiens
cccgaccatttgttgaagggaatcaccactgtcagacttcaatccaacaggacccactcgagccatccacacttgccccagcctcctccaaaacagcacactttccggtatggacaattcttttttttttttttcacttatttgtttgttgtggtggtagcaacagcagcaacacagacgacacgtatttccctattcttctcgcccttctcaccctccctacccagctcctgccttagaaacaggcttggccta

SEQ ID NO: 225096 - DNA, 405 bp, Homo sapiens
ccaagatcacgccattgtaatccagcctgggtggaagagctagacttcgtccccccgaaaaataaataaataaataaataaataaatggggttgtatataggcttagaatgggtcagtcagaaattcaggggccactggtcgtggtggctcatgcccataatctcagcctcccgaagttctaggattacaggcattagccattgcacctggccacatttaagaattttattttatgatttgggtgttaggattttaattagctggttggaaacttagtgaatagtttgataatgtttgaagaaggaaaatgagttcttgaaataagctgttttatgccaagtcaaaataataaaaatatgaatactcagacacataccaccccaaaaaataaataggccttgggc

SEQ ID NO: 225097 - DNA, 436 bp, Homo sapiens
aagctgggcactgagcttccttggcactgtccatggggcagaatgtttgaaaatgcctggagaaggctgtaggaacgggtgcagccatgggccctgtgccaagttgggctgagcatgagtgcacctgaacacacccacagtctcctctgcctggctccagggggcagcacaaattctggcctgtttggggtgaagtggggctctaccatggatctcattagaagctctggactgggaggccttggtctccagaactctcttttcttgtcccagtgactgattccagaacgttcttaggatttgctctctgctgtcacatgcctttgcgtgggactgtatagctggctgtgccatcgtggaggatggctcagaacttgactgttatgtttgaataaatacacgaccgcggcttcctgtggagatttagaatgaacga

SEQ ID NO: 225098 - DNA, 479 bp, Homo sapiens
ctattatcctcactgaaaccgagagacccagcagataaagaacttgtctacggctatgcagccagggatgaaaacgaatcaagtgactgaaagagaagaaagtttcagatgacaggagtgacgtgcaaaggtacagacgcttgaggaagcatggaataaaatttttggtcgggcatctgctgtccagaataaagactacattttccagcctcctttgcagctggacgtggtcatgtgaccgcatttaggtggcatgtaaatggaggcactgtgtggcagcttctggaaacttccttttgaggtgccatgtaggtgaacttggattcttctctgcccacttcccactcctcattttgatgcctaggctttaatgcaagcttggaccacaaagttgaggactgccccacagggatggcatagggtaagccagactgtgacctgaatgtgagagaaataaactctcttgtttaagccaaaat

SEQ ID NO: 225099 - DNA, 393 bp, Homo sapiens
cttttgcccttgctggatatgaatatgctgtacattgttttgttgttgttactcctcttaaccattctagaataaacacctatagaagggtgtctccactgtacacatactacttgattagggaacagtataactagaaccctattgtactatacttatgagtgtacagggactcgattaggaacttgtacttataatcagaccacctattcaatttgtgacccaagaaatggtcagccttatatatgctgtgaccctgagtctttacctgggactcggttggagattcatactgagtcaaaggaaagaagttttataggtcaaacccaagcctctcttcctggagctatatgcatatactttgatatttgtcagttaacatctatgaaccca

SEQ ID NO: 225100 - DNA, 430 bp, Homo sapiens
gcctcccaaagtgctgggattacaagcatgaaccaccatgcctggcctgtcaatcccattttgcagacaaggaaattgaggtaaacggatggtaaagagcttgctcaaggccacagtcagtcagaggcagtgccaggattcaaacccaggttggtgtgatgtccagacctaacacttgtagccatttggctatattgcctcctgcagggttaacacagagccatactcagaacctcagagcagctgacacctttcagattgcagtagaggggaatgaggatcaaggtcagagattgatcactatcctctgaatatatccccactcttcccattgatctctgtctcccatgttctcattctctagtccatgtgttgctgtcatctctgcctggaccacagcaggccctgactggtctccatctctgtactc

SEQ ID NO: 225101 - DNA, 1039 bp, Homo sapiens
agtaagtttaataaaataacctaaatattgtcaaatctaggttttacaatgtattgctcaactgttcaaactctctatatacaacacatacacacacacacacacgtcagttactacaagtaaaataaacttagtgaatcattgactattcttggatataacccacttttctgtgctctttaaacttggcataagtaatataggagacagcattggaataacaagagtaccttgcaagtcacattggtaaggtgcgctagactaaacatgtgacaaggctagcgttagaaccgcagtttggtgtctaagtttagaagcaggttagcaactgtcaacatgaaaaatgtatcatattttcttctggaaaatgatttttgaagaaatcatatagctgcatatctatctgttaaaaggttaataaactcagaagtagaaagacttcagatgctgaggaaaacatataatctatagcattcttgagagattttccatttgctttttatttgctagataattacatttggcttaatctgattttatggttatttagatttctcccttgagcaaaataacataattttcagtatctaagattcatcgattttttgttgaaaacaaatagatgtgacatgttaagggagaccaagttgaaccatccctcagacccagtacaaatatacctagtaagtgcccccctttcaatacattctaattgggaagaagaagagactagtggcttaaaaggagaaagcagaagctcctggtagtgttacctgatagcagaacttaccaggcagttggaattcacgagtgttattcttgaatgactatgtctagggggaatattgtttaaccttcgtgcctcagattacccattagacaattgggtataatcatattcacctacctcccagggatatcagagactttactatttcaaaaatattttgagtttttgtaaaatgtcctatataattaaaaatagtattatcatcttcctgcagaggctaaaaaatgttttccttataatgagtataaa

SEQ ID NO: 225102 - DNA, 1359 bp, Homo sapiens
cgactaccatcagagatactatgacacctctatgcacataaactagaaaacctagaagaaatggataaattcttggacacatacaacttcccaagactaaaccaggaagaaggtgaatccctgcataggattagacttcatcctgcatgaaacatggcttcagtgaactgtactttatcttttacattacaggtaatttcttctctagatttttctctttgccctcaactcttgacatttctctaacattctgttggccacacaatcccttttctttgataaatttggcaaattccatggcttcaagtatcaaccacatatagtactataaactcgaaattctctttggttcatcagcctcaaattttccacctgtctcctacatgtctctgtcaaaaacataacacatacacacacacacacacgtcagttactacaagtaaaataaacttagtgaatcattgactattcttggatataacccacttttctgtgctctttaaacttggcataagtaatataggagacagcattggaataacaagagtaccttgcaagtcacattggtaaggtgcgctagactaaacatgtgacaaggctagcgttagaaccgcagtttggtgtctaagtttagaagcaggttagcaactgtcaacatgaaaaatgtatcatattttcttctggaaaatgatttttgaagaaatcatatagctgcatatctatctgttaaaaggttaataaactcagaagtagaaagacttcagatgctgaggaaaacatataatctatagcattcttgagagattttccatttgctttttatttgctagataattacatttggcttaatctgattttatggttatttagatttctcccttgagcaaaataacataattttcagtatctaagattcatcgattttttgttgaaaacaaatagatgtgacatgttaagggagaccaagttgaaccatccctcagacccagtacaaatatacctagtaagtgcccccctttcaatacattctaattgggaagaagaagagactagtggcttaaaaggagaaagcagaagctcctggtagtgttacctgatagcagaacttaccaggcagttggaattcacgagtgttattcttgaatgactatgtctagggggaatattgtttaaccttcgtgcctcagattacccattagacaattgggtataatcatattcacctacctcccagggatatcagagactttactatttcaaaaatattttgagtttttgtaaaatgtcctatataattaaaaatagtattatcatcttcctgcagaggctaaaaaatgttttccttataatgagtataaa

SEQ ID NO: 225103 - DNA, 1049 bp, Homo sapiens
tccctttctcatctgcagggtggggagagtgatcgctaccacagcatgtgtcattctaaggactgcatggtgcttgggacatgtcaatgctcaacacatacacacacacacacacgtcagttactacaagtaaaataaacttagtgaatcattgactattcttggatataacccacttttctgtgctctttaaacttggcataagtaatataggagacagcattggaataacaagagtaccttgcaagtcacattggtaaggtgcgctagactaaacatgtgacaaggctagcgttagaaccgcagtttggtgtctaagtttagaagcaggttagcaactgtcaacatgaaaaatgtatcatattttcttctggaaaatgatttttgaagaaatcatatagctgcatatctatctgttaaaaggttaataaactcagaagtagaaagacttcagatgctgaggaaaacatataatctatagcattcttgagagattttccatttgctttttatttgctagataattacatttggcttaatctgattttatggttatttagatttctcccttgagcaaaataacataattttcagtatctaagattcatcgattttttgttgaaaacaaatagatgtgacatgttaagggagaccaagttgaaccatccctcagacccagtacaaatatacctagtaagtgcccccctttcaatacattctaattgggaagaagaagagactagtggcttaaaaggagaaagcagaagctcctggtagtgttacctgatagcagaacttaccaggcagttggaattcacgagtgttattcttgaatgactatgtctagggggaatattgtttaaccttcgtgcctcagattacccattagacaattgggtataatcatattcacctacctcccagggatatcagagactttactatttcaaaaatattttgagtttttgtaaaatgtcctatataattaaaaatagtattatcatcttcctgcagaggctaaaaaatgttttccttataatgagtataaa

SEQ ID NO: 225104 - DNA, 492 bp, Homo sapiens
aggtcctcccccaggtactggggtgtgaactcggagagctacctgatgtcgcgcccctcggggacagaggcgcggccccaaaccctccacgcttctacaagaaccccctactcaaaatggaggctcaggccggtgtaaagcgggcctccctctgacggcacgcgggccagtcggggctgcggcaggacggctggcggaggtcccggcgcggaacagcaagggccgtgtctgtgcgggtgagtggccccgcaactgcaggctgacgtcaccgcaggccgcgcgggccttcgtggggctccccgggcgcggctggatcaggacaagcctacttcaaggaatgtttggtgtgggtgcccacttcccggccccgccccgccctccccaggagaataatcgggtatttaatctctcccggtcttaattcttggcagcgtggaaggtggtttgcaacgggaaataaaacttgacaggagcattttctctaaaagggat

SEQ ID NO: 225105 - DNA, 362 bp, Homo sapiens
gagaagacgacagaaggggcatactcaaagtgactttcttccataaatttcagcacaatctaatcactacttatccagtatcgtaagtccaaatttaaaactctaccaaaaaaagttttgaaaaatcaaatgccatttctcaaagatagccaacttataaagactttaaaataaatgtgagtggtaaaaatcagaaacatataaatatttagaaaaagggctgagtgcagtggctcatgcctgtaatcccagcactttgggaggctgagaatggcttgagcccaggagtcgaagctgcagtgagctatgattgcaccactgtactccggcctggctgatagaggccctatctcaaaaaaaaa

SEQ ID NO: 225106 - DNA, 571 bp, Homo sapiens
caagcaatcctcctgccttgaactcctaaaatgctgggattacaggtgtgacccactgcacttggcttattagccaatgttaacatattaaatgaatctatatattgctaggcagagcagcttacaaaatgccagaatgcataatcaaactggacaggctcaatgaatgattacactgtgcttaatggctaagctcaacaccttgatatagctttatgatttgcagaaaatttttaataatggtccctataagaatcacctgtagaccaggtacggtgactcacgcctgtaatcccagcactttgggaagccaaggcgggcggatcacctgacatcaggaattcgagaccagtctgaccaacatggtgaaaccccgtctatactttaaaaatacaaaaattcgccaagcatggtgctaatgtctgtggcatgcacctgtagtaccagctactccagaggctgaggcaggagaatcacttaaacccaggaggcggaggttgcaatgagatgagatcgcaccactgcactccagcctgggtgacagagtgagacttcttctcaaaaaaaaatt

SEQ ID NO: 225107 - DNA, 606 bp, Homo sapiens
tgaacactccaccctgaagtggagggcatgtgtgctgagacgaggaatgcacgtgtacacatgcaggtgtccctacagtggtccctgccgggctgccaggacagggtctcagtgcttgttaccctacagggtacccaacagggcttgcctttctcaggtcacctcctgtgctgggagtgcccctgcagctgggtagccatcctggtataggcccagaagaggccagtggtaaggacagcacgcctcagctggcagggcccaccatctttccagcactgagttggcaacagtctcaaataggtcacaggtgaagagtttcaaggacatgtagcttctgccttagaagcacttagttgacactgcttcccttagctctaactttacaaaggttggtgggtaagatgactttcagtgccctcctaagctagtgaggtttgtttttttttttttttttttttgagacggagtcttgctctgttgcccaggctggagtgctgtggtgccatcttggctcactgcaagctccgcctcccgagttcacgccattctcctgcctcagcctcccgagtagctgggactacaggcccccgccaccacgcccggcaa

SEQ ID NO: 225108 - DNA, 725 bp, Homo sapiens
acagagtgagactctgtctcaaaaaaaaaaaaaagaaaagaaagaaaattgcatttagttcctgtagactgtgtgtcaaatgtctaaatctcttctaacaaatggcctaaggaggtgcaaagcgaagcatcctcaccagcatcctgacttggcagtgaggcatgggaccctggagggagtagtggtaagtgtgactctggaattcttcctgggctacttgtcagtgactggctccagattgagaggagagcccagaggacacaagtggctgccccagcctggaggtgaaagtcttaaaataaaatgccagatgcctagaccattctaatcctttcttaggagctgaaatcatcccttctggaagcgctctagttctaaaaggacagatatacagcaagatcttcctggggctaatatggagtttataggcaagtaggcctcagaacctttccctggtagtgatatctgtgggcaggcacagtttccacactttccagaaattccagcggaaggagtgagaaggaggaatctgcccttgagtgaggaccaaagaaagcagaaattcctcttgggaatttttcctccagagaccaaacactacttgggagcttgtttactgggctttaaaagcttgtgacccccagtcactctttcttgaccccaaggctttgcatttctgtggcttccccactggacagaagtggaactgtcatgctgcctgttct

SEQ ID NO: 225109 - DNA, 342 bp, Homo sapiens
ggaaagaatttggtattatttagcagatagaagacacacatagctagcaatttcatttctaggtatacctgagatcagggctcagcaaactttaaagggccagatgtaaatgtggtaggctttgcaggtaacatacagcctttgttgaatatttgtttttaaaaaaactataaaaacataaaaatcattcttagctgggtggctgtaccaaggcaagctataggctgcatatggcctacatgccagtagtttgttgatgtctgcactagttagggtgaaaatgtgaagggaatggtgaatgatgaagatttggctcaggtttcagggtaacagttaagaaaa

SEQ ID NO: 225110 - DNA, 546 bp, Homo sapiens
ctgtagagaaatagaaagagagtatgcagccaaaaaagattttcatttgtttgttttttgaaagcagcaggctgccactgcatatctctggagaaagattgatgatgcagaagagaaagagatagcattgcaggagaaaagtccttcaggcggccagaggagatggcacttcctgctgtcagagtgacttccaaaagggaagtttgaatgatgcaattcccctgctctaaaattccccatggcctcctaaataagcccaacttcgtagcctggtatttaagcccagctccagccaaactttccagctttgtcatccttcaggaagactcctgtgtgtattctatgcggaagccgacacaagctacttactggtcccttcatatcctgagtgagttctcatctgcagggctttgctggtgccctttgccctcagttctacctgttgaaagactactcatgcttcagtgctttccatgatgcccccagtaagaaatggttcctttcttctctatctcctacagcactttgcaattcttaaggcttgtt

SEQ ID NO: 225111 - DNA, 618 bp, Homo sapiens
ctgtagagaaatagaaagagagtatgcagccaaaaaagattttcatttgtttgttttttgaaagcagcaggctgccactgcatatctctggagaaagattgatgatgcagaagagaaagagatagcattgcaggagaaaagtccttcaggcggccagaggagatggcacttcctgctgtcagagtgacttccaaaagggaagtttgaatgatgcaattcccctgctctaaaattccccatggcctcctaaataagcccaacttcgtagcctggtatttaagcccagctccagccaaactttccagctttgtcatccttcaggaagactcctgtgtgtattctatgcggaagccgacacaagctacttactggtcccttcatatcctgagaaaacctggaaacatccagctaataatgtttcacagccgtgaccacagcctctgcctgctggcacaccacaccacttccaccctgctctcatgccaggcaccattcagtccccagcatggcatcagctacccacagtaaagaacaacaggtggtttggaaaaatccagccaaatgcttacaactccctctgggcattgtaatggctatttaatggtgaacaaactgagg

SEQ ID NO: 225112 - DNA, 398 bp, Homo sapiens
ttttagcagccccagcggagacaacactctacctggacattttatttgctgtaatgttcttacgagttgcaagcctggtccactttttacttcacaactaatgtggaagagaacacatctgattccaaggagaggagactcatctcttgtcctcaataacaaatgaggaatctgaagagcttgttttaaacaattttggtggtcttacaacccactggcatagaatctcgagtgtacttctttctattcaccatgccacctacttctactgcagacatgaaattaatcaagatcacgtagaaatccattggcttgggaggacagaacaatcttattcatagaaacatgatgttactttattagtaaacaaattcagtataaatatgcatctgtgactt

SEQ ID NO: 225113 - DNA, 426 bp, Homo sapiens
cctgttgtgtgggacatctcagcctgatgcctggtctggtgggagggtgaggaaggggacagagcaccatttaaaagcccaggcttataaaaaaagaataagatcatgtttcttgcaggaacatggatggatctgaaggccattattcttagcaaactaatgcaggaacagaaaaccaaatactgcacgttctcacttataagtgggagctgagtgatgagaacacatggacacaaagaggggaacaacagacactggggactgtttgaaggtgcagggtggtaggagggagaagaggtgaaaatataactattgggtactacgcttaatacctgggtgacaaaataatttgtacaacaaacctcgtgacacgagtttacctatataacaaacctgcacatgtaccctgcacttaaaataaagctt

SEQ ID NO: 225114 - DNA, 227 bp, Homo sapiens
tggagtaatgggtaaataaatttttttaaaaacctaggtcacataatcccaggccttccagctgataataatttcagcagttttgttatactctgcaacaatagttcttaaactttcaggggtcatgaaccctttcccaagaaaaaagttttcatataatttcagggtatttttaaatccctgaattcattacctccatggattctcagttaagaactccctagttc

SEQ ID NO: 225115 - DNA, 417 bp, Homo sapiens
tgcatttgcatataggcaggcatatatatacacacacacatgcctaacgcacatctatttttaacacaaatgggataatttatactgttcagattgttttgagactttgcattcttcagtcatgaatatatgtcgacttcctcctctttcacactcttccaaatcttccccatccttcaaggtgtcattcattctttgagaaagcccctagtggcgctgtcaatagtgagttttggtaggtacgtttctaatgttctttaaattcctgtaatcctcttcccctctggaccgctcactttgtctaatcttatgttgttctttgtttattcattagttaattaattccgttgagctacactcagttatttggcccccaagaagtttgtcgtcggtggaagacacagacatactaaacat

SEQ ID NO: 225116 - DNA, 737 bp, Homo sapiens
gtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctca

SEQ ID NO: 225117 - DNA, 801 bp, Homo sapiens
actttgtgtgtgtttatgtgtgtgtgaggtatgttgaatatggtcacaactgtgctttagggaatattaatccagtgaccatagaagcggggagttgggcaggaataccgtaacagaacattattgtaacagtgaatgaaaataatagtaaaattataagaaggaaagaatggctgcaagaggcgtttttaagaattgactcactgattgtgtatagaggctgtttaaaagactgaatgcgtggaagatgatggtgatgccagtagaaatggagaaataccgagtgaacgcagctttgagggactctgatttcagtttgagatctgttgaaattatagtgcagtagaggcccacagctgctggcatttcaagatgtgggtttggagtgcaaaaagcaagctggtgccaaagatttgagtcttcttggaacagagatatattgaaagtgtgactaaggagatcacaaaggaaaaaatgaaaagagggaataaaagaacttgatgcatgtctactgtttttcagttatgtattgttgcatcaaaaataaaactctaaacttagtggctgaaaacaagctcagcttattgttcctcaggattatgcgggttgactaggcggttctactggtctcacctggagttactaatagagctgcattcaggtggtgaattatttgagcactaggcctggctgggctttaacttgggcattttggttctcatccacatgacctctgtatagctagcttgggcttccttacagcatggcagtcttatggcagtgagccaagagctacagcag

SEQ ID NO: 225118 - DNA, 424 bp, Homo sapiens
tggtatttttagtagagatggggtttcaccatgttggtcaggctagactcaaactcttgatctcaggtgatctgcccaccttagcctcccaaagtgctgggattacaagtgtgaaccactgtgcccagccaagagtgtgttacagttttctatgtagccgtcttgcataactttgttagatttattccttagcgtttttaaaagtggtattgtaagtagtgtttttaaaactgcatttaaaaattgtagctgtaatataaaaataagatagatttttatattattcatgtatattgctgtaatagttgataatttacatttaggttcttttggattgtatactgtacagtcatctgtgaatattatatcatctgcaaatgaatcttttatcttacccttaccaatcttatgtcttctatatatc

SEQ ID NO: 225119 - DNA, 464 bp, Homo sapiens
ttagggggttgccctagaggagctgaggattggccccaaaggcataagggggccagttcaactcatagcccaccctagtcctcccggtcacatgcaggtagccagttacttggtaattaacaaaacaagcttgtggttgttgctgtcttccattttactcctatgtcttttggggccttcttgggaaataaaggcttcctttttcctcatgtacctcataattattgtgccccagaactgcacataattattattatttttccattcaggagttaatgcttcagccaaacaggtctggatggaaacccagtttgcattcagaggaaaatagttgactattctcagactagaccacttgagggcggcattgccttaggagagtgtgttttgaccaactaatacataacctaaggaggaaatatgcagcgtgggtgtcacaggcacatcactgtagttcagggaat

SEQ ID NO: 225120 - DNA, 123 bp, Homo sapiens
ccgcccccaccccgccccagctgtccccgggctgctccgagaggaccccgggcccaccttaccccacctcaccccacctccacccctggagcgcgtcccggagcgggcgggcggccggcgggc

SEQ ID NO: 225121 - DNA, 396 bp, Homo sapiens
cctctctgaacttgagcatcttcatctgtaaaatgggagttggggtctgttctgagcatcccaggagatagaggatgagcaggtggattgtaaactaattaaacaaatcagtcctactgatcccatagaagaaagggagtcaggaaccctttcattccatcaatatttattgagtacacacagtgtgcttggactggtgtagtagatacccaccatcttttcacattaccctgaccgccctctaatctattctccaccctgctgtcagagtaatgtttctaatgatcagaaatatgatcatgtcactactctacttaaaagtatctgttgatggccaggtgcagtggctcacacctgtaatcccaacactttgggaggctgaggcaggtggattgt

SEQ ID NO: 225122 - DNA, 485 bp, Homo sapiens
caccccagcctcctgagtagctgggactcgatgcatgccaccatgcccggctaatttttgtatttttttagagatgaggttttgctatgttgtccaggctggcctcgaactcttaggttcaagcaatccacctgccttgtatctcatgatttttaaaaagatttttatctttccagattataatttggaaaaaaaaagtgaatgaaaaggcaacaaaagtagaaaggtctttgttggttttagcagaattttttgtttgttttgaattagttgctgtgacagttaaggtatgttttcagagttgtaaagcttataagatttctaccttaaaataaagtaagaatatgaggagtggccttattgtgatttaaaaacaaactgcctcatattttattccccacccaaagaaaacaccgtgccttaaaggaaacaatgttttatctaatgtttttattactttaaaaaaaaaagtcgacgcgattatt

SEQ ID NO: 225123 - DNA, 536 bp, Homo sapiens
actatgagagactaatttaggccgtgtggttataaatgagatttcaattcatttcttcttctcttaacccgtctcagaggagatatcacagggtgactttctatgttgcgttttgacacaaggacagtttgtttttgctttggctgatggatggggcagctctagttgatgaatgtggtttatatgctcacaggcagatgaaagtgtccactctgccctgagaccctctcctttctgcttagtggtgttatgaaagccccatgggtatttgatttttcaagaattaatcagtacacagaagttgaaatgtagaccaaaggaaagaatatgttttttcagttaggctttttgtctttttttaattatatggggtttaccctttgtgtttcccaactcaggggtttcactattaaataattgtctttgactcttaaactttttaggtaaaatttatataccaggaaatgcatagatattaaatatacagtttaatgagatttgatgaattattataaccaccaccttaatcaatagag

SEQ ID NO: 225124 - DNA, 333 bp, Homo sapiens
tgttgagggagatgataaatgtcacagtggaagtatggttcagtgtagtgctagcatgtaggaagaaaaatctaggtccacttggaggaggaaagagaggcttcaaggagtgtgagaagacagctgagtcttgaaggaagaatagatgttttccagacagataagggacaagaaatagaaaaaaggcagagagaaaaatatgtgaaaatgcatagaaaagtaagaacacgtgatgggggaactacaattagttcagttttgctggaccataagtgatgggaatagcaaaatatgggttaaacatgcaggacataggttatgaaggatactgaa

SEQ ID NO: 225125 - DNA, 606 bp, Homo sapiens
taaaacacttctacctgttgccatcaaagtttaaaagtctcatgaatcactatatttgccaatcagaatggtgacctaatatcagatttagaatatcccgtgccatttagggagaaaaactcctgcaatttctctattaacatattttatgtcagagaaggggtccctttaaaagagtagatataattatatattgcacgtggttatgttaaaaatataaaacttattctaaaataacaaatatcatttcttaaagttataaaaaattatcaaagacattaactgtcttatgtcttcatttaaaaaaaatctaaatctaggctgggcgtgatggctcacgcctgtaatcccagcactttgggaggctgaggcaggcagatcacctgaagtcaggagtttgagactagcctgaccaacatgaagaaatcccgtttctactaaaaatacaaaattagccgggcatggtggcgcatgcctgtctgtaatccctgctactcaggaggctgaggcaggagaatcgcttgaacctgggaggcagaggttggggtgagccaagatcgtgccattgcactccagcctgggcaacaagaacgagactccatctca

SEQ ID NO: 225126 - DNA, 801 bp, Homo sapiens
ctgtgaaagagtaaaattggcttaaaaattttaagtacaaagacatttcagaagagttttgtccataactttgttagactgaaatgaggaattacatttggcaccaggaaatggatctggattatttagaacaaatgttttccaggtttgaatcttctatgtggaagtacagcctgacttctttgccttttccctggtccgggatcctgacagtcagttcttcagctctgtgcctccagaatttcatgtttatgctgcacaaggcctgtattttataatggtggctcttttggacgatgacttcctcgatggtgaaacttccagtaatctccctcatcatactgaaatgatatcagtatatcatcagaacaccatggagcttgtcatttgagggacacagcttgcttgtgtgcttgggaaagaagaggtttagcatggtttcaggtcagtgatgagtccaatgatctctgcaagttcccttagctctgagaattctgatgtcatatgcacttctgccgccagagttgctgcttactggatgcgtaagaagaaaggaaaataaatgtaaaatgcctggcaccactgaggaagtagggtgaggagttaagttagacagtgactggcttcttcgacagttcgacaatagtcgggcagtgtcatgcgtgacaggccggcggctggattgtgaggaggactcccgctcacacacagacagtcacaatgcacgtcaagcgacgagtatcccggatccaacgagtcacacagaactcttaggggggccagacttaagtactttatcct

SEQ ID NO: 225127 - DNA, 516 bp, Homo sapiens
aaacaatgtctatcaacagttaactggataaacattgtgatacatccatagagtagaatatggctcagtaataagtaagaagtaactattgatacatgcaacaacatggacagttttcaaagtaattatgctaagttaatgaagcaggatgaaaaagagaacatactttatgattccatatatataaaattctggaaagtacaaactaaccctagagatagaaagatcagtggttgcctggaaggtaagtggggagggtcaggctgtaaagggcaggagggacgaataacagaggggtacaaaaaacttttaggggaaatggatatgttcattattttaattggggtaatggttttactggtgtatacagatgccaaaacatgtcaaattatacactttaaataaattatttattgtatatcaactatatttccaaaaagccacaaggacaaggaatgttacttatactctagcagtagcataaaaactgaaatacttgaaaaatacaacaaaatg

SEQ ID NO: 225128 - DNA, 291 bp, Homo sapiens
aggtgcaagtgagatggccatagcactgggttctctgggtgacgctggctagattagtgtagtagaagattcaattgcatgaataaaaccatggggatttaattgaggtcttagctaccaggagggtgggtcaggtcttcgcattggggcagttgtggaaattgttaggaagagaataatgggagttgagattatgagataacagatgcttgttttcaaatattttttctctttttgattattttaattgtggacaaatatttataatataaaatataccacttaaccatt

SEQ ID NO: 225129 - DNA, 578 bp, Homo sapiens
atatgtatatattgtacagtgattaccacagtcgactaacatgttcatcacctcacagttatcttttgtgtgtgtatatgtgtgtgtgtgtgtagtgatgttctggattcatatgaacaactctattgaggtataattgattgtaataaattatacatatttaaagtgggcaatttgttaggttctgatatatttctacacccacaggttcaatataagaccatttgaaatctaccctcttagcaaatttcaagtagcaatacattataaacaatgatagccaccatattgttcattaggtctccagtaattactcatcttataattgaaagtttgcacccttgaccaaattctccccctttccccccaccctcagcccatagtaaccactattctattctttgttacccagagtttgacttgtttttagattcaacatataagtgagattatttagtgtttgtctttctgtgtatttcacttagcatattgtcctcaagagtcacccatgttgcagatggcagaatttccttcttttactaaggctgaataatcttttattatgatattaaaaaccg

SEQ ID NO: 225130 - DNA, 444 bp, Homo sapiens
ttctttatttccaccatttactcttttattagtcattcattcaacacttttgggggataaagtgatgaacaaaccacacataattcctgcactcagaaatttaaaattctagttcaaactttctcttaatttacacgacaaggaaaccaaggtgcagagagccatttgttcaaggtagcaacaggagtcaggagcagggttgggggtgggagccatggcttttgacttcttatctagacagaactcatgatctcttttttccctgtgccattttagcagttgtaacttttgcttggtaattaaaatacaatatttattttgaataggataaacacgtacagttgttccttggtatctggaggggattggtgccaggacccccatcaaataccaaaatcctgaaatgctcacgtttgttatatgaaatgttaccgtatttgcatg

SEQ ID NO: 225131 - DNA, 460 bp, Homo sapiens
cagtatactcatgctctcagagaccggtttgataaatgccgatctttgagaatttagaggcctaatttgtagacaacattcctgataaaatgagttcacctgtagtggccagtcctttggggtttccataagcaatgtgagatacattattttctaataagacatccaacaatttgaatattaatgttcaatggaattaattttgcatgctaaaagccaactgatgattttagtggatctctcttaacaatcattctttctcatgtctaaagatgagtttgggttatttctcctgaaattatggttaactaactttcatgaattttactgaaaatgatgagaaacagaaaaatctgggatttgtagacagtggcgagaaactctctgtctagtatttatacccctcaccaagcagcactcctgggccctcaagctctgctgctgtgcagaaaccgttcca

SEQ ID NO: 225132 - DNA, 559 bp, Homo sapiens
acacttttcatttgggtttgaattccttaaacatgaagactatagtaagttgcccatctctggaagtaaatactgaggggtacatggcagggtaatccgacccgatgacctagccagaagttctggctgtcctactcaactatgccctccgcaagcccagcatggtagcctttcacctggatttgaaggggaaaattgtatttctctctgaatgtaattacattttggcaaaggtcagtctagttaccaccaaaaaatattctacgagttgaagggtgggggtgggagcgtcagagcaaggttaatagtggtattttattgattttgaagtaaatataactctacgtagtcatttgttcaaccaaaacgaaaaatattcatcaaatattccctaataagttggtactcatttccttagccactttaaaaaacacaagtcaaatataattgattatataaattgtatttgcatgaagatttgagtccaaggactataagaaagattcaaattttaaattttctgcatacgatatggttaaataaaatgtttgtatactaa

SEQ ID NO: 225133 - DNA, 400 bp, Homo sapiens
ggagatctgggactctggtgactgctgctctgcatgttgaccagaaagcaagcagaacatgtgaacgctggttcttgggaagagaaaaaatttgtgcttttgctttgggtccaggaggacatataatcagctagggaactctgagacacgggtactcaactcatggcaacagtgacataaagtttgaaaaaacttcaataatgattttattttaaatgaaatattcgttgctgccaccggaccccaaagggcaaagtgttattcgtaaaggttgaggtgaaaaagttacttggcttttagaaaatgactttcacctaattaattaattaatattctgcctcattccaaggaagaatgtgaggcagtttataaaaatgcatgtcggtaagaaatgaagttg

SEQ ID NO: 225134 - DNA, 511 bp, Homo sapiens
agcttaagaaggtactgtttgaaagagaaggagattccacgacaaaagcctcatctctcacctggacaagtgtgcagcctcctacctagcttctgcacctaatctctgcccctacccctaacacacacacaattcaccttgcgaaggacagtccatgataaggactctggaatgcccaagaggaaagggtgaagagacttgtagacccccgatatggtttggctgtgtccccacccaaatctcatcttgaattgtagctcccacaattcccatgtgtcatcggagggaccaggagggaggtaattgaatcatgggggcggctctttcctgtgctgttctcatgatagtgaataagcctcatgagatctgctggttttataagggggagtttccctacaccagttctctcttgtctgctgccatgtaaaacacaccttttgccttctgccatgattgtgaggcctccccagccacgtggaactgtgagtctattaaacctctttttccttat

SEQ ID NO: 225135 - DNA, 450 bp, Homo sapiens
atttctgagaaaatgatgtgggtgattttatataggctttagttttgaattacttatgtgtggtatgaacttcagtatccggaagaaagtcttcaagtcaacagctctgaaggagtttttttttttcccagagaggaggggtgagaaaaatcaagggaaggggccgggtgcggtggctcacttctataatcccagcactttcagaggtataggtgggcagatcacttgaggtcaggagttgaagactagcctggccaacatggcaaaaccccatctcgactaaaaatgcaaaaaaatttagccaggcatggtgatgggcacctgtaatcccacctactcaggaggctgaggcaggaggatcgcttgaaccgggaggtggaggttgcagtgagccctgatcgcgccacttccctccagcctgggtgacagagcgagactctgtctcaagaa

SEQ ID NO: 225136 - DNA, 455 bp, Homo sapiens
gcctgctgagtacctgctaaatacacattatgcacctgctgagcgcctgctaaatacacactgtgcacctgctgagtgcccgcagagcacacactgcgcctactgagtacacagtgtgcacttgctcagcaaccaaatacacactgtgcacctgctgaatacacaccgtgtgcctgctgaacactgtacgcctgctgagcacctgtatacacattgtgcacctgtggaatacacactgtgcgcctgctaagtgcctgctaagtacacactgcacttgctgagcacctgcttagtacacactgtgcatgtgctgagaacctgatgagtacacactgcgcatctgctgagcacctgctgagcacacactgcgcctgctgagcgcccggtgagtatacactgtgcgcctgctgagtacacactgtgcacctgctgagtgcctgctgagtacacactgt

SEQ ID NO: 225137 - DNA, 240 bp, Homo sapiens
ccaccccatccacgacacgctgacccatggagtccccaacatctgctccttgggttggagggcacggcagcaaagcagcaggtttaattaatcacactgaactcagccgctggtgaccccaggcacagccagggagggcactgggggacaggcagccgagagagtcacctgccaccttcttctctccccatcatgggagacaggagctgattaaaatgcacatgatttattgggatttat

SEQ ID NO: 225138 - DNA, 148 bp, Homo sapiens
gtcaaaatgccaggaacactgacacacggaaataatcaccaagagaaggttataatatctatcttacggagtgaaaactgaggctgcaaactatgaagtgaactctttaaaattaaaggcaacttgcatactattttgaaaatgaaaa

SEQ ID NO: 225139 - DNA, 298 bp, Homo sapiens
ttgacaaagctgtttatttccaccaataaatagtatatggtgattggggtttctatttataagagtagtggctattatatggggtatcatgttgatgctcataaatagttcatatctacttaatttgccttcttttatagagaacctaatttaaaggaagtcttctttattaactaaaagaataaatctgcaggaggctgaggcaggagaatcacttgaacccaggaggcggaggttgcagtgagccgagattgcaccactgcactccagtctgggaaacagagcgagactccatctc

SEQ ID NO: 225140 - DNA, 296 bp, Homo sapiens
ccaaagctcagctccctttttgacacgcgttatgaattcagctcatttctggatcatggcccttctggggaataatagaacataaagaaacctctttctaaagtttcaacacttttcataaatcaatagtctagtcaaaagtcaatgttcttttttggcattaacttttatatcagtcagagtttggttagaaaaacaggaacctctctgcgttccaggcatgaaggttataggggcttatgggactgcgggaaacgggggctgacagaatggctggaagatccggggtgtcagag

SEQ ID NO: 225141 - DNA, 228 bp, Homo sapiens
gcacgagctcgtgccgaattcggcacgagaagcaatatattgctttgccaacatatgcaaatgtttggaaagtcttccacatttaaaggaggaaaaaaatacaacataaattgtagtcaagggaaaaacagaccattgtttggttttccatcttccctggggagcagctgctgatttcactctaattttagctgctattgctttgagctaaactttccatttttatta

SEQ ID NO: 225142 - DNA, 441 bp, Homo sapiens
cttctgctattcaacctgtccgctagtctgagtgcagcacagttttctagctgtattgtatctctccgcctgttaatacattgcttttctcccatgacatctttaggcccattgccctcagtattcaaagtggccatcttctcttgtgtttaagaggccgtgtcttggctggacacggtgattcacgcctgtaatcccaacactttgtgaggtctcggtgggctgatcacgaggtcaagagatcaagacctggccaacaatgtgaaacctcgtctctactaaaaatacaaaaattagctgggcgtggtggtgtgcgcctgtagtcccagctactcgggaggttgaggcaggagaatcgcttgaacccaggaggcagaggttgcagtgagctgagattgcagcactgcaccccagcctggtgacagagcaagactctgtcta

SEQ ID NO: 225143 - DNA, 442 bp, Homo sapiens
tgcaatcagtctgactggttgcggaaagaaaccagtcagagatactttcaattttccatttgccacgcataaaaaggggaggggggttgcaaagggagtggcctctggtccttttgttacttagttttggaaagttggggttttcctttagatttagttctaggaagtcagtgtgaatcagccttaggttacctgccaccagaccctattctcctgcctcagaaacaataggctacaccatatagccaaggtgtataataggacacataatccaggtttgtgtaagtacactctgatgtttgtacaatgatgaaatcgcctaacaatacatttctcaaacatatctccgtcattaagtgatgtatttatttaatgataaaaaatttattaaaacgtttatttgatatttaaatactaaaagaatttttcagcaccaccaaag

SEQ ID NO: 225144 - DNA, 411 bp, Homo sapiens
tagaggcggaagaaaaggctgaggtggattcacaggctctatagatagagaacagtgtagtgctgaaaaggttagagaggtcttttgttctgacaataatgaggtagtttgggatcttggatttctgaatatgacttggatgacacataaggagatgggtttcccccatttcacttacccaagtgtaggtagccccaacacagttaggtccttagccttgtgaattgttgaacaagtgttgtaaacccagaatttctgcttctacagaaatgtccttctttgcctaccagtattagcatttggatatgtaattcttgctcgactttttttgttacttaaccagaatgacagtctttcccctatcttccttctttattcttatcttctacctttccctcccaaactctttcc

SEQ ID NO: 225145 - DNA, 418 bp, Homo sapiens
acgtagaactgacatcatacacttatcccatccagcctatacgcagaccctcattgcttcgtccacataggcctcattctgcacccctgttccattgtgtagctggctttgcagccctgacacgtttgcataaatacagtcctataacccctaccctgcatgggccttcacaagatcctgaactcttcacaaaaccaaagttcatccttttcatccaactcaaaataatatgttaagcctctcaggcagagttccctatgttcccaaggggccactggtctctacttcatagtcctgatcaccctgagctgtgcctatctatgtccatctatgtctccccctcagagaataagcactctcagagcacaggacttgcctgcagctcctccttgggagctcagaataaatgactgagtaa

SEQ ID NO: 225146 - DNA, 468 bp, Homo sapiens
agaggaaatatattgaaatcgacagtgatgaagagccgaggggtgaattactttctcttccggacattgaacgccttcataaaaagccaaaatctgacaaagagacaagactagcaactgcaatggctggaaagacagaccgaaaagaatttgtgaggaagaaaaccaaagtgaatccattttccagttcaaaaagtaaagagaagaaaaaacagaagaactttatgatgatgtggtatagccagaatgtctggtcagaaaataagcgttccttctgagaaaaacagttggcgctgcgagatgccttttgaaaagagaaaaagaatgaagtaacttcccagaaagttttccattccaagaagaatgctaagtttgtgtcattactctgaaaattggtaaatcaagcatgtttgtttacattaaaaagtccagaagcactatattatgaaaactgctgaaaatgtggca

SEQ ID NO: 225147 - DNA, 453 bp, Homo sapiens
ctgtgggggtggtggagcgggaggaagggagggggtgacccgcgagtctcactgccgctcatcaataggaccaagcgttgtgcaagcggaggactccgggtcaccaccaggggaacacagagcatcacaactgcaggaggaaaatggggcaaggaaagatgatgcaaagttcccgtgcaccatctcggagccgggaagccacagccccgggaagcacctcccgtggtgcccacacggcagaggggtcctcagcgggggtggcctctagcctctgtcctaccatgtgtgtctcaaacgcacccagatcctccaccccatcgaggcttactcattgggaataggagatctattcccgggaggagctttgtatcggaaaggaggatgtgtggttcctttggtttttaaaatacctactttattaaattacaaaattttagaaacctagtttttcct

SEQ ID NO: 225148 - DNA, 446 bp, Homo sapiens
aacacatattactgtgttagaattgcctgcagtgttttcagtacagtaacatggtgtacaggtttgtagcctaggagcgataggctatatatcatacagcctaggtgtgtagtgggctatatcacttaggtttgatcaatgattatcattcagtcttgtgtgaattaaatgtaaagaactcaacagaataccaggatcataaagtatattcaacaaatggatgcaatcattatttttaactgcataatggcagagacagccacccatagtaagaagtcacttttgctcaggtctcttcatttgagatttgttgtatggagggaaacccacgtagtgtgttacacaaccttagtgagttggctttaaacagctttcttgtcctctccagtagcagtacatccataactacttcccaaccctcagtggccaaggttggaatgctctca

SEQ ID NO: 225149 - DNA, 94 bp, Homo sapiens
gtatatggtatgaaatcaagatcaagcttgaacaagaagcctgtgtcacacttttttctgtgtcaaataaaaagagactttaattagaaagaca

SEQ ID NO: 225150 - DNA, 471 bp, Homo sapiens
ctcttgttgccagggctgcagtgcagtggtgcaatctcggttcactgcgacctccgcctctcggatgagaaaatttaaagaagacgtgtaatttctccaaagtcgcccagctcagaaatgccctggcggagaatgtgaagatgaggccagagggaacattgagaagaaggatctcagagaagaaggaaaattcagcagaacctaggaagtgcaactgctattgcctgggcctttgttcctggaatggactctgagagtgcatgatgcagcttggaggacgtctcctctgggatccctccccactgcccccaccgcttcctggggtgaatgagtcctctgtagccatcaggattcgctgtatcaggagtgttcctctgctgtcacctctgatgactattttcctcaattcagaatccccagcacctgcaaaaggcctggataaagaaggggctgagcaggaacagaggattg

SEQ ID NO: 225151 - DNA, 700 bp, Homo sapiens
gggaagagcatttctaggagaagggtcaccaagtacaaaggtgatgatgaaggaggaatgggcttggcatctctcaaaaaactcagcgtttggggaatgtgagaaaagacttgtattttgggtaaatcatgtaatctttcagcttaatttcttataagatatctatatctgtaatttcttgtgatgattgaatgaaatcacatttgaaaaagcttttcatataggaggtactcaataaatataattggaatttgttgcaaaagagagaggcaggaaggacagtaaagaccagacgtgtgcagctggagcatagtgagcgagggaagagctacgttagaagaggtaggagagggcagccagggccttgaggtcactataaggagttgatattttattctcgaggaagtaggaaatgcctgagggacttcaagaagcaggatggcatgagctgagttaggcttttaaaagtcactctggctgctaaatacagaatgatttgaagggggcagtcagagaagtaggaatatcaggagtggtggtctgattactctgagatgtgtcttgattctattttgttttctttgaaattccttgtctcctagtttttcatagcttttgtagttatctacacttacaatgcccaacaagctgaatacagtctccctaccctttaataaattagtgtagctttttagtgcag

SEQ ID NO: 225152 - DNA, 484 bp, Homo sapiens
aacattgattcttctgtttaaagaaaattgatttcctttggctgaaaaagttttgttctctctctcttggtgttcattattttagatgttccctttggactctgtgcacatccccatcatagaacctactatatttactatgatagtaaattgacctctctgccaacaccactggaccatgtaagttccttgaaggcaggggtccctagtgacaggcagagtaatatctggtacattgtagacactcagtaaatgtttgtgaaatgaatagagtgaccaagcaatctaatgaatatggtcctatcatggtcccaaccagtcattggactgagtatagttttgatggtgtcatctcaaatgaacatatctcaaatcacatccaggttcagcaaattttcttctctgtcttgccaaggtgggggccccactctgagtcccagagatagaaactccagtcatctttgcatttcttttacttccttag

SEQ ID NO: 225153 - DNA, 427 bp, Homo sapiens
agccgctgcaccagcctggtcgatatctttgtattaatgagtcaagtgatgtctttgctgaattagataatagttttcaaatacctgtactataagaatattttctcaattgtcctgttcccaatgtaatgacttcaggcatgacacgctttttaagtttaattgcattattaacattttctccatcactttcttaagtctaaaccccaggagttggctaactttttgtaaagggccagatagtaaatattttcatctttgcaggccatatggccgtagagcttctgttgtactgctatctttgtagcacaaaagcagccagagacagtatgtgagtgaatgagcgtgactgtgttccagtaaaacttgatgtggttaatttatgtcaatgtgaattttacctcaataaacagcatgtaaaatgaaa

SEQ ID NO: 225154 - DNA, 179 bp, Homo sapiens
caaatgtttctgtacttgctccgattgccccattgcttgtacttctgtagtacttgtgagccataggatcttttctcaaaagccttgataaagaagttttataaacttataagatgatttaatgtagtaccataaaattaactgtagcagtaggctttttcaggaagacatgtgaaata

SEQ ID NO: 225155 - DNA, 622 bp, Homo sapiens
tgttactagaatgtttaagggaagattagactaagtcacctgcctttttttgctcctgggtgcaggtcccttaccacctccccatcccacacctcacctactgccatggggagtgttaaccatcttatttccttttctgtaaaatgtgggaacattttcaactatttaatcaaatctttaagaattttagtgattataggattgtttaggttttctgttgctttttaagtttgcttagtttatttttatgtagtactttattttacaaaaattttcaaagttactggcaaaagttgttcacaatattgttttcttaaaaacatatgatgcatttaatttctaataacatttgtctttgccttatttttaaatcaattttaccctaatttcattttcttcaaatgtaggcctcgttgattctttttacttttgtctctttatgacttcctgccttttatttatttatttacttatttatttatttagagacagagtctcacactgtcacccgggctggagagcagtggcaccagcttggctcactgcaacctccacctcccaggttcaagtgattctcctgcctcagcctcccaagtagctgggattacaggtgccccccacc

SEQ ID NO: 225156 - DNA, 581 bp, Homo sapiens
tgttactagaatgtttaagggaagattagactaagtcacctgcctttttttgctcctgggtgcaggtcccttaccacctccccatcccacacctcacctactgccatggggagtgttaaccatcttatttccttttctgtaaaatgtgggaacattttcaactatttaatcaaatctttaagaattttagtgattataggattgtttaggttttctgttgctttttaagtttgcttagtttatttttatgtagtactttattttacaaaaattttcaaagttactggcaaaagttgttcacaatattgttttcttaaaaacatatgatgcatttaatttctaataacatttgtctttgccttatttttaaatcaattttaccctaatttcattttcttcaaatgtaggcctcgttgattctttttacttttgtctctttatgacttcctgccttttatttatttatttacttatttatttatttagagacagagtctcacactgtcacccgggtggaggttgcagtgagctgatatcacgccattacactccagcctgggagacagagcgactctgcctca

SEQ ID NO: 225157 - DNA, 473 bp, Homo sapiens
gatgcaaaataatgaacagtaattaagttttccatcgtttctccccactatcactgggattttcctgagaccttaacagtaaatgtgaaaataatgtgtggccctacagccagacacccttatcactgccctgttcaccttccctggaagaggcaagtaggcatggctgttagaaacaaagggttcagatttgggctttccaggttcagatcccaatatctcagtttactgggtgtatgacctttgcaagctcattaacaattccaagcactggtttttgcagtggtacaatggggatagtaattatactaacctcctaggatttgtgggagcattaaattaagataatgtagtaatgtccctcacacgatgaccagtgcccagaaaatattattagcatcattatcagtccagtaaattgttttaaaaaccaaaaagacactagtggaaattgatttgtggtgtttcctggc

SEQ ID NO: 225158 - DNA, 405 bp, Homo sapiens
gagtaagaaaaactcgcagcaaaactaggaattaaaggataagaagaagaactgtatcctataaaatgactgagaaggatcagccagagaggtgagaagaaacgcaggtcagtgaggtgtccggaaagctaagtgaagaaaatgctgccaggagggagtggtcaatatgcaaaggtccatgatgtccactgaactgagcagcaaagggtcattggttatctctgtaagagcagtctgggcagaatggcagatgttgagtgagcaagttaggacagcaaatgtggacagtattgtctagaaatttgcctgtgaagaggaggaaagataagggaagtatttgaagaagaacattggtcaagaaaggtaggggtgtgtgtgtgtgtgtgtgtgtgtgtgtgtgtgtgt

SEQ ID NO: 225159 - DNA, 382 bp, Homo sapiens
agggcaaaaagaccaagcgtgactccctgtctccccattgcatcctgattgtctccctgtccagggacagaataaatatcctcaagacattgactcttttcacagtgaagaagctgaggttggagctttggcctcatctcctataggttcatgctgcatctctgatctctacaggcagggagaaggtctttcctgctccccttcctcctggcacatgacaaaatcctagtgccttaaggtctgcaggaggagagagtttatatagtgttttccagttcaagttccttatcatataatcatactccccccacctgcatctcctttgttacactgtgcacatattaaacatcacaataaagtacgtgcatcctgctgcctgcgt

SEQ ID NO: 225160 - DNA, 471 bp, Homo sapiens
actacttcctggctgtgtgactgaaggtaagtccaatcccctcctccattttctcatctgaacactaggggcgattgtagtactgctctcatctctggttatgatgatatactggcaatgcacataaaacatttggaatggagcctagtgctacagatgaatgtttgtgtcctccccaaattcacatgttccaatcctaacccccaacttgatggtattaggaggttggatgtttgggaggtgattagatcatgagagtagaaccctcatgaatgtgattagtaaccttataaaagagtcaacagagctccctcacccctgtgccatgtgagaacacagtgagaagatggccctctgtcaaccaggaagcagaccctcagcacacaccaaatctgctgcaaccttgatcttggatcttccagcctctagaactgtgaggaataaatttctattgtatagaagccacccagg

SEQ ID NO: 225161 - DNA, 413 bp, Homo sapiens
cccattgctataaaaaataaaagattagctgggcatggtgacatgtgcttgtagtcctagttacttgggaggctgaggagggaagatcgcttgagcccaaggattcaagattatagtgggctgcgatcacgccactgcactccagcctagatggcagagcaagaccctgtctctaaaaaagaaaacaaaacaaaaacaaataaaaaacattaaattcagcacatggagaaacagggctagagttacagaatagaaattcatccatggaggggcagggacaggaatagatgaaaatgccaggaatcctggggaggcagaagaggccaaggacagagctttgaggtggtcacgtgttcctgcccagcctctggtcctgctctcctctcgttgatgtctagaaaaacattcttacc

SEQ ID NO: 225162 - DNA, 188 bp, Homo sapiens
cgtgatagctgttctagagtatcccttgtcatgcagtgactgcagagtcacttccccaggcctcccatagaagttgggtgccatcaacatagggaaataagaaaagcttaaatgtaaggaagggtcttgtctttttctgtgcagaaaaaacaagaatggcaacacagatgcagaaaaatagagccaga

SEQ ID NO: 225163 - DNA, 378 bp, Homo sapiens
actaatttcctgaaaagtatgttccgatagatgaacagatcattaatgcagaatgagaatcactcctaaaataggtaatggtaaaaattaaattgacaattacctctctctatgcagaaggaaatatcacctatatgacatcatcatcatctattgatacttgctggcagtgctaatattgtttttaatgccaatttgtaagaagttttatctctctgtcactgacatcctacagagtcacttccccaggcctcccatagaagttgggtgccatcaacatagggaaataagaaaagcttaaatgtaaggaagggtcttgtctttttctgtgcagaaaaaacaagaatggcaacacagatgcagaaaaatagagccaga

SEQ ID NO: 225164 - DNA, 469 bp, Homo sapiens
atcattgtctgacccccatgtccagatgaggacacagaagccccatgagtggaagggatttgcctcacgccacagtgaacaaggggaagaggcaggatcagaactcagggagcctggccgcaagtcctgcactgctcacaacaggctccagctgccctcgtatgaagacaatagctgtaaggatgaaggcacacaaaatgccaagtgagagctctggctacagtccctctcaccatctcccaaggcaaaccctgcggctgtggccttggctttgccagaaactgattccatgctgctcccccaggggacctcgaaactgcaggtgtgccaggacattcctggctgacaagtgcggggtcgcaggagggctggacggcgtgcctctgtgtccatcagctccttgcgtgggtgcgctcatgtacggggtttaatgaatgaaatgattaaaacctggaaaaatgtgtattga

SEQ ID NO: 225165 - DNA, 458 bp, Homo sapiens
aaaaaaagtgcctgtttagatgcaacttttttttcaaatattttccttctgtgattggttcaatccatggatatggaacccacggatacagagggctgactaatttaaaattttcgacctaattaataatataattattaagctttctgacctaagagataaacgaatacacacgtgcatgtatatgaggataaaatggtgttcatgggcatacaaaaatttatgaaaacattttatctgataaaatatttgagataaacaatgccagtgataaaatctttagtccagaaagggttctgcaaaaagggtggtgtagattctctctaaatcagtactcgatgaagtaagtggaactaatggaaaaaggaaaactgctgacagtatttggtgtacttggatatatctgctaccttgtttgcatgcataaaccaactcattctgtgtgtgtgagacattga

SEQ ID NO: 225166 - DNA, 469 bp, Homo sapiens
ctgcatgactcttcaactgctacctgtcaatagaccagttagtagtagagaaatccagatccttagagaagagggctgtgccgactcctaaccacagtgacccatcctgtgggaaatgcaaatgtatgtgcctttgctgttcacgcacggaggtgcttgattgatttgaaacattcctcagtgatttttaatgaacttatatcttaccagtagttccaaattttctttttgacattgtacttaattcaggactcaaattcaggactcatggaaatcagttaaccaccatatatattttttttatttactctaagatactgagtacctacattgcactagacatctttaaatcaatcatcttctaaatgtctcaatctgttttccttccttttcaatttcatagtcactgtcctatgacaggcctttataatttctcacctagataattattgtcctctcttaagtcttt

SEQ ID NO: 225167 - DNA, 382 bp, Homo sapiens
ttaggtaaatgtcagccgttctcctcatcatttggtggagggtagcagagggtcccctactcttgtcccctgccagagctactgtggccagtgccggcctgtgggatgggtcatgagcagatagggctgggggggtgtggagccacacacagtatggacatcctgggccagtcactcgcccaagcctgcctgctcttctgtaagatggagagaacaccaaggctctgaaccatttattgccacagtccaaggtgaccaacggtcccagtagctccggactgaggggtttcttgggatgtgggactttcagggctaaagccagacagaatttggcaagtagaatggcgggtcacccgacacggatcctgttgactacacaaaa

SEQ ID NO: 225168 - DNA, 400 bp, Homo sapiens
gagtacggctacacacatcttccttttaaatgatcacttttgtttggagatttggacttgacatttcaggccattagctcaccatccatggcctgttatggaaacccactcctgcatccatctgtattaagattgcatttaataaaaaagccatgaattagtgaaaaaccagaaactgagttgagcccatctttccatatgtttgcctgctggcggtctggagctgagttctttcctctcagacagggctctgctgttgggatggccatgtgcttgagcggagggtggcaggagggaggtgggaccaggccaggctctcccaggccgggaatgagggagctagcacatcaccagcgggtctaagggtttgtggaagctgcagtggggacccagcattggg

SEQ ID NO: 225169 - DNA, 128 bp, Homo sapiens
gatgggtcagccacgaacagccagattgtttaaattcttcctctttttcctcctgctgcactttgacctggtcgttcaagattcttgttcccaggtctggagggtgccatgtcaaatgcgcatctgaa

SEQ ID NO: 225170 - DNA, 1037 bp, Homo sapiens
aaattttcactctatataaattaaccatgatctaatttgctaataaaatgcatttatttattaaaatgacattcctgaattagctttataggacaatatacacacatgtgtacatatttgagtatatatacatgcatacatacactaaacatatatgttagagtattggagagacagcaaggcagtatggttatggctacgtgttattcatccacacatttacaaccaaaagtataggtttatttattgaccaattagatatggccaaatgaataaccaaaatagtacattttcatcatgctgaaatctttccttttaaaaatgcacttgactaagtttctcttttagattaacctacaattttatttctacattcagcttcatttttggaaacatttgaatagactaaaataaattatttgcagttgtactgtgagttcaaagtaatctcaagtacgttaagacctcccattgttgtggatcatattttccaaaaatggctacaacaatattcctagtccgacagacccttgtaactttccagccaagagtagtttatctctcctctagacacagtttttaaaacttgatggacctttgtgaatgcttgaacaaatagaatgcagcagaagcgatattatgggatttcggagaacatgtcataaaaaaatatatagtctctctctcactttctttttctccatctctcattctggaaccctgagcaactatgtaagaagtctggctgccatgatgccaccatgctggagggaccacatggacataccatgaagatatatagagaaatgctttagaaacctcagctgttccgtctttcagctatttgagtcttcctaggccaagggccagatatataaacaaagaagacttgatggtgactccagccttagtcaacgtctaactgcaaccacgtgagagactttcaaccagaactatgcagtggagctgcttctgaactcctgacccatagaaaccatgaatgataataaatgattgctgttttccttaaatgtttg

SEQ ID NO: 225171 - DNA, 177 bp, Homo sapiens
gctgtgacgcatagccctggcaggtgctttctcattgtcatctgtctgaccgactgggcagagcccagctccagtggctacattcaatgttcatgcaccctctggagctgtgccaggctgtgaacctatttacaccctataatgttctaactttactggagaaaggactgaaacagt

SEQ ID NO: 225172 - DNA, 667 bp, Homo sapiens
atataattacattttattatatcacattcttgtttatattgtaacattttaataattttgaatacattatttacaatgtttatgggcaaaccttatagcagtctagtgatttaacaagtattaacctccccaaattatagctgaggaaatgacgcatattagctccattttagtagcatgcatttgaagtcgattctcagtagacagagccatcttcacatgattcttagaaatgaacacatagttactttcccgagaatatgattgagaaagttagtcttcaagaatctgaaattcaaactgaaggcttctgtctcccagtcctttgctgaaataaagaaaacaacaaaacataatgggaaaagtaaggaagattcaattaaaggtaggcatataagctcctgacagaaaaagaatacatgctaaatagaaatgatggtatctcttaagataatttatgaatttaacaagactccaattagggtgccagaatattactttacatatcctcacaaagtggttctaaaatctgaacaaaataagtaaatgaaagggcaaactagcaaaggaatcatgaaggaaaacatgtcctaccaaattcagaacatgtatgaagtgagaacttttcaaagagtaccatagagatttaaaatatgaaagtaaaaaa

SEQ ID NO: 225173 - DNA, 982 bp, Homo sapiens
aaaatttgttgcacagaatgactgaagagaagacgctgactgctgagggtttggtaaaactcctccaggctgtgaagacgactttcccaaacctgggccttctgctagagaagttgcagaaatcagccactttgccaagcaccacagtccaaccaagccctgatgattatgggactgagctattgagacgctatcatgaaaacctctctgagattttcacagacaaccagattttattaaagatgatctcacacatgacaagtttagcccctggagaaagagaggtcatggagaagcttgtgaaacgtgactctggttcaggtggtttcaattctctgatatcagcagttctagaaaagcagactctctctgccacagccatttggcaactgctgctggtggttcaggagacaaagacctgtccattggacctgctcatggaggaaatacgaagggagcctggtgccgatgctttcttccgggcagtgaccaccccagaacatgccactttagaaacaatcctgaggcataaccagttgatcttggaggccatccaacagaagattgagtgcaagctctttacctcggaggaggagcacctggcagagactgtgaaagagattctgagcattccctctgagacagccagccctgaagcttccctgagagcagtgctgagcagagccatggaaaaatcagtcccggccattgaaatatgccacctcctgtgcagtgtccacaaatcttttccaggcctgcagcctgtcatgcaggagttggcatacattggtgtccttactaaggaagatggagagaaggaaacgtggaaggtgagtaataaatttcaccttgaagccaacaacaaagaagatgaaaaggcagccaaagaagacagccagcctggggaacagaatgatcaaggagagactggttccttgccaggacagcaagagaaagaggcttcagcctccccagaccctgc

SEQ ID NO: 225174 - DNA, 305 bp, Homo sapiens
tttctaatagcattgaatacacacacatataaaagatattgaggtattactgagatgcatgtgatattcaaaaaagcaaaaacatttgagtttctaatgttataaaggttttaattcttctaaaattaatatagacttgaaatatcaatacaaaaacccaatgggatttctttttgacagctagtatgacttccctatgttacttcagaattcaagtttgtgtctgcctacctctgaatacttattagtcagggttggtgattctcagtgataaaggcatatgaaagaagcagaatgatgtcaga

SEQ ID NO: 225175 - DNA, 578 bp, Homo sapiens
ctcactgtaaatcctcaatccatgttagctttttgtaacattaataacatagcaataataatttgtagcttgaataatagtaagttgcctaaagagatgtagctaaggaagtctgagttagcctttggactctgaactgcctctgcatttagcacactgatatgcagagcaagctgtatccacactgatctcagtgtgctgcagtttcaaaagctgttcagctgggatcaaggaaagcaatgaccgcctactccccaaatcctttctatttcgaaattcccaggtcaatgatgaccattgccagagggtctcaggaaggtggaatccacatggagagttggaaaagggaggccgaggtgggcagatcacctgaagtcaggagttcaagaccagcctggccaccatggcgaaacctcgtctctactaaaaaatacaaaaattagctgggtgttgcagtgggtacctgtaattccagctacttaggaggctgaggcagggagaactgcttgaacccagaaagcggaggttgcagtgagctgtgattgtgccactacactccagcctgcaaccctgtcaca

SEQ ID NO: 225176 - DNA, 546 bp, Homo sapiens
atgccatttttagcaagtgctaactttccacatatactggtaatgttttctagattttcaataatttttcactgatttaactctgtggcaatgccatgccattttgattattatagctttatggtcagttttaatatctggtgaagaaagtctcctctcattcaacttaaaaaaagattagcaatcttcgcatatttttccttccaaattaattttaaaataatctttgtcatttatttaaagcttggttttcttgccagaattgtattaaatctctatctaaaatatctataaaaaatagatatttgtatattacatcttctaccaggatattttgttgtttatttttggtcttttggtattttttatcttttttttttttttttatgtatttcgagatggagtctcacacagtcagccaggctggagtgcagtggtctagggtccaggctctggacaaacctgggttcaaatcctttctcttcctctctctaagctatgtgatatcggataaatcactttacctctcagaactgcacttaaaaa

SEQ ID NO: 225177 - DNA, 652 bp, Homo sapiens
caaagacagttgttattttatgtggaatataataattacaggaagcaatgctttgattaaaggcattggcacctcccttgcaagcattgatttgctaggttcttaaaacttcaactgccagtgctctatgctgatcttagtagttaaagaggacaaggctcattttgtatagagccctgcttctcttggctttggcattttctgttgtttgaaaacacacagactaataaagatgtctgcgtattttgtttaaaggcttgcatggcataggaaagaaaaatagttttagattttaaaaagttgaaatttggtgataatttattttggatcagaaataaagctttgtgaaaaaattataacccacgtatgtatttgaggattgctgtctgattaaaaagaaagctttttatttcttcccctttaaaagatcacgttaagctaaggaaaatcctggttgatgtttttaacagtaataagatgtacggggcacatatggtttttaaagcccttttatattctgtcttatttgattctgaataagctaagttggtagatatgtgttcaattccatcacagtcaaaaggttactgacagagaatcacttttgaagtataaagaaataaattattcaataacacttaatttctagaaa

SEQ ID NO: 225178 - DNA, 439 bp, Homo sapiens
gggtattttcttttgatttttagaattttacttgtaaacatgctacatatacatataatttggtgccctgtttttccatttacatattatactttccatattagtacattgtctgatatttctgcataatactcaattcaacttacctgctattgtttttatcatatctctattacaaacattaggcccatttcccttttttaaaagaggaaagtttgaggttatgggcggtgttctgataaaataaataatattttgtcatgtttgttttttcattgattaggaaacattgttttgaatttaatgcctcaaatttggtgcacaataatttgaagggaaaaactgacaagtttgaaatgaacattgatattacataatttacattaaaatgatacatcttttgtaaatttgtaagaagaataaataaatgaaaacctga

SEQ ID NO: 225179 - DNA, 187 bp, Homo sapiens
cacaagttagtacaagtttattttgttgcaaaacaatttgaaattcatgcattctttttcccaatatgcattttccatgaacgttctaaagatcactcatccttcctccccatgttgtctattcaatgtcagggaggatgtgaccccacccactgctcacctttgtctcccttctgtccccaccatc

SEQ ID NO: 225180 - DNA, 380 bp, Homo sapiens
tccaatagaagtttgagttttaggatcagcttctatgaagcagaagatttcactgagctagagaatcttttcactcctttggaattatttgcaaaagcacttattgttaacacattcttagctcatgagttgaatttgaggcataagtacaggtacgtattgctatgtatttttgttctgtaggtacatatttttatttgacatgttggtaaaattttaaattgtagtttgaaatattaaactgagataatagtaaatgcataatgtaatgaattgtgaaggtatatttgtatactacaccaaaatggaagctgtttttaaatatatatatacaattttcttcataataatctttgatttattcttttctaggaaactgt

SEQ ID NO: 225181 - DNA, 391 bp, Homo sapiens
tcgctagctcggatcccagggcagagggtcggaacacggtgctcttggtggctccgcgcaggggtgaggcgagcgcgtggtggcggagccttccggagaccgctctgagggtggcggagaatcaatgctgcctttgtgctcggtggtttccgagggagaaaaggagtggagagtaggaggggcgacccaacggcccggccccgccctgcagacgcgggatgcggtagggctgggaggcgcgggagctggacggtcagggctactgggggtgggattctgtgtccccgggaggtgcgtctccttggaccagcccagggtgtcctgaggtcagcagccaggtgtgtcccctggctgccaggagcagaagtgagtcctcttctggcttggagcg

SEQ ID NO: 225182 - DNA, 590 bp, Homo sapiens
cgggtgagatctctttctgtctttgcagtctcttagtaggttgcctgtaatgtatatcagattctggtttaatatttatttaataagaaaactattttctttctctattacatttgtggagagactttctgggttgggaggagactttgtttttaatcgtatttccccaacagctaacaagcatggcacctatgctatgaaatctatcaccccattcacttccatgagccgctttcagccaaagacagagaagggggcagattcaatggtcaggcctgctcctgggagactcaggactcctctaatttgcaccttgggcttgataactccctactggacatcttgaaatgttctcaggactgcactgctgcctaagaccttccttctttccctctctctctccttcacaggggtcaaagttatatcctagtacaatagctctgttcacctttcgctctctccttgctttctcatataggcatttatcccaatgactgccttgcttctcaggagatccatgaagacaccatattttaatgtttctagcttataactaaggtgaatgaataaaaaacatttaaatcttaagg

SEQ ID NO: 225183 - DNA, 427 bp, Homo sapiens
ttctgtctcactgcccaagaccctcagggatatgtacgcatttctgagaaggacaaaataaggagaatatccgttttgttcactgctgtatgcccagcgctgcagatggtgactgacatatagcaagtgttcaataagtatttattaaatgaatgaacgacattaaatgactggttattctaaaaagtgatgtaagcagatggttgttagattattgcagaggcaaaatccagagaagtaggatttggcccttctagtctctgctgccagatagtcctgcatgctgaatgaaatacatccaactacctaatgatttcaattcactcacctgtgacaccacagcccaccaaaaatcttggatatttaagaggggttttgtggggtaggggtgaaatagatctctgcttgcctctggattaatctcaaa

SEQ ID NO: 225184 - DNA, 507 bp, Homo sapiens
cagttaagatgccttttcagcattttgttgcttgtttgcagaagggagagaggtaggatcaagaatagtttttactcctgcagagtcgagtgcgagacttggaggctgagtccaggcgctctcccctccccgccagtcccgtgtcctggagcaggtcactgacctggttcctcgagtgcgacagcgcagcctcatcgtaataaaccgcctcccaaagcgttgtcagatcaaattccagaacatgttactggaaagcaccttgaacactctaaactgcagcacagttattagttagcaatactctttggggtttcactggcaccttttctaacaaataagattgatagatgcctgctcaaacaaattgaagtgcttgtctcagatgacacacttggcaggcatgggacgttcacaggccaactagagagctaatttcaaaactgagatataaaagtgtatcgctgtacttacaagttaccaagtgttgagaaattactcactttcaaa

SEQ ID NO: 225185 - DNA, 410 bp, Homo sapiens
tgggcgcagtggctcacgcctgtaaccccagcactttaggaggccgaggcgggcagatcacttgagctgagtttgaaaccaacctgggcaacacgacgaaaccctgtctctataaaaatatgcaaaaattggccgagcacggtggctcacgcctgtaatcccagcactttgggaggctgaggcgggcggatcacaaggtcaggagatcgagaccatcctagccaacatggtgaaaccctgtctctactaaaaatacaaaaaattaactgggcgtggtggcacacgcctgtagtaccagctactagggaggctggggcaggagaatcgcttgaacccgggaggcggaggttgcagtgagccgagattgcgccactgcactccagcctggcgacagagtgggaatccgtctc

SEQ ID NO: 225186 - DNA, 550 bp, Homo sapiens
aatctggatgacttgagtttgggggacttttaatcagaatcatttcatttctctgtattttatttggaaaattttcttagatgcctaaatcagatggtatatacagtgggctacagtaagcttagtgtttgcttaactttttattgaataagttattagttatgtacaacgtgaagccagacaaagtatatatactttgtagaaatatatagagtagtagaatatcatacagccattctttgatgctttctcttagctttaaaaactgtttatgtagcgagcagaccagtttcaggaccagtttctccgggtcacagttgagagcttctgccattggacccctgcctgacttcagcctggccccccttctgctggtattacaacacccggttttaattatcagtctccttatctgtcactttcattagactttgggcttcttgggtgggcctgtgtcctgaggacacttctgtcttgcaaagagaagtccacacaggtttaatgacttccctagaggcctactctcttggcccagaataggcagatgaat

SEQ ID NO: 225187 - DNA, 347 bp, Homo sapiens
tattctgtaatgaagatgggaaagaacggagtactgatacacgctacaacatgggtaaactgaaaacattattacgtgaaataagccagtcataaaccacatattgtgtatattttatccataagaaatgttcagaataggcaaatctataaaaatacaaagtagatttgtagttgctgagggctgggaaaagggtttggggagagaaatgactgctaatgggagtatgggatgttcttttggggctgataaaatgttccaaaattcattgtgtgataactacacatctgtaaatatactaaaaaccactgaattgtatccaataaagtactaaattgtatgatata

SEQ ID NO: 225188 - DNA, 1311 bp, Homo sapiens
gaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaatcagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggac

SEQ ID NO: 225189 - DNA, 412 bp, Homo sapiens
ggcaaaataactggaagactccaaaattagacgtttggttcagagacattatttaaccatatagtataattcatgcaatggaatactatgtaatcgataaacatcaggccagagaaggttatttcaaacttggcaaaagattataatgtattgctaagtgagaagtaggcgccatacggcatgcatggcaaaacaccagtcagggaggaaaaattgacatatgtaaaggaccacagaaaagtagccagaaagaaacataccaaaatgttaatggtgattataacagtggggagtggaattatgagtatcagatgattttaaaaatatctttgtgtttttattagttttccaaggtttctgcattgaacagatactgcttttgtaatctaaaaataaaaagcaataaaaaata

SEQ ID NO: 225190 - DNA, 1031 bp, Homo sapiens
ggtctaaagcagggagtaatatgatcaggtacattgttcagaaacattcctccagctgcaccgtggaagcgggactgagcgagcaagtgaagtggcagatccagttatgtggctggtgaggtgcatgagaggagatgatagtggccggaggtgtggcagtggaaatggagtgacacggttatatttgagggcagagttgatagtacttggcagctggctgggaatgggaagagggagagctgaagaccactcaggtttgtgtcctgcagcaggaagtaatagcaagagcagactcgaggtgacagcgaggacgaaaccactgatgtgtgtgagggcctgctgtgtgctgggtactgtgtccctgcctgttgactaacttagtcgttgtgagcaccccatgcggtggatgcggtagtatatctatttgacagacgaggaaaccaaggacaaagaggttgagtaacttgcccatggtaacccagcctggtcatggccgagctgggattcaaacccaggcagcccagaccccaaagcaccacattgtgcagctgatacttcatctccacagactgtcctaccatatttggcatagaatttaaaaatggaaatgattcttggtagcaacacgaatgtagtggagacacacagacctgggttgtaatctcactcagccaattcctcttagtgagacctggccataccacccaggttttcagaagcttagtttccacattaaataaagtaagaggccaggcgtggtggctcactcctataatcccagcactttgggagcctgaggcgagtggatcacttgaagcccggagtttgagaccagcctggccacatagcaaaacccaatctctaccaaaaataacaaaaaaataactgtgcattgtggcgtatgcctgtaatcccagctatgttggagaccgaggcacaagaatcacttgaacccaggaggcagaggttgtactgagccaagatcacgccactgcactccagcctgggcgacagtgagaccctgtctcaaa

SEQ ID NO: 225191 - DNA, 811 bp, Homo sapiens
ggaactgcaagttcccacgtccacccccgccacacccacagcctgccctgcatacaccactgctggagatgtagccaggacagcttgccctgtcccctgaccccacggaccttgttaacaccgctgctcccctcggtgatatttacctgtccgtggctgtcctgaccaatactcccaaggagacagtgcatcactgggccaacagggcagagccccaggggaccactccctttacgacatggacggacactttaggagtgacggttaccctctccttggatgaggaggggctccaaggatggacatgtcagtctcacctggagggagaggggcagtgggtgggggcaacgctcagtggctggtggacaggcaaggggtgagtgagccctgcccaactgactccattggcggccactggccttgcctggcattcacggaacaggcgcttcataaacttgttgcttcaatgtgaaatcacctcaattttgtaaatgcgtctgtagcatccacaggactcatcatctagaattcaaacccttaagggtaaaggctgcgtcttctgtttcctctgcgtcttctcgaagcactgtgtgtaagggccagagcacagaggatgtttcatacacgtgcctttgccctgagaccgcagccctgcctccccggtcccacgcagacctcatggagtggcctccacttcggggcttggtactgctgtgtacggaaggggcggtttctatgggaaacatggacaaacagttctatttggaataagcaaccacagggtgcccacccagccatcctcccaaagatt

SEQ ID NO: 225192 - DNA, 433 bp, Homo sapiens
ggtatttattttgtaatcctaatgcatcttagagttgtgtgtattttatgtggtactatttctttttcctccaaaaaagctgctattaaaatgactgcgtatttcagaattcatggagtcttggaatttagagaatatagcacacatatatttatgtatacacttatagtttatatgcacatatatatttagatgtgtgcctgcattttccccttgatattatatcataaacatttcctggtagtattagggtctaggcacttgtaatgtctaaatcatattaatttatgtgattgtgactttattgatatgattttgcttcagtcacttaggttgcttttagttttttgactaagtgtagttaacattcttaagaatattttttgctagttttctgtctgaatatccaggacccatttcgatctgtattctt

SEQ ID NO: 225193 - DNA, 402 bp, Homo sapiens
agattttttttttttggaggaattgttttattgagtggtgttaaattgtgacagtatccttggtcataatttttatttgctctgtggcaacatttttctgctgagttttctttcactgccatgtgtcccctacctttgctctctgctgattattacttatatttgaatatcttgagttcttcttggactagctatttgctagtccagatatacaaaagggaaaggtcacaatcatgtccccgaccagcaggaaataacccaatttacttaagactcagggttacatgttgagttactttaggttttattagtacacataaacagagatcagaaactttaggggtgcttggagtgtagagtgctgtgcccatagtctttttttgaaaatacagtgcacctgta

SEQ ID NO: 225194 - DNA, 1130 bp, Homo sapiens
aagttgcagtgggtgatatgtgctgagtgacttggggtctgccccggcattcacttatacttgtttcttactaagaaattgaatgtgctttaagctgaaaattagaaagcagtagggaaggacaggctggatggtttgggttgttggtttaggaataaaatgcccttttgttttggtggtgggtgatgccatctatagaagggttttaggtcattgtgttggtgtctttccgtctttcccacttgagaccctcttgtaaatatggacttgacccacccattgtactcagaagaaacctcaaagattgtactctacaaagtaaataggttggtatcaatgattattggaactagagagccgaggacaagttttttgatgttgccttctttttatagtataaaatattctaattttaagtatttttgttgagatataatttacagacagtaaggtatacagatcatatttttacaattcagtgaatttgggcaattgtatcagcctttgtaactcacactcccatcaaggcccggaccatttcacctctgaaagatccctcgtaccccttcccagtcagttgacccctctgccccaggcagccactgttgtgatttatttcaccatagatgaggttttcttgttattgaacttcatataaaggtattcatgctactcttttctaaaaataaacaagaaataaactcgaggggggcccgtacccaattcgcctataggagtctgataaattaattgccgcctttaaacgtgtgatgtaaaacctgcgtacccacttaatcccttgagacatcccctttccaactgtctaatacaatagccctaccatcgcttccacaatttcagctgatgcaatgaaattaacctaatattgtaaatccgttaattttaataatcttttacaatagctattgtaaatctataataaaaataccggaaagtgatgtttcatttaaaaagcctttaaaactgcttatctatgctaatctttttacgagtcctttcttacactctaaaattttctctcagcctaaacatattctctaatacccttaactttggacctctctcgtataacaattaacgctctatttcattaattgcgttcagctccg

SEQ ID NO: 225195 - DNA, 600 bp, Homo sapiens
tgttagaggtgatctagaggacccctgccaaagcgtagtacccaacatacaagccatcagtaaatcctgccagctgtaccttccaaatatatttcaattcggcctcttttctcagcctttgccgcaccaccctatccaagtcaccttcatatctcatctggaatgatgcattcgctgctaactgttctccctccttcttatcttatgccctgcagtctatcctcagatcaccaataaatcaggttgcatctctcccttgtttaatccttctaacagttactgactgcacttggccctaggtgatctggccactggctacctgtctgacctaattttctaccactctcccaccttggtttctccattttagccacactgaccttgctgaccctcagaaatgtcaatgatacttccatctcaaacctgaacaattctaccccaaatacttacatagctctgtcacttcacatatggtctctacatcatgtctttggagccctttctggatcatcctaaataactaaataactaaaataatagccctgggctgggcgcagtggctcacacctgtaatcccagcactctaggaggctgaggtgg

SEQ ID NO: 225196 - DNA, 381 bp, Homo sapiens
ctcctaaacaagtgttcccagtatcagtaaattatacaacccagtgacctcaagccaaaaaattgtgatgtcatctttttcacacccaacatacaagccatcagtaaatcctgccagctgtaccttccaaatatatttcaattcggcctcttttctcagcctttgccgcaccaccctatccaagtcaccttcatatctcatctggaatgatgcattcgctgctaactgttctccctccttcttatcttatgccctgcagtctatcctcagatcaccaataaatcaggttgcatctctcccttgtttaatccttctaacagttactgactgcacttggccctaggtgatctggccactggctacctgtctgacctaattttc

SEQ ID NO: 225197 - DNA, 642 bp, Homo sapiens
atgggaagaatcctagattagggggagagaattttggttttagcctgaactttccaccactgtgctgtaagattcagttaggttaaatacttcgacctcattgagccactgtcttcccatttgtaaaatatagagatttggcagatgatcactaagatcataacctaaagaaaagaatgggttgtatgtgatagtaattactgttttaacttactgaaattcaaagaaacctgagtctgattaatttgaatgcaagtctgatgtgatacctacaaattcagcatataaaatgaatctaaagagtgctttgcttaagaaaaatctgcttagctgctcattgaccctaatataaaaacatttgaaaataataagatttaaaaagtaaggccaagtatagtaattcaaacttgcttgtcatctttaaaacaggtccctattttaacaggggttgggtggtggtggttgctgttttttaacgctttgaattagtttcttgattcagtggcaaagggtgatgattgttcttcctattgaaagaggtttttaccaacacctttgccatgtctgccctcaggggatttaagataagtagcaccaagttggccctctaaatttgcccccctctccctgccacagcattta

SEQ ID NO: 225198 - DNA, 379 bp, Homo sapiens
gttgcactatgttggccagactggtctgaaacttctggcctcaggtgatccgcccgcctcagcctcccaaagtgcggattacaggcatgagccactatgcccagctatgatcctaatcaaattctaatcctaattttgacatactttttgagtggacttgaattcaactgggaaccggggagcagagagtcaattttaggacaaccgacctattgaaagcaacctaccaaaaataattttaaacacccattgctctgtagtgacctccatcatttttgaacacctcttttgtatttgctctgatgcacgtttataggaaagtctaagcagagactgcctagcaaacctttttgtataatgattcaacacattttctaat

SEQ ID NO: 225199 - DNA, 313 bp, Homo sapiens
gtccaagtgtaattattaacagtgccccctttcactctccaaagagtccctgtccagacagttaattgtgaagtcgccttcagatggctggcggtaaggaaagtagagtgagggaagcagggtaggtggaggtgtgaaagggagagggcctcatctcagggtggctggacctgcaccagcatcggcctgcatgaatgtgctcctactcttgcccaggctgagtatcaagagaagcaagaaatctagataaaaatccaaatccagaaacatcagcgttttgaggttaacatgttggcaattattcagctttatg

SEQ ID NO: 225200 - DNA, 693 bp, Homo sapiens
taaaatctagcgaatgaaaccactgtgacttatgactcttctcctttcgaccctgaggcatagctcaggcaagtatcttcattacactcacattgcttcagtagttattaaggcaatattttctgacttacacagtgacttccaattcctcatctcataggttgctagttttatgtttttattatttattatttttttttagagatggggtttgactatgttgtactggctggtcttgaactcctgagctcaagtaatcttcctgcctcggccttccaaagtgccaggattacaggcatgagacactgcgcttgtcctattaatttttatatatttttttaagagatgggggtctcactatggtgtccaagctggttttgaactcctgagctcaagcaatcctcctgccttggcctcctaaagtgctaggattacagatgtgaactatcacgcccagtctcaggtcgctagttttagaaatgaaatctaagtggttttttttggtaaaattaaggtagaaaatgcatgacttggatgctttaaagaggaagaggggtaaagtccttccaaaatgtactagaaacgaaaagaaaaaggccgggcgcagtggctcacacctgtaatcccagcactttgtaaggccgaggcgggcggatcacaaggtcaagagatcgagaccatcctggccaacat

SEQ ID NO: 225201 - DNA, 503 bp, Homo sapiens
ttattttttttatttttaatttttttgtgttataataagtgctgcaaggcataattgcatgtaaatccttttctaccattctaattattgacttggaataaattattcaatataaaaatatttggttaaattataggaagttttaagaagttctttgttcattacttctaaattgttctcaagaaaatttatattcatttatagttcaacaaagagagtgtgaaacggccattcctctacccccaataatcattttcctttaattatacacttgaaatcttaatatgcatggagtataaagaaaaatatagagtaatttatgactagtatattcaacatctctctctctcctacataaataaaatcaattcagaattctatgttaaaaacacttattatttttattttttaattaaatataatattctgtcttattctaaaagagatttaaaatttgttgataaaatataaaataatcaacaagatacatttaaagtattact

SEQ ID NO: 225202 - DNA, 333 bp, Homo sapiens
aggtgttcttttttttttttattctctccccactgggcagcaaaagttgttccacagtggaaatttaggcatcctcaagtttcttcccagcttctgctgtgttttcttagagtaaattgccaatttctgtttttacaggaaatccttttttaaaaatggaatcagtgtggtccccatctactctgcaaaaattgcatttttctctattttcaaatgagatttgttcaagtttcaaaaccacgtgaaataataaatgtatagtagttttcttttccttgggcattgcttgatatgtgaaatgggtttatgaaaaataataaaatcataacgcta

SEQ ID NO: 225203 - DNA, 509 bp, Homo sapiens
acacatgcatctctgttactcaaagtaaaaacaagatactccaccagtaactgtgatgggaagtcaaggtagagaaccatggaatcagtaattccattttacaaggctgatgatgttcaaaacaggtaaatcttagagcaaacaaagttgagtgtgtaagcaggagggaaaaaaggtgccaaaaccttaaaagctccttaagatttaagatattggacaaaaacgcaactttcctcatcaggaaaagggtgtgtttcctaaatcagcattttttagtttggtctgtggaccacctgaaacaaaatcactgggcttcatcctggacctactgaatcaaagtccctaagtataaagcccaagtatgttcactgattcatctttgaatccactgtgatgagccctctcaagacaactgcttatctgaatgtttcttcaagtaaagtttactccagttcctacaagaccgctagttgataacacagtaaatgaaaggcagggaagggactaat

SEQ ID NO: 225204 - DNA, 462 bp, Homo sapiens
tagtcagattgttaaatttcagatttttttgttcataagattttcttcaggaattggtgagttccccattgtgttcacctggaaaatagccagctgaagaaaaacttcactgaaaagaaatctgagagatctagtgtagataaacattaatttccccccaaatcaggtcatcacatgaactacctgggttagaatttgtcttttccaatattttctgaaagtatttcaccttggctactatactataaatactcctcaacctttttcagtcttttttttagggtattgagataagaaagagaaaggaaattgagaagcattttacttgccctgaattaatgtatatataattttctatgctttcttataatgttaaagacaataacttggacaaactcaaactgctacttcatctctgccctctcatagaaaatgtcattaaattgcatttgatattgtttc

SEQ ID NO: 225205 - DNA, 630 bp, Homo sapiens
  misc_feature (594)..(594): n is a, c, g, or t
ggccctgaaatcctctagttcagaacagtaccatatgggtactttccccttgttttagttcctttcagcaaaaatacacgaaccaaaatgctaagtaaggccgggcgcagtggctcacgcctgtaatcccagcactttgggaggccgaggcaggtggatcacgaggtcaggagatcgagaccatcctggctaacacggtgaaaccccgtctctactaaaaatacaaaaaattagccgggcgtggtagcaggcgcctgtattcccagctactcaggaggctgaggcaagagaatggcgtgaacccgggaggcagagcttgcagtgagccgagatcgtgccactgcactccagcctgggcgacagagcgagactccgtctcaaaaaaaaaaaaaaacccagtaatatgctgttaaaatacatgtttctgtggactattataatatataaataattacatatatccccatttgctcttctgcccatagaacctttcattttatacaagttctacctatttgtatacatgcttaaatttaaactatttggttttttggttatttttattttttgctttttaagctgttaggctctttnctctgtgcttcaattaataaaaaatggaaagaatct

SEQ ID NO: 225206 - DNA, 539 bp, Homo sapiens
taaagcagggctcagaagcagagagagaaagagaatttttccacagcctcagagagaaaatccaggaaaatccaggagtagaactcatgaggctgaggttctggaactgtgttcccaaactgccttctctggaaaaaatgcagagggaaccagccgattcctagtaaaaaatttttgacttactgactttcaaaaagaaatgagttccatatgatgggaattgcattctttgatttggacttaaaggattttctgagcttttaaatggtttcctatgtaatattccatctcttctggtttgggagttttccatgaaatgcctttttaaaaaatacccaaagcatcaaatgagcttttcagcttgatgaagaacttaagaaatttcatcattccttttcttcctggctgaccttttaattttacacaagatatacaggagtgatttgtcttgtctggtttgtaaggatttttaatcaccagccacacacattagtcactggcttttgtacctacaagcccaattttctttgttttggggg

SEQ ID NO: 225207 - DNA, 431 bp, Homo sapiens
ggatggtcccttttggacatgtcaccctaactaaatctccagccatattgtgtgccttcctataatggtttattttgctcaagcttcagctatcttttattagtttcctttatagtggtatgttatttttatcatctttacagtcatatgaaagggtagtggaataatcatttcccttatttcataactattctaacagttttcctctgctgaatctagtagcaagtaaatgactattaaaatgtatttctttctttaatgttttgtacatacagccatagaagtcttgaaggaaaacttgactcagtatttatttagcatgttccataagtcaggaactcttctaaaatgtgggatacaaaaatctgaatgcttcccacacagaattgcttcatgtaagagtatttaaatagaactgaattctgtccata

SEQ ID NO: 225208 - DNA, 324 bp, Homo sapiens
aaggtgctgtcacagacccttaccagccacgaagaccccacccagaccatccctctgctgtttcactctttgatattctctggagctctctggggaggtgcgagacctgctgtctggtttgtacggtttgaccaggtcttacactcatggctggctgtctctctctgagaactgggactcctgaacttggtgaaatacctcagccattgatcatgttaaattatcgggaacactcatttaaaatccgagtctgctccagatggactctctctctttctgccctgaccatgagagagagagatcgtgagagagagagaccgtgag

SEQ ID NO: 225209 - DNA, 614 bp, Homo sapiens
ttctagaaatgaaaagaatataatctttaacaaaaaaggcaaaaagtctttatggtacagttatactgcgactttgttgcttaaaacacagttggcagagagatgaaaactaaaggttttttattctaaaattaaagttttatgaaaagtttataaatttttaaattaacaaagtttcctatcttttactccttcccccatcctcacaaagttgcaattcgatgagtatcttcccagtattttctgacatacagcacgctttttatttgtaagcactgcttcaacaaattagatccacagcatttagggttgactatagagtggtgaataaaacagctggagtgtaaactcttcaacaacagggacaaataaggaccacagtctacatttggtggatatcttttcgtatcagaatattgttacttaatagcactttttttttttttcgagacagagtctcgctctgtcgccaggctggagtacagtggcacgatcttggctcactacaacctccgcctcctgggttcaagcgatgctcctgcctcagcctcccaagtagctgggattataggcgtgcgctaccatgcccagctaacttttgtattttctgtaga

SEQ ID NO: 225210 - DNA, 303 bp, Homo sapiens
tagaagcataatgtctgtctcgctgaatttcatggggaaacgaaaatttacaatgtgtggctcatacgtgtaatcctagctacttgggaggctgaggcgggaggatcacttgaggccaggagtttgggaccagcctggggaacatagaaatactctgtctctaagaaattttttaaaaattagctgggcatggtggcaacatgcctgtgatcacttgagcccaggagtttgaggttacagtgagctatgattttgccactgctctccagcctgggaaacagagcaagatcccatcttggggaa

SEQ ID NO: 225211 - DNA, 387 bp, Homo sapiens
ccaaatgaatagaattgatccagagaagactcgagctgcagctgattgaaaagcaaggccataaagcccaaatcaatagaatagatccagagaagactcgagatgcagctgatctaaaagcaagtccataaagcccaaataaatagaatagatccagagaagactctagatttgctaatttttccaactccacattcagctactggtgttattgttcaagagcaagatcttgtagaatggctttttcttccacatactaattcatggcctctaactccttatttggatcaaattgctactatgataggaaatgggagaactcggattgttaaattacatggatatgatcctgaaaaaattgtccctctcacgaaggcacaaatacag

SEQ ID NO: 225212 - DNA, 535 bp, Homo sapiens
acccctctaatatagtttggattttttaaaatttttatttaaattttcttgtagagacagggtcttcctattttgcccaggctggtctcaaactcctgggctcaagcaatcctgccttggcctcccaaagtgctgggattacaggcttgagccaccatgcctggccttgtttggatttttgtcccctccaaatctcatgttaaaatgtgatccctaatgttggaggtggggcctggtaggaaatatttgggtcatggggcaaatccctcatgaatggctttggtgccctcccgacagtaatgagtgtgttctcactcttagttcatgtcagagcaggtttttaaaaagaggctggcatctctcttaatcctttttcctttttttgtcatgtgacatgcctgtttctctgtgccttctgccatgaataaaagcttcctgcagcctcatcagaagacaagcagatgctcgtgctatgctcgtacagcctgcagaaccatgagccaaaataaaccgttttctttataaactatccagt

SEQ ID NO: 225213 - DNA, 705 bp, Homo sapiens
aaaggtgggggcataggtggtgttagaaaaagtatttgaagaaataatgatggaagattttccaaatttgaaaactgaactgacaagtttgagaagttatccataccccaagtagaagaaacaccatgctaaaatgtatagtaatcaagttgttgaaaactggtgataaaaatattaagtgcaacgagaaggaaaaaggcacattaagtacagaagaacaaagataggaataactgtcggaaacgatgcaggccagaagacaatgtagctacatctttgaagtactgcagaagaaacaaatttgtcagtagaaattctatacccagcaaatatatctttcaaaaagtaaggctgtacttttccagacaaacaaatgcatcaccaacagacctgtaccagaagaaatattacgtgttcttcaggcggaagaagaatatcaaatggaaatgtcagtctacacaaaggaatgaagagtggaattgctctcattttttcatacctctagaagacaggtgactaaggcagaactaaaacaacatactgtgggatttataacatacagaagtaaaatataatcacagcacaaagaaggagacaaaatggacaaatatactgttggaagatccttctactctacataaagtggtaaaatgttatatgaaggaagactgtacgttaaagccatagtaaatcatagagtaacca

SEQ ID NO: 225214 - DNA, 367 bp, Homo sapiens
gttcacagctgcgacaccacgaacacattatgttttagcacctcctagccagagcatcaagaagcactttatcgctaagaggttctgtagaacagaaagacacaagtttaaacagcgatgcattggctagaaataacctctaaagaagcacacatttccctctgtcacgttatagatcgctaacgactcctcgggtgatgttttatgtcctttaagcctcatatcttacagcgttagaatgtgggatgccagcaattgataaattttagtgtcatggggttgggggaagaaatgcctatcaaatgctgaccaccagtttttcaaaaaaacttccattggcaataaaaatggcaagataatttagata

SEQ ID NO: 225215 - DNA, 340 bp, Homo sapiens
tttctgagaactagcaaaataccctggaaaaaatttatgaaacctaccagatttgtaaaaaggtcagccaggcgtggtggctcatgcctgtaatcccagcactttgggaggccaaggcgggtggatcacctgaggtcgggagttcaagaccagccggaccaacatggagaaaccctgtctctactaaaaatacaaaattagctgggcatggtggcgcatgcctgtaatcccagctactcgggaggctgaggcaggagaatcgcttgaacccgggttgcagtgaggggagatcaccccattgtactccagcctgtataacaagagtgaaactccgtctcag

SEQ ID NO: 225216 - DNA, 402 bp, Homo sapiens
ccagaacttggtgcgcaaggtgtgggcatgatgctgggatgctgatacaaccaaatttaagagctttaaaaaccattaaaatactggagtcaccagaaagtaaacaggtgctcattagtatattctatatgatggacattttgcttaatttacatattttccccctttacactgtcactctaattagctatttaaaaacgtattctcaactgaactatcagttggaacattttgtcgttttcgttagtgtgcacacactgttaccatttttggtcagtgatttgcaggcgtagccttaccagactttgctagaaatattacactgtaattgcatctgtctagaagcagttggtaccagcttatctgcatacaaactgttttcactgtataacagttttggtt

SEQ ID NO: 225217 - DNA, 345 bp, Homo sapiens
ttaatataatcttttaatcatttctaattgttttttttttttgttggtttatgttgttcccggaaaaagacgagagtgtttcgtgtctaaaaaactcctagaatgacacgtggtttatcatggtttatttaaactgcctgtagattaataataataattctctggcagaccacatgatacaattacgttcttgttactttagctcattagctcacttgtttttattacccttaattccaaaattaagggattctttttcatttcgctttttacatgatatcgagaggtacgtgattgttgttccctccaaaattagcattcaaccagtggtgcttttggtttttt

SEQ ID NO: 225218 - DNA, 420 bp, Homo sapiens
cggctgcatggaacagtaatgtccacagatggtaccaaagaatgtcgcacagaccttccggccttcttcgctgtgtaagcagctccttctcaaggctcaaggatggcaaggggagggagctgtgggaacaaggccagtcccattctctgccctgggagaaaggtttataggatttaagaggggaaggcatgcctgcagctgctgggtcaccattaatcaattgtgccccacccactgagctccctgcacttagggaatcagaaatgttgccttttcaggatgtgtaggtttagtaactggatcaggaaataatctatacaacaaacccccgtgacaggagtgtacctatataacaaacctgcacatgtacccttgaacctaaaataaaagttttaaaaacaagacaaggcacaaacaagc

SEQ ID NO: 225219 - DNA, 450 bp, Homo sapiens
ccagctatctggaaggctgaggcaaaaggacgacttcagcccagaaggatgaggctacagcgagtcgtgattgtgccactgcactccagcctgggtgacagatcaagaccttgtctcaaaaataaaaaagatttgagatgaaaacattagtgttactcagcatcaatactaaatttctgcattttattataaaattaagcctgatccatgtagctgatcataaatctattctccatattacatctaacatgaacttctaaaattgcaaatgtaatcaccaaacctcaccacctctaaaacgcccctgactataggtcatatcattattttatatatagcccagaaagaaaacaatgctaattaaacttcgatttcagcgattttgtaagaaaaaaagtgtcccacaatcgttggaatatagtgcggcaaccacctcacctccttaaaaac

SEQ ID NO: 225220 - DNA, 670 bp, Homo sapiens
tcttgtcctaattaatcaatgccaccaatacaatcatctctccagtttccttatattcatgggtctgctttgtagctatcttttctttcactaatgtatttctctgtcactgccccaagtgcctctgtcttcatgattacagccttataccattcctgacatctagtaggccagattccttccaaaaaacctcccacatcattgttttaacaaaacccttttgggatttttcttattgagttgcattgagtttatagaaatttggaaagagataatttctttaaaaatattaagtctttccatctttgaacataacgtgggttgagcatcccaaaacttgaaatgctccaaaattcaaaactttttgagcactgacgtgatgctcaaaggaaatgtttattggagtgttttgcatctccgagttttggatttgggatgctcacttggtgagtataatgcaggtattccaaaatctaaaaacaaaatttgaaacacatctggtccaagcatactcaacctgtacatctctacacttatttttcttctttaatattgttccatgaatttataattttttacataaatatcgtgcatatattttgttagatttatttctacctgtgttgtggactgtgttgctattataaatgtattttctcaaaaagtttgt

SEQ ID NO: 225221 - DNA, 425 bp, Homo sapiens
ggcctggggatctggtgccctggaggctttccttcaatctgcctctgactattaggagctcataggtgggtcacctgaaactctgggcctcagttttctcattgtgcaatgagattgttgaatcatattagagattccacaaatgagagcagtgcatccaagacataagccatttctgcataaccttttctagagatcccctgacccattaatcatgtaattaatggtcctcattaaaatgacttcagttctagcataatgttttagttccgtccaggtggaaacatttacaagcccacaggtatgatgtgttaactattatttaagtacatattaaaatactcaggaattaaaattaaaaatagcatttgtccatgtaccacctaatgaatacgcaataaatgttgaatggatgaatgacaaaa

SEQ ID NO: 225222 - DNA, 234 bp, Homo sapiens
atttgaggaagaaagaccagtgtgactgaagtgtgttgtgcacagaagagcaagaaagcctcagtccttccagaaactcctgttatttattgtgttttcatacttgagtcttaagagattccattctgacatctgctggctattgtgtatactgcagttccaaattccactacacaagaacaacctttaataacgtattttttgaaatttgtcataataaatttgagataaaac

SEQ ID NO: 225223 - DNA, 162 bp, Homo sapiens
tgggggtgatgagggaaggaaggccagtggggagaggagtgaggaagaggacagctgcgagtcaggtggtgagagcacttggagaggctgagaggacatgggctgggagtgaatgcatgtgcacatacacacacacacctctccagcatatgtacacatgca

SEQ ID NO: 225224 - DNA, 525 bp, Homo sapiens
aggcgtatttagtctaaagttacatgtatttgatttgttttgtatattagtaataaagcagtaaatgaattggacagttgcttgaaatgttgtctggcgtatctgtataattttagtgatttaacatgtcacttaagttattgaggaatgggaaataagtactatgacttggctaacaatttcggaggtaactagtttagtcgtggacagtattttttaaggaggttagcaaatgatgtttagttgccattgtgatcttctgaaactgagttaagatttaactgtatttattagaaaaataatcaggcttattttgaacactgagttgtcactatttttaggtccttactgcacactgaagtattgtacacaagaagctcattatttaagtgatctttacgtggcatacacaaatgtattacctgtaaaattaattttagttaaaaagtgtctgaaaggagatggttactttgtgagttttaagttgtttttgggtattagatcttgatgagcctgaaggggtcg

SEQ ID NO: 225225 - DNA, 322 bp, Homo sapiens
caggctgctggttgaggcgtcgagactctctgactagtacacgtccctggtggttgagtagtaagaatgcggtagtagttagaataaaataaatatccatgaatctatactgatgtgaataaattattgaataagctaacaactagggtagaaaagaaaattcctctgtgcagagttccaaataaattatgtggctacttcaccctataggagagggaacattattatctctttcttaagtgtggtgtgcacatagtgacttcctcccaaagcatacaatatgtagaggggggaaaagagtaactttagaggggagaaacct

SEQ ID NO: 225226 - DNA, 710 bp, Homo sapiens
tgcttggttttcagtgaatttacaattaaatcttcccacaatctctaacagctcaagctgtaaaaaacattcttcaatgtaattttccacaaagacaaacttgttagataagttatgtgttccaattttttccccctgaagactttcctcttgaaggagatttggacctgctaggtagctgctatcctgaggcttctactgaatattatttgggattccttttaacttttcctgttctggacttcctgtttcctgaggggattccattcttttccctttcttggttactcccttatttgatgaaacacatctttcaaaacttctagggaaatggaacatgagatgtaaattttctttctaacttccatgtccataattttgatagcttccaaattttcctaatttctccttacagagcacatacaagtttttaacaaaggacaaaccaccatgtcaatgcgttctagtggcactgaaggacagactggtatatcaattgatgtgctttttcaaaccatacataccgtgtacacatcataccatgacacacactggtcctatatgaaatttttaagagaactactctcataagtggcacatcatctatatgtaaattaatgcaccttaagtgcctgaaaacttttacagattttagtttctttgagacttgtttatgatactaattttaaagattataataggattaacca

SEQ ID NO: 225227 - DNA, 1736 bp, Homo sapiens
gtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggcctcaacaaacacccctcccgggttccagattctcctggctcagtctcccgagtagctgggattacaggcatggtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaa

SEQ ID NO: 225228 - DNA, 1181 bp, Homo sapiens
tgcttttataaaatctagcaaagatattatcttgttcattcttactgaacccatgtcccctacagctgaaactattacagctaatatttattgactatttgtggagtgctagttgtgtttataagcacttagcatgataaatttgcaatcatacatagggttgatgattaagttttggcctagaatgtttaagttatacaattagtgaatggtaaaatttgaatttgattcctggcttctgtcctcaaatttgtgcctttaatcactgacacaactttatagttaccattaggtaagtgaaaattatgttgaaacaggaaaaagctacttcattaaaaaaagcataatatatatttttctatatttcatggagtattgtgtttaattaggtatacaattttacctattgcattacatgataaagtccctatgtatagtctaggttagctttttttttttttttaattgactgatgttaagtttcaaacatatgcccttacaaagattgttgatattttggtacaccttgctaattcagtaaaataactcaaataaattgatgttgttttaatacatacacatacacactactatttgactgaagttttaactttcagataattataatatgtggatttaatatcttgtcgctctgccatcagatttaattatgtcactataaagaatgtgatttttgtagttatgctattccttaacatcttactatgtatcaaggtgctccatgtactattccttcatatcccatagaatggaggtggaacagatgttgccaattcatggcatatggacttattctttttattataatatatttccattgcagtataatggaagcttttacaataaagactttctcttcataacccaaataactggaccatgaagagacctactgtgtctggaatttattccttctggtgggttcttggtctcgctgacttcaagaatgaagctgtggaccctcgtggtgagtgttacagctcttaaagatggtgtgtccagagtttgttccttcagatgttcagatgtgtccagagtttcttccttctggtgggttcgtggtcttgctgatttcaggaatgaagccgcagccccttgtgcttagtgttaacagctttttggttgtggacccagagtgagtagcagcaagatttactgtg

SEQ ID NO: 225229 - DNA, 271 bp, Homo sapiens
ctttcttctgttctgctgcaagccactaatgcttctccatttacttcctgtcttctgaaaattcattaaaacttcttgtatgttgatgagggaaccgagatctgaagaagagaaatgacctatccaagttcccccagctggggccagttcttctgtttcacctagaattggatgttccaactcctggggatttttgtgccacgaagaaatgaagacaccagaaattcaagccaaaggcctggggcttccttggctcttctccactccacct

SEQ ID NO: 225230 - DNA, 634 bp, Homo sapiens
attattgaatttcataactacttatggaatgaatttacacttgataaggagtacttagaagaaaactttctgaatctgggtaattaagtgaaagtaaaaataaatagataagtaaataaaataagcacatagagtactttttaaaggcttatgtgtcctctcctcccagaaattgatattgagatattcctgtatcatctgaaagtgactattgttatttcttttagagaattaattttatttctatcaacacatatttattgaacatacgccatatgccttgaattgagagagatactgtgaagatacaaaaaagataaaggcttggaaaattgtggaggatgtaatagaaatttactgtttaaaaattgtttgtactcaagcctgtttagctcagttatttagggcttctaaacaatattcctttatttttgagaatttttggagaaaaagtgacaagccccaaatctggaaaagagtatgattgatttacaataggagacgtggaagtcataagcctctgaatttaaatattaaatgtagtatctctggcagatgaaactatagaggacttttatttagtcatatatttttagtgtttgagtcttatattacatttttaatcataaaaacc

SEQ ID NO: 225231 - DNA, 423 bp, Homo sapiens
ggaaaagtaacggcgttatccattcacatgaagcattcacatgcctcgggaagaacacaccataggcacacaggtattgattaccgccttgcttgtggtagctaaaaaagaaggaagtgacgtgactgtccctcagcaggggaagggttgaagaacggacagaacatgcatactgtgagatgctatgaagccaggccaccggagcaagctagagccaacccagtggcctggggagggccccaggtgcccctggcggggcggtttggtgtgaactgcagcgtgagcaggagctgggaagacagtcactcaggacgcatctgtgttaaggagagggaagagggcatgcggccaaaacagtggttttctgagcatgttgtgaatgttttcttaccctgaaataaaatttaaaaaagattggcagag

SEQ ID NO: 225232 - DNA, 439 bp, Homo sapiens
agagtcctggaaccagtcccccagaaacaccaagtgatgactgtatgtggaattgctgagtgaaccccatcagttttagattcttaccagtttagaatcagtttgagattctcaccatttgtgtatgagaattcctaacttggtagcgtcataatatatctttattctaattgctaatttatttgatttgttgtaagttagatagtagaaattatttgttcttaatttcagactctgtatacatttcttattcttcctttaataatgtatatgcaatacatttaatgccttaatattccttttggaggacagacctcttatcctctttggagagcaacacagttattacagatttaaaaatctttattactttttctgtttataaaagtaatatgtttttatttagaaattcaaataataaagaaatgaacaaaacaag

SEQ ID NO: 225233 - DNA, 494 bp, Homo sapiens
ctccacagtcttggtgccattatttaagaaacattagctgataatagcagtgttttctaacctactaataacagttatccttttttggtaattaccttattttagtaaaagtttggaagattaaaacagatacacatatgtttccaggcttagtgaaggggatgtaccaacttcaaagaattaaaaagaaatggctttttacctaaataaccttttgttgctggtagtatagcttgtgctaatttttgtaatgtttaagtaatgaaataattctacatatcaggtcctttttatttagaacatcgacttcctaatatcatccgaataaatactctggacatagtaggtgaaagtattttgttaacaacttctttctggccaagcatggtggctcatgcctgtggtcccaacactttgggaggctgaggtggggagatcacttgaacctatggatttgagaccagcctgggcagcatggcaaaacacttgtttct

SEQ ID NO: 225234 - DNA, 523 bp, Homo sapiens
agaatagaaccatgaacacaccagtacaccctccacccacattgcccatggtcagcagtttgctatttggtttttctctttctctctttttttttcttttttgtagcatgtgttagaatttccttaatttgtaaggctgaataatgtttccatgtgtgtatgtgtgtgtgtattcatttgtatacacacaacacattttgtttatcctttcatccatcaatggacacgggttgcttttaccttttggtcattgtaaataacgttgctatgcatatgggttcacaaatatctgttcatgttcctgttttcgattcttttggatgtatacccagaagtgaaattgctttttttttttttgagacagggtctcactctgtcacccaggctggagtgcagtggcacgatctcggctcactgcaatctccgcctcctgggttcaagtgattctccctcctcaacctcccacatagctgagattacaggtgcccgccatcacacccagctaatttcggaatttttagta

SEQ ID NO: 225235 - DNA, 388 bp, Homo sapiens
ctttctccttccctctcttctctttactgtgtttcttactgtctaaacccaaccagaagctagaaggcaaaggagcagggtagagaagggtgaaaagtggatctacaggagaaaacctaagtgtgcagtgccacttccatcattccttatgatgatataagttattacatttaattttaaaacattttttctaggtttttttcccctgtgaattaaaagggtcatgtacctgctatctgagtaatagctatacccactgtcacagtgccttaataatataaacccagaaacctttgcttttcttctgataactagatgtccagaatggaatgatgttacttaaacttttaaagtctgtggtacaataaaatattttaaacaaaatatc

SEQ ID NO: 225236 - DNA, 684 bp, Homo sapiens
ataatggaacactaggcataaatgggctaactccttcagctctgggctgagtttctcacaattactgcagatctccacatctgggcaggtcctgacaatagttaaagattttttttctcataatttgtcctgaaaggacatatattgagctattcaggagacttgagaaaagttccaagttaaataggataaagggcaatggatacacattttttgttcagaaatataaagattattcttagttagaggtgaatatgttccttcactgttctctgaattcattctgtcattctgctcctggacttcctacaatagtaccttgacttataaggcccgtgtccagatcttttacagtccacttcattcaaaatgctcctgaaaaattcaagggactcactaacacatggctttggtaaaggcattctcctgaacaaaaacctttctgacctcaaaatacacctagcaagggatttagtggtgataatctagctctcctaccttttcagccctggatctttatgctctttatcttgcaaaacatgctctaaattaaattaactgctacccatttgtatgccccgtgtttctacaacactatagtctctttatggttcaccttttctacccatccccaaagcccagatgaaatgccactttcatgaaactgttggatccatctatcct

SEQ ID NO: 225237 - DNA, 329 bp, Homo sapiens
acgccccccacaccccgcccgaccccagctgccgcaggagggccggctgatagaggtggtgcagacattggtcctcacagccgggcagccttgaggggaccacacaccgccccgcccagggcctccagcacctcggctcactgccccggttccagcaggaatgggggccacacaacccgagaaacacagaccacgccactgccgagctgcacgagcttcagctgcaacaaatcgccacagagcaggcagctgcaacatcagaaatggacgttctcacagctccaggtccaaagtggtttcactgggcacaataaaggtgtaaggtgtct

SEQ ID NO: 225238 - DNA, 383 bp, Homo sapiens
atacagtatacaatcgagccggtacccaggtctttccccttcaagagtggctggcaaccactaatctgcatgttgtctctatgaatttacctattctggatatttcatataaatagtatcatattctattgtaccttgtttctttttcttagcacaaattttctaggtgcatttatgttgtagcatatatcaattctttattcctttctatgtctgaataatattccattgtatggatataccacagtttacttacctgttcattcattgatcgacattttggctgttgctaccttttggctattttgaatagctgtcaatatgtgtacatgtatttgtttgactatctgtctacactttcaggtatatacccaggagtggaa

SEQ ID NO: 225239 - DNA, 243 bp, Homo sapiens
atcatgtgtgcatctgggtgggttgaataaattatggggctaaacaagggtcagtttccttcccttggatacaggggttactatgtcattcccctcagttgcataagatgcttgtttgcttaggttgcagttcactgtgactgactcgttttttttctttctaggttctgcaaattgtcctctgtttcacctctagtgatttccaggctaccctctatctctttctccttttttcaaatttga

SEQ ID NO: 225240 - DNA, 2701 bp, Homo sapiens
  misc_feature (2067)..(2067): n is a, c, g, or t
  misc_feature (2446)..(2446): n is a, c, g, or t
  misc_feature (2509)..(2509): n is a, c, g, or t
  misc_feature (2528)..(2528): n is a, c, g, or t
  misc_feature (2582)..(2582): n is a, c, g, or t
  misc_feature (2608)..(2608): n is a, c, g, or t
  misc_feature (2643)..(2643): n is a, c, g, or t
caaaatgataatgctcagaaaaaatacaaggtttttttcttggtctaaaatgttttactcatcaatattacatttgaagcaagcttttacatcaaaattgtgatgagtaaaacattttagaccaagaaaaaaaccttgtattttttctgagcattatcattttgtgaaagtatgaatgattaaggctgggactttaccaaattacacagttaacatgtatttgtgaaaacactgataaagaaaataaaccagaatataatctagtagaatataagttttagatggtcgaaaatttgtcctatttatttctctttttcctgtgactaatagccatacaataaatgtttattgaatataaacaaaagataattaaatgaataaactaaggaattgttttaaacttatgtttgtgtgtagttttacttaaaaactttttgtctaattagaataaaaactttaacactaaaataagtattaaatgactagtatatgtaccataaatctgtttcatttctttcttggtgaaatggttagcatatgtctgccaacctgttgctgcttagctttactgacaattatatacattataaaatacatattttgttttgcactgtttttatatatttttgtattcaattgggtatgcttattgttagaaaatcttaattttattttgtagtatcaattataaaatatgtaattcttcaaaaattatttttgtgccaaggtgtttttctccatacaaggtgagcagattaggtagcattcatacagctataaactttagcgttttatttgttataggtaaagttgtgttttgcaacaagaacatccatatcatatcacaaaattgtaagttaaatggtttgagtactttgaccaatgcttagttttatgtgaggattaagaggtaacagagagagtatgaaacaccattctcattgaagcagatgtcttttctctctcactggaaatttatattaaaatttaagcaaatcagtaggttcatgatttgccttgagcatctgtatatttttggttgtaacagaaatacttcattttaatgctcactactagatgtctattcagaatgcatatttcttaacaaactttaaaagaaatatgtagattaaaatgaattcccagtgctatgatatgtttgtaatacttcttcaggcagataggtttcaaagaaacatacaaggtacatgctcaagttgttactgacctatactatgcctgcctcctaataggttgtattttggctcctatgtttttgacaaatagctgagctctgtaaagctctgtttgtggtgctgaaacctctcatgatgtatgagcatgtctggctgataaattctaacgtcagcctctgtgtgatagtgattcatcgggttgtaaaatttgtgtttgagaaacacgttgaattagcaagtttcatattttggttgtgttaaaatcaactcaatttaccctcttgttttaagaaattcttaacaattgccttccacattgtcaaaaacagctaggatttaactggaaactgtccatgctatcacaaaataaatgtctaatattaacaaataaattgatatgactacagtgctggaaatgtttataggccagtgagatgttgatattatgcagaaagctattgtaagaaaagttaaaagttgcttatgagcagacacagtagcaattaacatgaaagctttgtaactttgagagataaacaatttgcctataaaaactgtggtattttattgtctcagaatgtttgctttgtacaaaaatacttctatttttgcaggactgtgggggtttgtttgtaaaaatgactgaaatcctcaaaaatcttaattctctttttttttaagtgaaatccgtatattccctatataagatttttaaatgactactaatgtacttggcacttcaattcaatgatttgtaatcttttaagctgtgggtttccagtgccttaaatatatttttagaggactggactaaaaaattaaattcttaattgtttcttttactttaaaatagtttcagaagcttttcctntagttaacatcattcctcttaaatttgtgtcaaactctgaaagtatctgaattgtgtcatttttatattggagtgagctaaataaaagaaatttcagaaagtcgaacctgttaaacttctactactaatgctatatgttttatggtgtaattttaaaatcttagtgttggactgaaacatgttgtttccttgccatgtttcaatatagtaaattattaagttatttgcttgttacttcagtgaagctccttaactgttttgaatcagagagagatttgaaaattatacctagagcataagtcataatgaaatttggcaatagtttctgcaaagcaagcagcctagacctggcgtggtggctcatgcctgtaatcccaanactttggggcaccgaggtgggcagatcatatgaggccaggagttcgagagcagcctggccaanatggcaaaactttttctcnactaaaaatacaaaaattagccggagatgtagtcacctgcctgtaatcccagcnactctggaggttgaggcaggagaatngcttgaacctgggaagcggagtctgcagtgagccnaggttttgccactgcactcctgcctgagcaacagagggagactccatctcaaaaaaaa

SEQ ID NO: 225241 - DNA, 942 bp, Homo sapiens
aactaacttttatcttccttttctcagactatcaatcagtattaaatagatggaaaaaaatcaaggactacttgaagctatttttgttaatattctggttactgaagtttattgtaaatatgtatgtatagtaggcatatttctttttaaccttgtgcttccctccttcccatggaatttcttcccacagatgaggggccactggacagggggatgagagccattcgtccctgggttgagggaattagtaagacatcattttcaccactgggtggtcttcatacacatgagttataatagcattttaagtatcttagcatttgtgggattagaaatctgtttttgctatttataatatataaaaaatgaaacatgatagcctttcttgagataagtatgtgaaatgtttatttttaaagttactaaatgcatcttgtcttgctactacatgcactgctctgaaaaagagcctttaccatctataacctgtattttgggtattcttccttttcatacttctttgaagttgtggaaatattaagtcttttgttaaggcagagtctctctctcctgttacacaacactgaacctcacgccactgcctcagtggttattggccagccccagaggttagacttggagcataattctgagtggcagctaaaggtagcaggagtcttacctctccctactttgggttcagaattgagccagagaaaggaagccattaaaatctccagaataatgatagttaatgagcaaatgttatgctttatatcccacagacatctgccaccttgttcatcttgtcctgaggagtaataaataatgttaagcttttaaaaatctgaatttcagagaatctcctagaggatagaggaaaacccctcagcatggtgtgttagagtgggattgctggttcctcagccccgtgccaggttg

SEQ ID NO: 225242 - DNA, 141 bp, Homo sapiens
tagaatacttaaatatttaatagaaaaaattcataaagttgaagagttccttttgtaaagcaagcataaatttaataataaaactttaaaaagctttgaaaacccattgataaattcacttggaaaaattaaagacaactc

SEQ ID NO: 225243 - DNA, 1159 bp, Homo sapiens
gcaagaaggctcccaccagatatggactcaacctgggacttttcagcctccataactgtaataaattcctttgtcagttacccagtttcaggtattctgttataggtaacagaaaacaaactaatacaagtggtaatgtgtccagctaaaaatttgggttctgttaaggttaaaagaaaatttgaggtagccagcagtatctgcctcagatgctgagaagcctcctgagataagagcgtataccatgtccataactgaagttttaacattctctgccaaacagaaccagaatttaagggcaggagaatttgcaagatagaatttgcaatttgcaagagggaattgcaatttgcaagagaggggcaatttgcaatttgcaagagagggcaatttgcaagagagaattgtggggccctgagagagaatacatccaaaggaagagggaaccaggcattacaaattgaattgaacaaggacagatatctgaagggggtttgtagttcccagtaaagtatggtacagctaggtgcacttccctggccagaccaccctacagtgtatgatccccctggggagcaaaaggctgcaggtaacactttggtgccctagaaattctgctgtggtgcaactatagtggatcacaggcagagtggggcattgttccccttcttagcacaggatactgggtcatttcaacaccacaaggatttgcagcatctgcggcaacgagtttggtgtcctggagcaaggaaaggaaccgttcatggtggctgaagccaagctgctcagcactgaggcagcaagccatgatctaggtcttcgagtagaattctcagttttggttcatttaaaaatgttttttgggggaattggggatcatttatgggtaccaaaagaaaaaaaaatgaataagatctactatttgatagcacaatagggtgactatagtcaataataacaattgtatattttaaaataaagaatgtaattgaaaagagtaaatgcctgaggggatggataccccattctctgtgatgtgcttatttcacattgcatgcctgtatcaaaatatctcatgtaccccataaatatatgcacctactatgtacccacaactatttaaaaaataataaaattttaaaaaattgtctttatgttg

SEQ ID NO: 225244 - DNA, 992 bp, Homo sapiens
ttcttcctgtaccagtgaggtagaaaacaccagaatagtgttgtaataaaagcatacacaccctgtggcagaggttccctggttgtcctccaaaatccattctcccttcttctgtagtgggaaggatttatgtggtctgtggccgcgcaggataagaactaacttcccagcttgcctttgcagccaagagaccaagttgtgttcagaaggatgtgagcaaaaatgttacgtaaaaccttagggtcatggctataatgccacctcttgctcttttcttcttctggaatgtggatgtggtggtgagtcagccactggaccttgtgaatgagggcaacaccaggatggcagagcagtaaaataaggagcaagggccctgacaccatggagctgacatattagccctggaatgcttacattggactgtaagagagaaataaacctaatcttatttaagccactgctattctggatcttgttacagcagctaaattaaaattataatacaattcccaaattgtgtatatttattcataaatcatatacctatattattgacacatttaggttaatgaaacaaaaaaaaaaggttattaaagagatttaagttattttgttcctatgacttagtagattgtccatctcatgagaaagagtactcaggttgaaccctactagtatattgagtgacagcatgagagggtgagatttggagttaaagacttgagtccctgtgacttacttgctgggggactgtggacaagttacttcacttggctaaacttgtttcttcagctgtaaaatgaggataccatctacctaagaggagagctgtgaaaataggtgagcacatatatgttatttagcatatttgccctcatatagtcaatgatagctattttttttcaaaatagcaatcagtagtttcagtgataatgactacagcctttcccactgccctttttttaaatattaaaaaatacttaaaaaataaa

SEQ ID NO: 225245 - DNA, 631 bp, Homo sapiens
caagtgttaggatttcagttgagagagactagagaatatggccggcaacttgctgtcctacaggtcatatatgttccttttgaatacagattctacaccctcctccatcctccctgcctctcaaaatttctttgtcttttacaggactatttctaggtcatgctacggttaccctgaccccagtcactccctatgctggtccatccaaactcagagccacgatcaaggcccttctacaacacagatgtgattacttcactctcttttgtggggtaaatataagccaagagccaagcaggtgcactgtggaggaagggagaatgcaagaagaaaaaaagaaagcccgccaggcgcggtggctcacgcctgcaatcccagcactttgggaggccaaggtgggcggatcatgaggtcaagagatcaagaccatcctggccaacatggtgaaaccccatctctactaaaaatacaaaaattagctgggtgtgatgccggtagtccttgtagcacctgtagctactcgggaggctgaggcaggagaatcacttgaacccgggggcagaggttgcagtgagccgagatcgctccactgcactctagcctggtgacagaggaagactccgtctcaaaa

SEQ ID NO: 225246 - DNA, 467 bp, Homo sapiens
taatgggcaccaagaaaggcttgttgcatgagcaaatattgaagagggaaggaagatcagggttttttttttaacaagcagtgtttagatatgttggttttgattgttctaagcagaatgtccaccactccctaagaaatacaaacctgttatgatacaaatgtgattctcctctagaagagataataggtaatgctattgtggataggaacccagaggacagaggtgtgtaaagaaggagctggaggcgtaggatgtcacatttaagttaatactgttagtcacttaaatataaattgtgtgcactgccaatagcctgagggcacttgaaaaaaagtataattttcgctgactaaatcctttgtttgttcaactaaattgtaggcacatcatggcactgaaaaaaaatcataaatttctaacttaggtggagacaataaatgaatccttttctgtggggtaactgc

SEQ ID NO: 225247 - DNA, 480 bp, Homo sapiens
actttctaagactaatgaaaggctaaatgttaggattatgggaggtaactgaattctgctaaaatgtagacagaaacaataaccagtgatttgtaatttctcagttgctcctgtagataacactactattgtgaaaacctaagattggtctttgaggtatttttcagacttttacaattgggcagagtcattcaggccacctggacgtcttcttcactggtaccagagaactggcactgcccggtcctgtgaccgtcacccagaaactgactcagctccaggaggcctgttttgaaccctcttatgattttctccacaactaatgagccacaccaattccctagccccttgctctccgaattatcctcaaaaccctagtctcccaacttttcgggcgacagatttgagaactaacttccccctctcccaacttgttccacttggctagccctgcgataattaaactctttgctgcaaaac

SEQ ID NO: 225248 - DNA, 418 bp, Homo sapiens
ctcgtggggactcacagtttctacttgcagcgcctccggcttagccagaacaagcgcttacactgtctgaatcagaccctttatggtccagtaaactgtgcttcccttgactacatgcagccccttagggggcccaggaagtcaggaggggtgtggatgatgacttggtgtgaatctcttcatcatccccactcctggagaagctgtcctgcccccagcagagaagcacactctcaccatggtctctgattttatttttatccatcaagaagagaatgcccatctcacttatttcttgacctccaaggtgcttctggtagggtgcgatgtgtattcacagtgaacacaatcggcagagggcaagatgccagcccactcttttgtgaaagggtctgaaatcatctcacggtcttcacag

SEQ ID NO: 225249 - DNA, 380 bp, Homo sapiens
aaccatagcacaggtgttttgtatataagaattttccttattgaaaatatgtggatattagatttaaaaagggcacaatgacttagcccactttgcttaagatcaatggccaaaatttataaatctatttcattcttataagaaggaaaaataattaacatgacatgttggatgtcattagaccttaacgggaaatcttccaaaagatttatacccataaatggagataattaaggtaaaagctgaaattattaaaataaaaagaaaagtagaaataatatgtataactaaagcctggttcactgagaagataaaaacatagactcactccaggggttgtttaagaaaaggagagagaaaacaggttgtacaatattagg

SEQ ID NO: 225250 - DNA, 552 bp, Homo sapiens
gaaatgtggctagcagtccaatcctgaagacaaagtatgatcaaagcaatagctaccaagaggtggaagtggaagtggtccagtcaaagcaaaagtggacctgtcaaaaacagggcaacagtttttggagatgcttgagggattttgcttgttcactttctggagggccaagtaatgataatagcttattatgagagtatttagagaaagttggccaaagctttagtagaaaaacacttgggaaagcttcaccagagagtccttctccaccgtgacagtgtctgttcatttgtctcatcaaacaagggcaattttgcaagagtgtccgtaggcatccaccttagagttcttatctggcttctttcttttgcttcctaatcttgaaaaaaatctctaaagagcacccatgtttcttcagttaataatggaaaaatgggtgagcgtgggggatgtggctgggtgggtgccggggcttcacctccaaggcagtggccggatcatgattgaggtgattgagcccctggagcctctagtgcctgtggattttggcag

SEQ ID NO: 225251 - DNA, 337 bp, Homo sapiens
atatcagaccagtttttccagggggccttattagcattcatttgttaaagtcaaccttagtttcttaaagctgaccatcatatctaattttgcacatcatactcactaatggtttccagattctggaggaatcaagtagagagaaaaagtaattatttcaattttatttataaaaatataatctaggccaggcatggtggcttatgcctgtaatctcagcatttttggagtccaacgcaagtggatagcttgagcctaagagttcaaggctgcagtgagctatgatcacaccgctgcactcttgccttattgatggagagagatgctgtctctttgt

SEQ ID NO: 225252 - DNA, 230 bp, Homo sapiens
tggtctgggggttcgggaggtagtctccaggcctgtggttggagcttgcaggtaggtgccagcttttgaggcagtggcagggagataaggcccaacctcagaccccctggaggagtgcttatgtacccaaagaagtggattggtttgggcagtcccaaggaccctgggttatgagttctgtctttgggggttgaaggcagaactaggctgggtgggcttgttctcaggct

SEQ ID NO: 225253 - DNA, 570 bp, Homo sapiens
agcccagtcatatatctgtgaagtgactatattaactataaactatgacaaatgtgagtgcatatattataatcctaaagcaggtgggttattacctatagcatgagctgtaaccatctagttaaatgagatcatcacagctctctctgccagcaatttcctgtttccaatggaagacaaggataccaaaacgtctctttcgttttcagtccattactagattcctctggaaacaatcatcatctttattttatgggttaaggtaatgttaatgtcacttagaattctgggtgagatatgataaaatgagtatgtgacctggattaaaacatactattaccagaccacaaagcgagtccaagtctttggaagccaacacagttctaagactatcatagaagagaactaaggtcccgtagcctccaaggttgtgtacgtctgtattcccccacccccttttttgtaaaggccagtatattaattcgttctgggaaccaagactccaaatatttcctctcagcctcagcctgcccttccattagtgaaaaataaagatttctgcacattcta

SEQ ID NO: 225254 - DNA, 475 bp, Homo sapiens
caagtaggtcattgggagaattaacagggtcattggcagaattaaacaagacaatgaatagaaggtactctgcgtaatgtttttaaaaaagtaagaaatactgaaaaccggccaggcgcggtggctcacgtggcaatccaatgtatgaaaaacgaaacaatgtaatacaatacaccaaaagcaaattacagaattgaatgggaaacaatttcacaacaaagcttctaaaaataatacaggagaatatcctcatgtctttgaagtaggaaaatattttttaaataggccactaaaaaggaagaaaaatactgacaacctgaaccattaaaattagaaatttgtttataaaaagacaccattaagaaaggaaaaaggcatgcctgtggtcccagttatgcaggagctaaaattggagaatcacttgagcccatgagctcaagtccagcctgggcaacacagagtgatcctgtccctt

SEQ ID NO: 225255 - DNA, 476 bp, Homo sapiens
agatgagatcattttgtctgtactgttttgtgcaacacaatttgtttttcattttcacttctttatatacatgtcattgaatattttgcagcatcatttttcatagctatattatatttctttcatggatatgtcatattagggatggggtaaatcatctgatgaatatttaggtttacttcagattgcttgatctgatgaaaaattatgtaacaaaatttccttttattatttctttggcgtaactttctaggtgggaattcctagctgaaagtgtgtatattcttccttaacgagtttgtagaatacttattaaggaactgctgtgtattggacactgtgggaatacagtattgaatggagcagatgcagtccctaccctcaaagacagacagcctgtttggggagatggacgagtactaaggcagctgtgatgctgtgagatagctgtgttgacagtgttataggggggtaca

SEQ ID NO: 225256 - DNA, 496 bp, Homo sapiens
agaagcccagggcagctctttcctttcttggtttttagttcaataaaactatatctgctattgaggtcatgctggcttccttctcttacctagtccactccttgagaattataatatctattatttttaaagttatctcttcccaagactctaatatcttggcttttttttaactgaaatataatttacaattaatgcacagattttaaatatactgtttgctgggttttgacacttgtatgtaccagtataaccactacccaaatcaagatatagaacttttccatcaccttaaaacgtttcatcattaacgctcaagaataagtgatactaatctatggtgatagaaatcagaagagtggttgcctctcaggacagagaattgaatggaaaagatagaaatcaaccagcagtaatatttaattttttttttgagacagggtcttgcactccagcctgggcaacagagcaagactccgtctcaaaaaaaaggaga

SEQ ID NO: 225257 - DNA, 687 bp, Homo sapiens
agaagcccagggcagctctttcctttcttggtttttagttcaataaaactatatctgctattgaggtcatgctggcttccttctcttacctagtccactccttgagaattataatatctattatttttaaagttatctcttcccaagactctaatatcttggcttttttttaactgaaatataatttacaattaatgcacagattttaaatatactgtttgctgggttttgacacttgtatgtaccagtataaccactacccaaatcaagatatagaacttttccatcaccttaaaacgtttcatcattaacgctcaagaataagtgatactaatctatggtgatagaaatcagaagagtggttgcctctcaggacagagaattgaatggaaaagatagaaatcaaccagcagtaatatttaattttttttttgagacagggtcttgctctttcgcccaggttggagtgcagtgatgtagtcatggctcactgcggcctcaacctcccaggctcaagtgatcctactacctcagtgtcccaagtagctgggagtacaggcacaagccaccacacccagctaatttttggagtttttctagagatggggtttcaccacgttgcccaggctggtctcgaactcctgggctcaaacagtcctcctgccttggcctcccaaaatgttgaga

SEQ ID NO: 225258 - DNA, 704 bp, Homo sapiens
tctgtgcctgaagccaccaaggtttccaaagcggctggaatcccggtgggggctcaccacctctccaaacctcttgctggcctctggcttggctttggagtggaagcaaaagactgagagtccgggattttctccctccgtttctgagacagcaggatgtactaaaaaagcactgactggtccagtagaagaccgaggtccaaacccagactctgtcaccaactcacagtgaccctggggaaatcttttcttacctttgaacctcgatttcctcatctttaaaacggggacagtggtctgtgccacgtgacgcccatctcacagggatgctcaaataatcaaaagagatcgtgcaagcctcagggctttgtgaacgctaaactgtgagaacgtgagggattttacctccgaggtaaccgggtctgaagctattacagtaattcactggcggggaaggagatgcgctgagcattgcctgggagtaagcagtcctggcctcagttgcatccccaagtctaaggcgggtgcaccggagaaagggaacaaactcaagtcacagaggtgtgtgtgtcggggtgagggatccccgggatggaagcctccctcgcgccctcggagagtcccagagggttgggcggaggcgcgcggagacgacaacactgtccccgcggtcgcgcgcaccgggcgcgcggaggcttccccga

SEQ ID NO: 225259 - DNA, 117 bp, Homo sapiens
aacaatgtgggaggtagatctgggaatctagaaatctgtgttgtccaataaaatatagctcctctcagaagggttttaacaacatagaaagtacgaatttatccagaatggtgacat

SEQ ID NO: 225260 - DNA, 355 bp, Homo sapiens
cagctggagtgagtgtagccggtgctaacctactgcacttggaagtcatctttaaatattgttcttgtgggctgagtgtggtagctcctgcctgtaatcccagcactttgggaggccaagatggtaggattgcttgagctcaggagttggagaccagcctgggcaacatagtggaaccctgtctctaaaaaaaaaaaaaatacaaaaattacctgggcgtggtggcgcacacctgtgatcccagctagttggaaggctgaggtgggagcatggcttgaatccagaaggcaaaggttgcagtgagctgagatcacaccaccacactccagcctgggtgacagagccagactgtctc

SEQ ID NO: 225261 - DNA, 357 bp, Homo sapiens
gggtcaggaagacattctcttatattttcctgagcataaagttttacacatttaagtttatcataagagcaggccacctgggttcgaatcgtgaccctgctgctgcaaagccgtgcctttccttcgtgtgtctcgcgtgggtgataacagcaccttccctagagggctattgtggggattcaccgctgtgcagagagtgcttcggaccctccagcagcacagtcagggctgtgtcagtgttactaattgtcgctgtttgtgtactgataatgagatcagaatccagtttttctttttgcctggcagcatggacaactgtcctggtatcatagactgaataaagtttccttcttcagc

SEQ ID NO: 225262 - DNA, 603 bp, Homo sapiens
gtggaattatcacaataatgtatattttaaaatgcttttgtagttatgcctcagaataggcagatagatactgcctattcatatttgaacttctgtcctgtgaagagctagccccagaagggatcttttgcttttgattatttagcctatatttaagaggtttcttttctcttgaattgttatccccagctacttgttcagagatgtttgtaaatgaagggagtgagtgggaggaaaagcttatgttacttgtagaccagagaatagtatagcagctagaagtggtgtttgtctgtaggctacccttagttgatttgtgttgtcatgcaagaaacattttgatgcatttatttcaggacacggcattttggagacttcattaaatgctacctgttgctgtttgtgatggaatctagtctagaatgttaagaggcagtagaaaaagctgaaatggcaagaagatggcactcttcagtctttaagattcacctgtttgcattttagaaacacattaccattctttttgcttctcttaaaattggagctatttggattaaaattaaatttatcattatgatgtgacctacttggtgtcagttattt

SEQ ID NO: 225263 - DNA, 248 bp, Homo sapiens
agatgaacgtgatataaatgtcactattagagtcatcagataattcttatttttcttaaaagttatggatcaaattgttgagaaatatttattctctgatgagagctcaggaggtgttgtgcattatgtagtataaaggaggtgaccaggtaagtgacagataggtagactcagcttctctgcttctcataggactacctctacccacctctagttagcattatcaactcctcctgagctctcatcag

SEQ ID NO: 225264 - DNA, 287 bp, Homo sapiens
caagaggaactcagaaaaaggagtttgtaggcagcaaaatcttccatgcagtgaaagaacgtggtatgtaataaagccttcaactaggaaatgtttccttacttttcagggctgtttatctcctataacctataggagcatcagcatttaagaatctttgccagacacagtgactcatgcctaaaatctcagcactttgggaggccgagacgggtggatcacctgaggtcaggagttcaagaccagcctggccaacatggtgaaacaccatctctactaaaaataca

SEQ ID NO: 225265 - DNA, 422 bp, Homo sapiens
ggtgaagtattacagtcatcattacaactcgtcattgtggagagacatgggaaaatataatattgcattcagtgaaaaggctggaatacaaacttgtgcttaggttctgtaattctataagattgtgtaatacgggccgggcagagtggcttatgcctgtaatcctagcactttgggaggctgaggcgggaggattgcatgagcctaggattttgagaccagcctgggcaacatggtgaaaccccgtctctacaaaaaatacaaaaattagcctggtgtggtggcgcatggctgtagtcccagctactcgggaggctgaggtgggagaatcacctaagcccagggaggtcaaggctgtagtgagttgcagttgcaccactgcattccagcctgggtgacagagtgagaccctgtctcaaaaa

SEQ ID NO: 225266 - DNA, 407 bp, Homo sapiens
tctagggcccaggtcatttgaaataaaatattgagataaatctaattattgtttaagacaatatccagttaaaacaacctaagaagtatcactgatgagagtcaaagaacattttactgtggttgagttgaacaggtcagcaaaacttgtaggaggatgagaaagtttgatatacgctaaaggtagaaatagaagttaatgacaacactgccatgtaaatgggtgtttttttcttctttaagaaaagccccccaaatatcaaagctgaggtttcttttagtatgttttatgcacagtttgagtggagagaacctgttgtcaaatggcttgggtaaattcttgagctcagtattacaaagtgcatggaaatttcgttctttatagacatgtttaaccactgtggcaaa

SEQ ID NO: 225267 - DNA, 352 bp, Homo sapiens
gttaccagaggctaggaagagtaggagaagagtcgggggtacgtgggtgtggttgatgagtacaaacaatagttagaaaggatgaataagatatagtatttgctagcacaacagagtgactatagtcaaaaataattttattgtacatttttaaataattaaaagagtatacttgggttgtttgtaacacaaaaaataaatgcttgaggtgatggataccccttttgccctgatgtgattattatgcattacatgcctgtatcaaaatattacatgtaccccataaatatatacatctactatgtacccacaaaaattaaaaattaaaaaattaatctccagctttggagtc

SEQ ID NO: 225268 - DNA, 839 bp, Homo sapiens
aacaaattttattttctaatacttacaggcttatagaaaagttgcaaaggtagtacttcctgtgctaccttttccctgttgctagcatcttatgttattatggtacatttgtcacaaccaataaaccaacgttgatacattattattagctaaagtccatactttattcaggtgttcttagtttttacttatatctgttttttgttccagaatcccatccaagataccacattacacttagtcatcatatctctggctcctcgtggcaatgacatttctcaggtttttcttgtttttgatgcccttggctgttttgaggagtactggtcaggtattttgtagactgtctctctattggaatttgtctttttttttttttttttttaatgattagactggggttatctcatatgtatgcatttggcccaggaaaaatttataatctccaggctctgggcctgtagtgcctaatggacaaagtagcctgtgtgcacacaaatatatccagaattggaagaaagtgtatgtctgcttttataggctatacatatcctacaatgtatcgtctatacctggtgccatgttttgccagtctttcgtatgtgtgtgtgtgcccaaggagtgtccctcggcctttgagaaggctacgaagtctccgggttatatgaatatgccatgttcatatagtcccttgcaaggagacatgtagattgtagttatttttgctattgcagacagtgcttcacattttgtgcacaagtttgcgtctctctgaaggaaattgctaggaaggggcctgctggtctgagcatgcccatttcacatgttgatgagcactg

SEQ ID NO: 225269 - DNA, 507 bp, Homo sapiens
caataaaggactcctgaagtagtctcggagtgtggtgtttctctataactctctcggttatgacactttggaggccccagcgagatccgccaccgggtgagggccggactcgttccgggctcccccggagcaacggcgggcttacagggtaggcgccacctaaagatgctccagggccccgtaggccaccgtcttccagaggggaacggatcaactgctggtgtgcccaaccaaattcaactcctgagtcctcagtctccggtcccgggaaggtaagtcagatctgactctgtctccctgggagggaaatggctctgactaggtttctccctcagactctgtccacactctaggatgctggaggacagcgtcctggtttctgtcagtcttctctgttaagtctagtctctctctatctcttctccttctctcgttcaggtctctaggagacctcggttttaaacgggtataaaaaattgtaataaactctgtgagtgagtgagtaca

SEQ ID NO: 225270 - DNA, 567 bp, Homo sapiens
aggggtgaacatatcaaaacaggaaaaatgtgagtgtgaaaagaggttctgttgattacattgactgtcaaggtaagaagtgggagttttccagctaaaaggacagtccccgtccaattggatcatttggtcacactgtcatgacagacctgaagccaataacaattttgataattgtcctaggggctggtgtaggaagaactgggaggttttcttggatagagtccccttgcctaaacagatgctgtaattgtcacaaaaccatctctgcatgcttgttgttttgtgctgtctctggtctccttttggagggaagaactgcatgtgttaagatccaagggcagagaacctggtctacttgcatctctttgtctctccctgtggtttcttttcactgcacatatttgacaatttgatcccctgtctatgtggtatcttttgttaggtcttagtcaattttagcttttttccattttaacaacttcaaaaggcttagaattgtacctgaggtttccaccttgccagaatttctagtttagggcccactatttatctttttctttttat

SEQ ID NO: 225271 - DNA, 586 bp, Homo sapiens
ctgaatgcgggacttcatcaaactgggttccaggctgggaggtctctgaacccaatttctagacagcctgctttggagttcaactgatgggaccttagacaccagccttaccctctgcaagtcttgtgatttggagccagatacttggcctctctgtgctccagggagacaccactgcacctacctgagaggactgaaggagaggatctgtgcaactcactcaggatactggatcttaagccaatgggtggacttacattcgtcacctctgattctgtctcctcctgcgcggtgacttagcaaacacttcttcctctccagctctgcttcttactctccagctctgctgccctgttccagtgctgacgccagacaacagataatttcccaaatgcttgtattagcccttaggagttcatgtgttcctcccccagccaataaagctgttaaatcccaataactgtcaggaatggagccaattgctataaagtacttccagcttcttggcatgaagaaataattagaatatatgtgttggctttgaaacaacactcactggttcattaaaaaattctgtgcatattgt

SEQ ID NO: 225272 - DNA, 884 bp, Homo sapiens
gtgccctcacatgaggctctcgcattccacgcccggctccacgccagcgagccgggagtaggaaaagtaggaaagaaatgaaaggatattcacggtacattttaccacttgacactaatgatcaaggtccagtcattaggtcacacagccctacatttgaatttcttctatttcttttatcatctgtgttcttcagcaaatgacttgaagataacaatcttgtatcatgaacaatataataccagttgtcttattgtgtgcctggttattactatatctacttgctttgtagaaagaaatgtataaaacagaaatatctctcaagcaatgtaacctcttaacctctatcttcttatgcaggggataatttatggtttcattagccaatcattaaacaaacaacatttctaagggcctactttggactcccatagtactagtcactcaagatatagatacgaataaaatgcatccaagcatttaagagttccttatcaaggacgaaagacatatatacagtgaggagagacaacacaattttgggagctcagaacagaggtaccacagcatggaaagtcaagaagatgttttcaaacatttgacatctactcagctgagctgggtttgaaagatacattgaaattttctagcttcttgtgggaaagagtataagattaatatgagtaaacttgaagaagtgagaagaagtctgaaattccaagtacatcagttgtacttcatagtaaattaggtttcacagagaggtaagaaaataattgctacattgtttggcttttgggagagaacattccaagaatgagtacatagctcaaaaacgtaattacatatttaaaaggaaaataaaataagagatttttattatg

SEQ ID NO: 225273 - DNA, 327 bp, Homo sapiens
caaattttagaatcatggcacgtagttgaatggtaatgtggatattatcacttaagaggtgatatggataaggtgcaatgaatgtcttttcatttttcactgaggtgaaaatgaaatttcaccataaaatgaaattttatgatactgtgaggacagtatcataaaacctctagatgttcagaaactggccttctaaactgttaaagcgtcgcacatagtagtaggtcctcaagggaggcctttccacagggaaaaaaagtgaaatcataaagtttccacaagaggacacttggtggtgttttggagaactgatacaatgttaataga

SEQ ID NO: 225274 - DNA, 856 bp, Homo sapiens
taagcaaagggtattttatttaatattaggttatgtgtgtgcatgttgtgtgtacctgtgtgcatgtatgtgtgtttctctactgagcctggggtctctagccagggagaccccatcttattcaccatgtccaagatcctgggatctgggcccagcatctcttcctcctttgtagatgctggagcccagccaaggtctgggagctatatgggaagtgggggctgggatctgggtgggaatatgtgtttgtatacaaaggggccctccttaaaagggacaggatgaccttcccgaggaactcattggcctggggtagtttaagaagtaatgttctttctttctttctcttttccctacctcctgctaacccaaccagagatccccttccttgctgagagggttgggggcaggaggagatttggcagtgcctgcaggttgcctggccaggtggagagggggaaagaggaagggcaccgtgggtgtaagatgcctttctcctccacccatcgaaaccagccaccccttccctgtgccaccaagacagccttttccagtggccatcctaaggggaactcccaaatgggtgttgctggtggacacagatgctccccccaatggaagccccaagctctgaggtatgcgggtagaggctttggataggttttcttctgctcccctcttttatagatctaggctgcttggctgcctgtctttctaggcagtccccctagaggaaaaatgtaggaatttattttttctttaactgctgtgaactcactttgagggggtaggaggagggagaaacagcctgtgttttttatgcaataaagtcatcaactacatcatgaaaactttg

SEQ ID NO: 225275 - DNA, 375 bp, Homo sapiens
agccctcccaagcctgtcttcttgggtctctatggaggcttctttatgtcagcatttctgcccccagggtatggggtggagccttctctggaataagggtcttatgacccaagatcagattagggtcctgccttgggcaggtgaaaggaggcaggaaaaggtcagagagattttgtttcccgaggtttaacactcgcaacgttctttttttagttattctttttatttattttttaccttttcagtggtgctggcactcccaacattgtaacaaaagactaacaagggctctgggagttatgagataggaaccatggatcacacacacacacagccatggataacatggctaaaccccatctgtccaaaaaaaaa

SEQ ID NO: 225276 - DNA, 333 bp, Homo sapiens
tgatttcccttttgatttcccttcgatccacacgtttgaatttggtatttagttttcaaatattttgagattttccagagatctgctcttgatttctaatttaattccattgtagacctagaacatactttgtataacttgaatcctttgaagtttgagaggtgttttcttaatggcctagaacaagggtgtccaatcgtttggcttccctgggcctcgttggaagaattgtcttgggccacacataagatacactaacactaacgatagctgatgagctaaaaacaaagacaaaaacaaataaaaaaactcataatgttttaagaaagttta

SEQ ID NO: 225277 - DNA, 748 bp, Homo sapiens
ttacaggcatgggccactgtgctcagcctattttttactttttttagagatggggtcttgctgtgttacccaggctggagtgtagtggcatgatcatagctcactacagccttgaactcctcttgccattttttttatccttaaaatttccatgtctcactctcttgccaactgttctctctcatttggtcccttgattcactctaaactcaaaccctgataaagcagctgatcggtgaagtgtctgttgttactaaagtagaagttagaggcagaacagtggcagagagccctggaatctggcccttggtaggtgctccacaaatgtttgttgaacaaatgaataagtggagccaggttgtctatgccctagtcccagctctctcacatgcgctagtgagagatatatacatgtataaaaaaaaatctccctgtgcctcagtttcctcatctgtaaaatggggaagatcattataggcttgtaaatgaaatgaattaatacttataaaatgcttaaattagtcctggatcaaagtaagctttcaataaattgtaagctcttatgttcaagctctcagaaccagaatactcgagatgcagacaaaacattacctctcttaagaggtttgttggggaaagtatagctggagttaaaaatttaacctcttagataagtcactgttcaagctactggttttcatctccaccattccacctaaattgccaccaccttgctgaattagacaca

SEQ ID NO: 225278 - DNA, 510 bp, Homo sapiens
atgactttgtgatctgggatgatttatttggttctttgaagccctcattttctcttttgtaaagttcaggtaatagtacttcatagagttgattggaggactaaatgagataaggtaaaacactttacacttaatagtatcccctcaaacttggagaaaagctagaggatcagtcttaggttaaggtggacattttaatagcctcactggaaaaagagaaaaattaatcaagtaagtgtgagagacctcagcaactagactagagcaatctggagtcattaacacttggaaaatgtctttttatatccctcacttcctgctgagacttttgatctctctctttggattctcttcctctatatcataagagctggagtttcccaaagattcttcctctgccccgttcacattatattcatttttaactgccactactttgccagtcagtgagatattaccctaacttacaagcaaattctggccatgctaaccagtttaaaattataattt

SEQ ID NO: 225279 - DNA, 447 bp, Homo sapiens
gaggcttgcttgcctactccttctctctttccagagggaaaccttgtggtggttcctcactgtctattcattatgcaaggaaatgagggcttttaagggttcctcagatttttctccaccaaagagtgctttcacaagttattgaggcgtttgtttccattttaaagtaaacttttggaattttttttctccttttgagtggacctgaagggttttgacctccttcaggaaaggcaaggcaaaaaccttaaaacagttccactgaggtcttcacacaactttaagctgctccaggtctcctgaaagtcaccaggaaatgtgatttcctccttgtgaagatggtgatggccctaagctgagatttttttgagttctagggtttggttatcatcatgttttgatgcattgcaagactttattgtctgatttgagttgatttctgcaaat

SEQ ID NO: 225280 - DNA, 415 bp, Homo sapiens
cagatgcaggaaaaattctctaccctttcttttgtgcctaaaagcaatacataaacttgtctttgtgaaaatgacatgagtttttccctctcctgaaccaggatgaagagagctacccttatcaccacatatggagagccagcaccaagatgagtcagtataaaaagaccttactaaaataacccttactttcagtagtttcctgatatatttgctagtcactttcccacaagttatcacccctagaagcctaaaacccttctcctttgtctagtcacttctttaaaatttattgccttttgttaaaatggtatgtaatctcttaagcctaactgcttctttgtttttttttatttttttacttctttttttttatgaagcccttgtgcacacaaaattaaaaatattaatacta

SEQ ID NO: 225281 - DNA, 1719 bp, Homo sapiens
cccttgcgtggcgcgtcggtctcagagtcgcgtgacttcaaccccctcttcgggaggctgggtcgtcatgatccggaccccattgtcggcctctgcccatcgcctgctcctcccaggctcccgcggccgacccccgcgcaacatgcagcccacgggccgcgagggttcccgcgcgctcagccggcggtatctgcggcgtctgctgctcctgctactgctgctgctgctgcggcagcccgtaacccgcgcggagaccacgccgggcgcccccagagccctctccacgctgggctcccccagcctcttcaccacgccgggtgtccccagcgccctcactaccccaggcctcactacgccaggcacccccaaaaccctggaccttcggggtcgcgcgcaggccctgatgcggagtttcccactcgtggacggccacaatgacctgccccaggtcctgagacagcgttacaagaatgtgcttcaggatgttaacctgcgaaatttcagccatggtcagaccagcctggacaggcttagagacggcctcgtgggtgcccagttctggtcagcctccgtctcatgccagtcccaggaccagactgccgtgcgcctcgccctggagcagattgacctcattcaccgcatgtgtgcctcctactctgaactcgagcttgtgacctcagctgaaggtctgaacagctctcaaaagctggcctgcctcattggcgtggagggtggtcactcactggacagcagcctctctgtgctgcgcagtttctatgtgctgggggtgcgctacctgacacttaccttcacctgcagtacaccatgggcagagagttccaccaagttcagacaccacatgtacaccaacgtcagcggattgacaagctttggtgagaaagtagtagaggagttgaaccgcctgggcatgatgatagatttgtcctatgcatcggacaccttgataagaagggtcctggaagtgtctcaggctcctgtgatcttctcccactcagctgccagagctgtgtgtgacaatttgttgaatgttcccgatgatatcctgcagcttctgaagaagaacggtggcatcgtgatggtgacactgtccatgggggtgctgcagtgcaacctgcttgctaacgtgtccactgtggcagatcactttgaccacatcagggcagtcattggatctgagttcatcgggattggtggaaattatgacgggactggccggttccctcaggggctggaggatgtgtccacatacccagtcctgatagaggagttgctgagtcgtagctggagcgaggaagagcttcaaggtgtccttcgtggaaacctgctgcgggtcttcagacaagtggaaaaggtgagagaggagagcagggcgcagagccccgtggaggctgagtttccatatgggcaactgagcacatcctgccactcccacctcgtgcctcagaatggacaccaggctactcatctggaggtgaccaagcagccaaccaatcgggtcccctggaggtcctcaaatgcctccccataccttgttccaggccttgtggctgctgccaccatcccaaccttcacccagtggctctgctgacacagtcggtccccgcagaggtcactgtggcaaagcctcacaaagccccctctcctagttcattcacaagcatatgctgagaataaacatgttacacatggaaaaaggtg

SEQ ID NO: 225282 - DNA, 512 bp, Homo sapiens
gttaagtacattgaaattacatggcttttaagaatatctttggtgtgcagcttgactgctgatagaagcatgtgctgtagtgtaatttaaaggaagagatgattttctctacccaagaacagcagcctggtcttaatattctatgttcagagagatacattactttaggttaagaattaacacctgttactttgtccttctttgtggctggaaattgaaacagcaacaccttgatgtgaattaggacatgaaggtgatgggacaggattaagtactgcagcaaaagggcttgctgaaggaagggccaaaagggaggatgatgtattcagaaagctgactttgcctttttaccattttgcctcacactaatcccaaatacaaaatatttactctctgtgtgaaatcttcatacatttgtagtcttcctgcatttttattcctaatagacttagatacataaagcccaatttgaataggcaatgattaaagactcaataattaaaaacagaagt

SEQ ID NO: 225283 - DNA, 452 bp, Homo sapiens
gagttggagaccattattctaaatgaagtaattcagaaatggaaaaccaaatatcgtatgttctcacttataactggaagctaaggtatgaggatacaaaggcataagaatgatataatggactttggggactcaaggggaagggtaggaggcaggtgagggataaaagactacccatcggtatgtggtcaagtgatcttcaacaagggtgccaagaatacacaatgggggaaggatagactcttcaacaaatgttgtaaaagctagttatccacaagcaaaaaaaattaaaagtagaatcttatctcacaaacaaaaatcaactcaaaatgtattagtgatttatacataagacctgtaactgtaaaactcctagaagtcaacctatgagggaatcttcatgacattgggcttgggaatgatttcttgaatatgacaccaaaagcacaggc

SEQ ID NO: 225284 - DNA, 409 bp, Homo sapiens
aagtgaagttgggaaacagagccaagtgacaagctgtgaagtaacagctcagccttcacaaagcaaatgtgctttgtgcacttccttgccagagcagatgtggccttggtggactgtggggagcatcatctctcaggtaaaaataaattactaagattaggaccaaatgatgcaaatcctttcatttgcaaacagatcatgaactggcagccatgtggaaagaagactagactgcgaatcacttaggatcccaccctcggtttagtctagaatactctgcgaatcagctttttggccctaggtgagtgattttaaaagacattaaatgtgcaaatgcataaaatgaactcacgtagttcatggacacaggtgacataggaagttaatcaacaaaaaaatagaatgaaat

SEQ ID NO: 225285 - DNA, 299 bp, Homo sapiens
atgtaaggtattgactgctctttagccaggccatttctcaggattgtctttgcagcaagcaactttgagctgtgaagtaatatctccctgggttaaaaagcaagctcacttactgctttctataaaatgtgggttccccaaactcagtgctattgtcatgtaacacatttaccacatgtgtagaccttcatctgggcctttgtgttgtccctgttggactcagggagcaagagctgatgcaaaagttaatgctcatgctgcttgctgtgtgatgaataataaagttcattgtctctgac

SEQ ID NO: 225286 - DNA, 439 bp, Homo sapiens
ataagaccggaaggtgagagctccctggtctgccctttttttcctggaggctggggcttgcctggccaaggtcgcccttcatgagagggaatcagaactttgtgtggatgcctaaccccgccggggcagcgctggagagaatcactgctgaggctttcctgccggctgcagtgactgcccctttagggtccctgcaaaaacaccacccctgcaaggaatccaccgtgtcctgcttgccagcctaggtttactgatcatctggtgattccagagaaaacaatctacagtggaatgaccaagttctagaaagaggaaaacacaaacaatctgtggaaagtccgtttgtcgtctagatttttaaaagatacacattttcccttcttgttatattgagtagtgcatgaagccgatataatagatgtacaatcacactatagct

SEQ ID NO: 225287 - DNA, 1114 bp, Homo sapiens
gatctccaagctctacgaatatacgcataggatcctgccctcttcgaaaaaggaggaatgtgtattcacgttttctcgtttgcgcgtttcaggttctctggagggatagacactgaacggatgatggtagttgtctatggggtgagggaacaggtttatgaggaaggcatttctgcatctctttttatgcttttgaattttttaatcatgtgatattaaacatagttaagaacttttattataaagaattgaaagaggccgggcgtggtggctcacgtctgtaatcccattactttgggaggttgaggctggcagattgcttgaggccaggagttcgagaccagcatggccaacgtggcgagaccctgtctctactaaaagtaacaaaaattagctgggcctggtggcgagcgcctgtaggcccagttactcgggaggctgaggcggacgcagaggttgcagtgagccgagattgtgccactgcattccagcctaggtgacagagtaagaccctgtctcaaaaaagaaaaagaaaaaagaaaaaaaagaaaagagaaattaattatgaagaggtcttagaaaataaatctccaaacccacttatagtcacagataataattgggcgtacaggtatatgtctttccagtcattctttctgtgcattttatagctgtttgcgtggcttttatgccattcgagtcacgttggacaagcagttttgagccctgcatgattatataatgggcgcttccccaggtcattggaatgacttgtgggtgtcttgatcagtgtgtggttttctgtcgcatgaacagattgtggttcatgggcctgtttctgtactgttgtgcgttgaaggggtttccatggattcacacactggcgtgtgtctgatgcgccacccaacctgcatgggcaggaggaggtctctttgcctggggtcagggtgggggtgccctgttctccctctagtgggcgagacggggtctgctgggctgagtgagaggccgccctgaattcctcggtgtggatttcaggaagtggcatgacttgttctaactgaacgtttatttgatacgcccttggtacatgtgttttccagaagtgtaatac

SEQ ID NO: 225288 - DNA, 270 bp, Homo sapiens
ttgatcccacccccatggcgcccagcaaggttttgagcaccttttggattaatgccagaagaaatccttcaaaagtcaaagctccattccactctctggcttccgtggaggaagggctgaactgtgcctagttattttgaggtttgggacaaaccaaagaattgagcatagtggtgaatcgttttgaaatgagagacctagccaaggatatgttcacttagtaagaggtcacatcttctgcaaaataaaaaaatcaatcaaaaaaaaaaa

SEQ ID NO: 225289 - DNA, 196 bp, Homo sapiens
aacataacctctatttcacaaaaaagaaagctaacacttaaagaagtaacttgcccaagatcacacactaccaaagtggttaagttagggttagaacccatgcagcccaattccaaagaccccattctaatcaccatgctatcagcaatccctacccatggcacctaaaacagttcaaaacctttcccttgtctca

SEQ ID NO: 225290 - DNA, 401 bp, Homo sapiens
taaagatatgtttaacctctctgatactgacttgctcatgagaagaaagagagagggccaggcatcttgcccactactacccactatcaacacttaggcctgacatcagtctctcaattaatattctgggccaggtgcggtggctcacgtctgtaatcccagcactttgggaggctgaggcgggtggatcacgagatctggagatcgagaccatcctggtgaaaccccctctctactaaaaatacaaaaaattagctgggtgtggtggcaggtgcctgtagtcccagctactcaggaggctgaggcaggagaattgtttgaacccaggaggtggaggttgcagtgaaccgagaccatgccactgctctcctgcctgggcaacagagtgagactccgtctta

SEQ ID NO: 225291 - DNA, 473 bp, Homo sapiens
ttcagtcccctgccttcttagaaatcctttgtagtgatggtttgcattattctcctgtattagacaccttctttactgttttctggttctttcacaagtacttttttacataagctgttttgaagttgtaaatcatcctaaatcttttataagcctcatataatacatagtacaatgccagcctggactctagttttaatctaaatacatagggtttaatttagcagcataatctttttagtcttttgaatgatgaggtaacctcataggtattttggcccattttgtttttccttgaattacatatataactgactatttagactgactcctttagatctcctgggatgctgacctcttggctttccaattcatgagactattgtaaagaataagtgagttcattcatgtaaagtagtaaaacagtgcctgacaaaagtaaatgctcaataaattctaattgttatgaaata

SEQ ID NO: 225292 - DNA, 377 bp, Homo sapiens
gggaagtggaaagaggctgcatagcactcaggttctccctgaagttgagagtcttcctgggatttttgcagggtaattaagagcagattgtggctgcgcgcagtgactcgcgcctgtaatctcagcactttgggagtccaaggcaggcggatcacctgaggtcgggagttcaagaccagcctggccaacatggcgaaacctcttctctactaaaaatataaaaaatttgccgggcgtggtggcatgcacctgtagtcccagctactcaggaggctgaggcaggagaattgcttgaacctgggaggtggaggttgtagtgagccgagattgccccactgcacttcagcctgggtggcagagggagactccatctcaaa

SEQ ID NO: 225293 - DNA, 402 bp, Homo sapiens
tattttgtttgctgttatattccagtgcttggaatagggcctagcttaataaatattcatatttaatggcttaactaatgcaatttatgtttgtttctgtgacacatgaaggtaagtacacattcgaaaaagatgttcacttcccttctttagcatcccacatccaaacattttttttccctttctcttttgtcttgggctcaaacttaaattcatgtttaatctatgaaagcaaaacaatcttcaaaacaggccataaagccgggcgcggtggctcacgcctgtaatcccagcactttgggaggccaaggtgggcggataacctgaggtcaggagttcgagactagcttggccaacatggtgaaaccccatctctactaaaaatacaaaaattagccaggc

SEQ ID NO: 225294 - DNA, 387 bp, Homo sapiens
gcacgagaacaataagacaaatcctgaaatgcaggaaaaaagatgaaacaaaccagtgaatgcaatgattattgtgtcatctaatacttgaagattttaacaaagcaagtgtttcttctgtggcgatccctggtggcctccagaccttccattcatgtggcttctgactcagctcagccctggtgttgattctggggagggtccatgttcttggagtgctgcagtattcattgctttgtcatcagtcagatgggctgggaatctggattctgcgactgactagctgtgtgacctctagcatgtaacttaatctctttggggcttaccttttccatctggaaaacagaaagaataaaactctcagagttggtatgaggattaaagata

SEQ ID NO: 225295 - DNA, 136 bp, Homo sapiens
tagagactagagaaaggaagaaaacagtattaaacaaatatttcacatgctttttatatcagggtcatcttcataaacgattaatattttcaatttataagatactttaagttttgctccatgctacaatgtatct

SEQ ID NO: 225296 - DNA, 527 bp, Homo sapiens
ccatagtccccaatccctctagcactttggtttcataatgaaagacataagaggaaagaaagatcgcagagaagcagcacatggaaaccatcctgtctggagcagaggagcgaagagagaggacagtctggggtaagatgttgctgaggaaacccaattgggctgaggagtggctgggctcaccatcttcccttcttctgtctccccctccgtgggacagtgctgctccccgtgtccaaggtcagggacaggggacagggtgggattgccacttgggcagtgtcaaaaagaaaatagaaattcctgaggaatggctgagattgacatgaaagacagccctcaagtggcccccacacatcccttttgggaacctttcctctcttttacctgaagtaccttcataaatgagtgcctgcttaatttgttttttaaaaacggagtgaaaaacaggcaatgtttatgtctcaaagaagcgtttctgatgaaagcacaataaatgcagttttgcagtaccatgcaaagcaata

SEQ ID NO: 225297 - DNA, 741 bp, Homo sapiens
gagaaaggaaaataagtaaaacctacatgatttttgtaacataggcttggtcacattgctatatttcatctaagtgatggctatacagtttttctctgcttgtcacatttaacagagatataaaagttcttgctaaaaggctagtcttgtagagtacgtcatgaaggctcatcatgaatacatcatgaaagcccacttgggaagaaatcggagcaagacaactggcgaggcaaaaagaacaagcaggggcagacatggaaatccacctagtctgttttaaagagcccctgggcaggcaacttctgaggaggacgctgtcagcagaagtgccatcatataaacactacaccttcaaaaaagtttcctgaccctattgtcccctctgtgtcctcctcatttcagttaacatggcctgttaaaaaatcttgtcaccattagatgtttcatgtcttatttatttaacacacttgttctgtgtctggctaagaggactagcaagtcttttgtttaaaaatgtctttaggccggatgcagtggcttacgcctgtaatcccaacatgctgggattacaggcgtgagccactgcacgttggttattctctagacctcaggcatagcttctgccctgggatttctctttaccttcaccctggtcatttcttcctctcctgtctcctggatcccatagctgctgctttttggtttactttcctgttgggtggagtatatctttcagcatcc

SEQ ID NO: 225298 - DNA, 319 bp, Homo sapiens
tgaaactctaattacatttacatttagaataattgggaacacccctacccccatctggcttctgagtcatatccctacactataactttgatataggaaaaaagtataaaatctgcaaaaataatgtgaaagaaaaagaaacctcaaacaattagtttacaaacaatgccaagtgctaaagaaatatataatccttgaagcttgaaagccacagattactactcagaggtctgtcaaaagctttagccaaaatatttcatcaaaagcaggcccagctgaacacagtcaaaagggaattatcatggccaacctggtcaac

SEQ ID NO: 225299 - DNA, 524 bp, Homo sapiens
tgtgtctctctctgtctctctgtcagtctctctgtgtctctatctcggtctctgttgctctctctctgttgctctctctatctctctctgtctctgtctgtctctgtctctctatctctgtctctgtcgctctctctgtatctctctgtctctatctatctctgtccctctgcctctctgtctgtccctctgtctctctgtctctctgtctgtctgtctctctctctctctctctctgtctctctctctgtcttccagcctgtttgagacatcacccaccaagcggcctgggagggagacctccccttttctccagaggcaagccgcagggccctaactggaagggctggcccaggtcgccatcatcccccgcagtctgcagagggaaacgaaggcccagacctccccggagccaccctgaggagtctcacagacaactcctccctgacatgcaggctcagggctcatgcgggcaaggggtccgtggcaggcaggcaggaggagctggtaacaggcaccacttt

SEQ ID NO: 225300 - DNA, 735 bp, Homo sapiens
gataattaagttgtatcttaaggatgctttgtagctaaattttaaaatattgtttctaaatttttaaaaaacaccactggctctggtagtttttagaataaaagaaaatcagcaaatatgagtgacatagaataacaaacactgagcaggtaaatgtatataataggagtctctagagcattaatgatccaggcatttccccaaagcagcattttctaacctgtgttttgtgaaccccagggatataaagtatcctgaggttcacttattttaatttgtcttttaaaaagatggtgagtattttcctttcaaaatcgattagtttgaggacttctgagggtatatgagcaagcatacatggcattgttggtggaaatcagtcacctgattatcattcaaccgaatgttgccaggcaccatggtcttcttgacttttaatttttcttaaagagaagataccagacatatgcagaagtagaccgaatagtatcctgtgcttccaggttcaataagcctgcttcagtgagtatcaattcactgccagtttcattactacacccttacctggctactttgaagcaaattcctgataccatatcattatatctgtgagtatttcagcatgtaaatctaaaagataaggcctcaattttaaaaacctgtaatacctttattataattaaaaatagttaacagtttcttaataacattaatatctactgtccaaatttctag

SEQ ID NO: 225301 - DNA, 471 bp, Homo sapiens
aactctttttgcccaacagaatgtggacagcagaactgctttataaattgggaggaaggcacacctggaagatggtgatgccagcacaatgggaaatgtgccagtgtgtagaattcttctctggtctttgtaaatagaaatgctcactttctatgtgaaacacctaaatgattcgatgccaaacgcagaataagtttaaaggtagaacaagcaaatagctaaacaagggagtgtttcagaaaggaaatatgtcaagccttggctcaaaagcaaaacagtcttttcatgaagggaagtgttcacagcatctattaaatgcatactcagtcacaaaaataaaacccatctgtttaatattaacatttgtaataaacattttaaaaaaaggaatgtagaaggcaaaaatgtattgtaaaacaaaatgtacactcttgggataactaaaacttcctctgaaagaattgcagtact

SEQ ID NO: 225302 - DNA, 204 bp, Homo sapiens
taatataaaaacagctatattttggcactcaagaggcaaaagctaatatatgtgatgaaagaacacaaagcaaataaaatttgactatttcaaaatgatgcctcgggcaggtcctgtatccagaagaggatgttcatccagggtctggggctaaggtcatcttagcacagcccagctgccagcttccctcctctgccgcttccc

SEQ ID NO: 225303 - DNA, 385 bp, Homo sapiens
tgtctcccttcagatgaaggaactgatgctgagacttgcactctaccataggcggaagcacccaccaccctgttcccagccctggaagggcaaggaatgaatctgaggcaaatagggccagcactggcagtctgctcgattttccctcagagcatttatcttccttgacatatttacaattttttgtctatttttggtttctctaacttgactagaatgtaagatccacaaggcttgggctttgctcttttgttcactatgtccatagctcctgtaacagtgcctaaaacatagtaggcaatcaatagatattctttggataaacaaatatgcctcaacattgagtctaacttacagcagacattgaataaatatctattgaatg

SEQ ID NO: 225304 - DNA, 757 bp, Homo sapiens
ttagttttaaaaaattctaagcagcacataaatcatgaggttttttcacactgaaaaaaataaagaaagctcagtgctaaaatcacctgcagggccagcttgatgggcacgcagtctgtacaattgccctacccttggttaatgttcttaaaaatctcaataatttttgttcaaaggacctcatgttttcaatttgcactgcacttgcaaattaggtagccagcgctgatcctgtagcatcttctaaaatagaccttatggataagcagggcatttcctgtcccagaacagttgcccaatagcaaaaatggatttttgagtgaataaattgataaataaaaatgttttaatggcatagcataaaaacacaaacacttgtatctaacagtcaagcagaagaggttcttactcaaattaagaagtggaggcagaaagagtgaagggtgagaaaagggcactcagaagttcttttctatccaaatccatgagagcacaaagttgaccataatttcattgcctatgaagccaagtaaaagaaaataaacccttacttgtaaaagcaaatcaatatcttttaacttttgctattcttaatggatagctgcaatatactcaaacacattcaagagtttataagacattccgttgaaaatcattttctcttatcaaatttagacaggttcttttaatttgaatgaacactacttcttttgtgtaaatagtgtattataaattgtaatgttattatttgaggttt

SEQ ID NO: 225305 - DNA, 472 bp, Homo sapiens
gaggaaacattactaccaacgttacagaaataagaaggattataagagactataattattggataacctagataaaatgaccaaattcctagaaacacaaactaccaaaaccgagtcaagaaaaataggaaatctgactagacttacagcaagtaaagagactgaaccagtaatcaaaaatttccagccaagcttgatggctcacgccggtaatcccagcactttggaaggctaaggcaggagggtctcttgagagacctgcctgggaaacatggtgagacccctgtctctacagaaaaaaaaaaaaaaaaagatagccaggcgtggtggtgtgcacctgtagtcccagctactgggactggggtgggaggattgcttgagcccaggagttggtgctgcagtgagctatgaccaggccactgcaccccagcgtgggtgacagagcaagatcctgtgtctaaaacaaattaaa

SEQ ID NO: 225306 - DNA, 442 bp, Homo sapiens
ttccgggaacccgtcctgagctggccggactcaccattccaacctcagcccctgccactctccccacaccatcctgccatctttcaacctcaccaggctcatgtacgccaagcctgttcctgcctcagggcctttgtacgtgctgttccctctgcagaatgtcctcccgtggtctttgcctgactggctccttgctatcacctcttcagagaagccctccatcatcaccctgcctcaagtagcttcccagccacttgcctttacagtactcagttttattctttgtcactccattccccttccggcataggtgctccattaaatcaggaaccttgttgcttctggtatctggggtgtcccaccgctacccccatgtgagtgcctggcacatatagatacttgatacctgcttgctgaataaatgaataagtgcaacttggta

SEQ ID NO: 225307 - DNA, 273 bp, Homo sapiens
gactagaattttgatggcttgaaacttgttcttggctccttatttaccatcctgtgtcctcagaagctctgtgtttgtttgttatgtgggtatatcttccctaattagtgttattggtagttgtgcaaatcaacataatgtattaaagatatttaataaactttaaagtcctatacaaataaacatagtgtatattatggtacagtaaagccaccatatccatgggttctacatctggattcaaacaaatctgagttgaaaatacttggggca

SEQ ID NO: 225308 - DNA, 502 bp, Homo sapiens
tctcgctccatccctgacccagccttgtgcctatgtgccagtcatttgcctatttgctctttgactcattccctacccttcacctgcaaactaccttttccaggcttatttgccaactggctccagctgggtttaagtggaagactggaggaccagaggaagccagagaatttcctcccctgcctttctctgcttgtggtgatatctccagcagtggccttttcttctccatgattccaactcccagcagacagaccttccctctacagtcccaggtgcttctgaacacccccatgcagatgcagttcttcacctgtggtaccaccatcctctctctgttctaccagcctttgtcatagtaacggtttcctgctactgttaatatctgggtgagtttatcacccctatttggcttttcgcatcttctaaagatctttgtaactaagtactttcattaaagtgctcctattttattgcatgggccatgactaatgcagcctcc

SEQ ID NO: 225309 - DNA, 781 bp, Homo sapiens
taatccagtaggggtggtgcccgtataaaacaaggaagaggcaccagagctttctctgtctgtgtgcacactccgaggaatgccatatgggtcatagctagaatgtgaccatctgcgaggcaggaagagaaccctcatcagaaaccgaatcagccataactttgatcttgaacttctagcctccagaactgtgagaaataaatgtcaataaatgtctgttgtttaagccacccagtctatgggttttgtgttttgttatggcagcctgagatgaccagtacagtgaccatttaaacaaggtttttaatgtctctgagaaaagcctcattttcttatctgtagaataattatacctgcatttgaaaaacaaaaaaaactggcccaggcttagtatagggaaaggttaatttccaacaaaacttattggtagggaggccagtctatagtgatactttttgtaatgatttattttggtagacaatctcaattttaaaaaaagaagaagaaggaaatctataagtgaatgaatgaatggaggaaggaaaaaactgaatcgacatgaacatgcagggctattctccaaagaatcagccatcaccttgtcctgccacctgccacctctgcttcctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctga

SEQ ID NO: 225310 - DNA, 380 bp, Homo sapiens
tgcttcccgtcccgggccagggaacgcgcccacgcccgcccgtcccgcggcctctcccgggtgccgctgggcccgctactcacagcgctgtggcgtccgcggggatgcgcagcgcgggaccgagcgtccgcagcccgcggcccgcggcccgagcagttgacgcggcaggcggcgccgggcgctaggccgcagaggcaggggggctcgcaaggcccgcagccgcgcccggggccccccgccagcgccccgagccacaggcccaggcccagggccagcgccagccgggcgggcgcggcgggcggcatcgttagggcagcgcgcgcatggccccgccgtccccaggcccgcccgcgcgcggaggccgcggctcaggcggggcc

SEQ ID NO: 225311 - DNA, 243 bp, Homo sapiens
catggttttccaaagtattttatgaagtcatcatgcatttaattatttagtgagtagctgaggtggaatgtaaaggctaataatagttgtaagtaaaaaaacgcttatttaagaaatgttaaattggttgacattttgacaggaacattttaataagataaatgtgctatatgtgatttctttacatactttgttggtataatttggataattacattaaatatctttctaattttgcttttg

SEQ ID NO: 225312 - DNA, 419 bp, Homo sapiens
cccagtggctcacgcctgtaatcccagcaccttgggaggccgaggcgggcggatcatgaggtcaggagatcgagaccatcctggccaacatggtgaaaccccgtctctactaaaaatagaaaaattagccgactgtggtggcacgtgcctgtaatcccaggtactccggaggctgaggcaggagaatcgtttaaacctaggagatggaggttgcagtgagccgagattgtgccactgcactccagcctggcaacagagcaagacttcgcctcaaaaaaaaaaaaaaaaaaaaaaaaggaatagggccaacctcagaggtagaaatgcagcagagggaagagtagcgagcagagggaatgagcagcgtgaattacagtgagagcatcagcaaatggaatggcaagacataggggcccgca

SEQ ID NO: 225313 - DNA, 235 bp, Homo sapiens
aaaaaaaaaaaaaaaaaaaagcaaagcaaagaaaagaaagaaaatgaagttgttacttttgtaactgggtcccttaacttcaaaatgcattttaagggctgagcatggtggctcatgcctgtaatcccagcactttgggaggccgaggtgggtggatcacttgaggtcaggagttcgagaccagcttggtcaacatggtgaaaccccacctctactaaaaataccaaaaaattag

SEQ ID NO: 225314 - DNA, 689 bp, Homo sapiens
gcagccatggtgcccgaggtgcccggcgcggtcctgaccctctgcctctggctggaggcctcggagggctgcctggcggccggccccggagcagctgctgctcagctgctggacgagtcgctgtctgccgggagcgtcctgcgcgcccgctgcgcctccaggtgcctaagcttgccaatcatacgcatctctgccttcttccagcacttccaggtgcccacctgttccaagtttccaccgtctcgcctcagggaaattctggggggaccaaaaggagagggtcaccccacacctccaactcctgcaaatgagcccatccagaaagctgtctctggagcacatgcctgtttccatcttctcttgcacagtttcaggccatgtttaaggatgggagaagattgcctggcctccagcctggatgccagccagaacagtggttccctgctttggtgccagaatcacaagtgatgttctaaggtgaagaattatgaactgagttgatttcattatatatgatgcaaactaagtctttgtgatttccaagttaccaagcaggaaacaaatatttctacttggaaatctcagccctgaggcagtggccagtgattttggagaactatgaatgctttaccagttgtgagttcctcaaatacaccctgttggtgaagcagggggactgtccagctcct

SEQ ID NO: 225315 - DNA, 678 bp, Homo sapiens
catctcaattaaaaaaaaaaaaaaaagcattttcttcatattcgctacatatgtttgtaacattaatgagaaataagaaattacccttttccttgactaggtgtggaaactaaggcacagagaaatccaatatctttgcctaaggctatttagaaaggtaagggtagactgtgctgacactctaagcatagagaagctatttactgcatcaggtactgtgcttatccagggacatttggcattttcatctccttgttaaaatatatgtgtatatatatatatatatatatgaaagaaaaggaaagaaaagcaatttaagaaaaaaacaaaagataaagtggcaactagttttgtttttcacttcatgatcatgctcctagcagtttagaaaaagtttttttttttaaggcacacattaaactatcaaataggttgatccaaattgtccaaataatcttctagtcccagcatgtctttttttctctcatagaaattaggatcatatatttgtaaatgacttgtggaggagattgaagcagtcagtgtaaatggagtttctccaggtgctgatgcctaatcgctgggtaatagctgtggacttgctgtgagacctgcattattacaatgtaatcagaatcctgttgctctgctgttattgtcagccacttgtggaatttt

SEQ ID NO: 225316 - DNA, 333 bp, Homo sapiens
aatgggctgaaacatgtccccccactcaccacactgtaggtaacaagaagtagagaagagctgcagcccttctggaagcccagaccttggtgctccctgagccatggctgtgacatgctgtaacacctatttggggactctgcagttcctggtgtctctgagctttcgggcaccaccacattcccctcatccagacgctggtgcccacagtggaagccacttgtggcacatctggtccagccacagcctcaaagggagctggcatatggagcttcccaccctgccacagcagccagcgtgcctggctgtgcagtggccagaccctgtgttcac

SEQ ID NO: 225317 - DNA, 1742 bp, Homo sapiens
gctagatggcgagttagtgagtgcagcacaacagcatggcagtaggaatagaataggagtggaagagggcctaggacagagtcttaaataatactggcctttagggttggggaggtatcagccaataaaagacaagaaggaatttccagttatgcaggaaaaaaaaaatgaggatgaggctcataaaagctaagggaagagagtagaccgggacagaggagtcaagtaagatgagaactaaaatgccgttgaatttagcaccatgaaggtcattagtgacgttagtgagagctgttctagtggagcatttgagatggaagcttactttggaattgactgaaaagtaaatgggggttgagggaagaaatgcagcagtatggaggcaaaagatatgcacatttgatcacttacaaaatatgattacagaccaactaaaaacctaggagattccagaaaccggaatgtacttcaacacaaattcttgggatacagataaatgtcattcacttattcaccaaacatttatgaagcactcggttccaggtcttgtgctaaagaaacatgtcagtctgatggcttttcttgtgtagccacagtgattggagatgtctttggctttgcactttagctgctagttgttctatttaaacgtctaggtaagtaaataggttaaagtgctctcctgtgtaggacccttcctagtgtggttctgtcttcaaagtctatgattctcacctagagcagatgaggtgaacattcttcttattcccattcccattctggaatcctttttgcctctagattaatgggaatccaacatcagtgaagtgccctttgctgctgctgccagccattctgactccagagccagtgaataggtgctgcttccatcactaggtggaataacaggagcatgtgctgccaatcagcatggttgcctagcaacaggaggagatgctattcattgtctatcagtgtgggggcacaatatattttagtttaaggtgcttgatgaacacaatgattacatggaccctccatgtcagccttggaagttgtgattctgaggctgggaagctggactatctttggaagctaaatttggaagtgaaagggggatgtaggatatgatcatctggctacatagataagtattgcaaaataggatttgggtttctggctatggcttaagctgtaagaataatgggctcctggcaaaggataaagtgtatcatgaaacaagaaataatgtgtctggcaggcatgcaattctcattgaatatgaggaagtgggagacaaatgcctagataatctgaaaaacaaaaaagagattttacagaggacaccaggtataaagtagaaacaaccacagtgggaaagatacacagagtgaatatcaaattttagtacaagacagtactctgtctcctagatcttattgagatttggaagtgtcatgcaacatggtcactttgtggtcaccaactgtcctaaaaagatttgggacaaattccacagtgtcatggtatggatgaaaaaataggcactattgagaacacttaaagaacaagaaccgaaggtttttggctgtttctcatcatctcatggaaaggtgggcagggatcagggtgccacagaacccttcgtgtgtatctgtgttttagcgaaggaaccctctgctcccctgtggctctctctatttattgagaaagtggaaaacaacaacaacaaaaaaaaaaaa

SEQ ID NO: 225318 - DNA, 373 bp, Homo sapiens
cctagaagagtgaggactagggaatatatgtatgtgtgtatatacaggtatgtgtgtgtatatacatataaatatatatattatatgcaatatatatatatatttgtggtgcatagaaaagtggctgcccatgtcttaatcctggaacctgtgaatatattaccttacattcaaaaggaactttgtggatgaagttaagggtcctgagataattaccctggtttatctgggtgggcctggtataatcacagggttcttatgagagagagggaagaatcaaagaggaggagaacagattctcttctgaggtccttgattttagacttctgtcctccagaactgtaaaataataaatttgttttgttttaaacta

SEQ ID NO: 225319 - DNA, 399 bp, Homo sapiens
tgccttcaaaggatgcaagtgaggcttgatgttgaaagaataatgaacttcgtttgtttactccttaaaccaatatttctttagtgtgtactacatccagctactgtttgggacatcagaaatacagaaagaaataagacaaaggctctgatctacacaaatgtactttctagcgtatgtgaagggaggggaggagaaaagaaaatcgatatacaaacaaaagatgagtaagaaaaaaatcagactttaaaaaaatgccacatagaacaacgacaacaacaaaaaataggatgctatgaccaagagactagtggcagctccaggctgggcagtttgaaaaggccatataaagaggttacgaatctgacatttggatgacacaaggcaccaatcccagca

SEQ ID NO: 225320 - DNA, 412 bp, Homo sapiens
aattgcttgaactcgggaggcagaggttgcagtgagacgagatcgcgccactgcactccagcctgggtgtacagcgagactctgtctctaaaaaaaaaaaagaaaagaaagaaagaaaatgcagaggaagaaaaaaacgaaaattttgacctggaatagtaaatcagtagttttcagatccaagttacctcacttgcagagttcgaaccgaatgctgaaagaaacgatggagacattaaaacaggaatgctgaaatataagaaatcaagctgagaaagtctaactagaagtcaaaaagacattggaaaaagaacagacacagcagttagaagaaaagcatatgcttcatgaatgtatctcagggaaatgtacagtcaagctaaagagaaattgcagtgagctgcagttgccc

SEQ ID NO: 225321 - DNA, 268 bp, Homo sapiens
atcagtcttcaattagctatatttttaggagcctacctttacttagcctcacaacatgggccttagctttagcacttaatctgcacaaatacctggcttaagtgttatgactgactggctattcaaccaaccatacaaatgaccaattcggtaagaaagcatgaacttcagtgttgaaccaaatcaaccaacctcctcaatccaaatgaacaatgctattctaggagtctgtgctagaataaaatcctaatgcaaaggctgtcttaaa

SEQ ID NO: 225322 - DNA, 676 bp, Homo sapiens
gagacttaagtagtttgctcagaataacatacactatcccctcaaaatgcatgcaaacactatagtggacatattttgaagtacctcatcttatttatttatttatttatttatttatttatttatttattttgagatggagttttgctcttgttgcccaggctggagtgcaatggtgcgatctcagttcaccacaacctctgcctcccgggttcaagcaattctcctgcctcagcctcccgagtagctgggattacaggcatatgccaccatgcccggctagaagtacctcattttacattgactcctttaactccctctcatctacccattatgatgagttcccaaaagccatcaaagtccttaccctaggaatctggaattggaatggagaaagagttagaatttcagcctgtctggaattgtcatgtgtgtgcatttgggctctgtgggtaactctctgcatttgccccatagactaaatatcagagagatctggtatgcagtgagaatgacacagaggtccagagagaagcagagatccatgaaacaagaagatttgtgcagacttcccacttcccaactccaatcccccatgaagcttggctcattcctactgtttaatgtagtagaatgtccctgaatctcaataacaagttgtctatctttgctttaa

SEQ ID NO: 225323 - DNA, 211 bp, Homo sapiens
gtctcaaattttagtgggcatcgggaccacctggagggctgattaagccagattgccggttccactccccacaccaattcacttcatttctaacaagttctcaggtggtgctgacactgctggtgctgggactgcacttagaaccactggtgtagcaagtggtttcagaactatggagccattttctagctgttccttgctgtttccagtt

SEQ ID NO: 225324 - DNA, 362 bp, Homo sapiens
ggctaggaagtccaagatcaaggtgcttatagattcagtgtctggtgggggctcacttcctgctttatgagctatgccttctcactgtggtttcacatggtagaaaggggtagggctttctctctggcctcccttacaaaggcaccaaccccattcctgagggctctgccctcacaacgtaaaatttctgtacattctatgccatgctgaagctcattttacaaccctaagctctcaccttaaggtccatacatgctcctaaggaaaatccaccacagcgcactcagtcctcccgtggaggcacctgctgcactctgctgcagtgttcttcctttctaataaactttccttttccaaaccta

SEQ ID NO: 225325 - DNA, 309 bp, Homo sapiens
aggtatcacatacagcaacaggagagctgaataacaaaaagaagccagagatgagaaaactgggaagagcaagcaagggtaacacctataacctatagatgatgataagctggacaagttaggagaaaaaggataaaaaccacaggctggagcactggggacaaggagaaagtgtggaagattagataaataaataggctatttagactctgaacttcagttgtttgttcagattttattcaagtataaaggaaagccctggaaaggtaacaacatgagctaactggtgtcttatacattggttgctgc

SEQ ID NO: 225326 - DNA, 503 bp, Homo sapiens
ggccctcaaccttgttggcagcagggaccggtttcaaaatgaaactgttccacctcggatcagcaggcattagcttctcataaggagcacgcaacctaaatccctcgcatgcgcagttcacaatagagtttctgctcctgtgagaatctgacgccaccgctgatctgatgggaggcggagcccaggcagtaacacttgcttgcccactgctcacgtctgatgggtgcccccattcctcacaggctatggaccagtacccatctgcagcccagggttggggacccccaccatacatgctctgaaaataagtgtctttaagttgtgtttttctgtgtgacatcatctctgaacttgaacatgttcattacggcaagattgtaatcctgctgtattcctcgccctctgtattctatccctttaaaaactagatatttaaacattttatcctaatgtgtttcatcagaacactttgcacactttcttactaaaacggtatgtgggtg

SEQ ID NO: 225327 - DNA, 307 bp, Homo sapiens
aggattgtgttctcaatttccttttgaggcaatttgatgttactgtatagaaatgctactaaaaattgtatgttgattttgtaatctacaactttatggaatttattaatcaattttaacaggtttttggtggagtctttaagcttttctatatataaggttatgttatctataaggaaagacaattttacttcttcctttccaatttgaatcctttttatttctttgacttgcctaactgttctggttagtactttcagtactgtgttgaacaaaagtgagggtgagtacccatgtcttgttcctc

SEQ ID NO: 225328 - DNA, 476 bp, Homo sapiens
attcctatcaaaaattctgctggctttttttgtagacattgacaaactgatcttaaaattcatttggaagttcagaagacctagaatggccaaaccctgtagaaaaataaaacaaaacaaaattaaagaacttatacttccatatgtcaacacttttttacagtgctggagtcctcaagacagtgtgttatggcaagatcaaaggaatagaattaggaatcaaggaataaaccctcacatttattgcttttcaattgtttttcaacatgggtgtattttttgtgcttctataacataatttccaagacttggcaatttataaacaatggaaatttatttgttaagttctagaggctgggaagtcctagaataaggtgccagcatttagtatctggtgaaagctgctctctaagatagagtgttgaggctgactcctcacatggcaaaaaagatgcatgccatgtcctcacatggtg
